(12) United States Patent
Peters et al.

(10) Patent No.: US 12,258,637 B2
(45) Date of Patent: *Mar. 25, 2025

(54) COMPOSITIONS AND METHODS FOR ENHANCING AND/OR PREDICTING DNA AMPLIFICATION

(71) Applicant: ENVIROLOGIX INC., Portland, ME (US)

(72) Inventors: Lars Peters, Portland, ME (US); Stephen A. Judice, Portland, ME (US); Daniel Shaffer, Portland, ME (US); Breck Parker, Portland, ME (US)

(73) Assignee: ENVIROLOGIX INC., Portland, ME (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/938,585

(22) Filed: Oct. 6, 2022

(65) Prior Publication Data

US 2023/0220495 A1 Jul. 13, 2023

Related U.S. Application Data

(63) Continuation of application No. 15/306,032, filed as application No. PCT/US2015/027074 on Apr. 22, 2015, now Pat. No. 11,505,836.

(60) Provisional application No. 61/982,784, filed on Apr. 22, 2014.

(51) Int. Cl.
| | |
|---|---|
| *C12Q 1/68* | (2018.01) |
| *C07H 21/04* | (2006.01) |
| *C12Q 1/6844* | (2018.01) |
| *C12Q 1/6848* | (2018.01) |
| *C12Q 1/6853* | (2018.01) |
| *C12Q 1/6876* | (2018.01) |
| *C12Q 1/689* | (2018.01) |
| *C12Q 1/6895* | (2018.01) |

(52) U.S. Cl.
CPC ........... *C12Q 1/6895* (2013.01); *C07H 21/04* (2013.01); *C12Q 1/6844* (2013.01); *C12Q 1/6848* (2013.01); *C12Q 1/6853* (2013.01); *C12Q 1/6876* (2013.01); *C12Q 1/689* (2013.01); *C12Q 2600/156* (2013.01)

(58) Field of Classification Search
None
See application file for complete search history.

(56) References Cited

U.S. PATENT DOCUMENTS

| | | | |
|---|---|---|---|
| 5,455,166 A | 10/1995 | Walker | |
| 5,629,179 A | 5/1997 | Mierendorf et al. | |
| 5,952,202 A | 9/1999 | Aoyagi et al. | |
| 6,063,604 A | 5/2000 | Wick et al. | |
| 6,130,038 A | 10/2000 | Becker et al. | |
| 6,355,421 B1 | 3/2002 | Coull et al. | |
| 6,617,137 B2 | 9/2003 | Dean et al. | |
| 6,794,142 B2 | 9/2004 | Laird et al. | |
| 6,977,148 B2 | 12/2005 | Dean et al. | |
| 7,056,671 B2 | 6/2006 | Enoki et al. | |
| 7,074,600 B2 | 7/2006 | Dean et al. | |
| 7,094,539 B2 | 8/2006 | Gu et al. | |
| 7,112,423 B2 | 9/2006 | Van Ness et al. | |
| 7,282,328 B2 | 10/2007 | Kong et al. | |
| 7,662,594 B2 | 2/2010 | Kong et al. | |
| 8,574,847 B2 | 11/2013 | Becker et al. | |
| 9,096,897 B2 | 8/2015 | Shaffer et al. | |
| 9,322,053 B2 | 4/2016 | Shaffer et al. | |
| 9,631,231 B2 | 4/2017 | Shaffer et al. | |
| 9,845,510 B2 | 12/2017 | Peters et al. | |
| 10,077,467 B2 | 9/2018 | Shaffer et al. | |
| 10,100,370 B2 | 10/2018 | Parker et al. | |
| 10,584,376 B2 | 3/2020 | Shaffer et al. | |
| 10,793,922 B2 | 10/2020 | Peters et al. | |
| 11,208,687 B2 | 12/2021 | Shaffer et al. | |
| 11,505,836 B2 | 11/2022 | Peters et al. | |
| 2003/0060431 A1 | 3/2003 | Simmonds et al. | |
| 2003/0211483 A1 | 11/2003 | Schroeder et al. | |
| 2005/0059003 A1 | 3/2005 | Enoki et al. | |
| 2006/0115838 A1 | 6/2006 | Bazar et al. | |
| 2006/0216796 A1 | 9/2006 | Hashiguchi et al. | |
| 2007/0054296 A1 | 3/2007 | Piepenburg et al. | |
| 2007/0082011 A1 | 4/2007 | Lehrer et al. | |
| 2008/0254458 A1 | 10/2008 | Chou | |
| 2008/0274458 A1 | 11/2008 | Latham et al. | |
| 2009/0017452 A1 | 1/2009 | Ratain et al. | |
| 2009/0017453 A1 | 1/2009 | Maples et al. | |
| 2009/0048439 A1 | 2/2009 | Weisburg et al. | |
| 2009/0081670 A1 | 3/2009 | Maples et al. | |

(Continued)

FOREIGN PATENT DOCUMENTS

| | | |
|---|---|---|
| CN | 1633505 A | 6/2005 |
| CN | 101952459 A | 1/2011 |

(Continued)

OTHER PUBLICATIONS

Office Action dated May 17, 2023 in corresponding Canadian Patent Application No. 2,946,737 (3 pages).

International Search Report and Written Opinion dated Sep. 8, 2015 in corresponding International PCT Patent Application No. PCT/US2015/027074 (13 pages).

(Continued)

*Primary Examiner* — Suryaprabha Chunduru

(74) *Attorney, Agent, or Firm* — Greenberg Traurig, LLP; Melissa Hunter-Ensor; Nicholas R. Ballor

(57) ABSTRACT

The present invention features compositions and methods for amplifying a target oligonucleotide in a sample, including detection of the target oligonucleotide in real time.

10 Claims, 38 Drawing Sheets

Specification includes a Sequence Listing.

(56) References Cited

U.S. PATENT DOCUMENTS

| | | | |
|---|---|---|---|
| 2009/0092967 A1* | 4/2009 | Yao | C12Q 1/6806 435/6.12 |
| 2009/0197254 A1 | 8/2009 | Lee | |
| 2010/0092957 A1 | 4/2010 | Zhao et al. | |
| 2010/0099149 A1 | 4/2010 | Birnboim et al. | |
| 2010/0255546 A1 | 10/2010 | Uematsu et al. | |
| 2011/0081685 A1 | 4/2011 | Makarov et al. | |
| 2011/0151467 A1 | 6/2011 | Usui et al. | |
| 2012/0021461 A1 | 1/2012 | Millar et al. | |
| 2013/0217071 A1 | 8/2013 | Montesclaros et al. | |
| 2013/0280706 A1 | 10/2013 | Judice | |
| 2014/0093883 A1 | 4/2014 | Maples et al. | |
| 2017/0044628 A1 | 2/2017 | Peters et al. | |
| 2017/0166960 A1 | 6/2017 | Shaffer et al. | |
| 2017/0327911 A1 | 11/2017 | Peters et al. | |
| 2018/0363046 A1 | 12/2018 | Shaffer et al. | |
| 2020/0239947 A1 | 7/2020 | Shaffer et al. | |
| 2021/0025016 A1 | 1/2021 | Peters et al. | |

FOREIGN PATENT DOCUMENTS

| | | | |
|---|---|---|---|
| EP | 1201768 A2 | 5/2002 | |
| EP | 1420069 A1 | 5/2004 | |
| EP | 2836609 A1 | 2/2015 | |
| JP | 2002291490 A | 10/2002 | |
| JP | 2004532615 A | 10/2004 | |
| JP | 2008526228 A | 7/2008 | |
| JP | 2010505396 A | 2/2010 | |
| JP | 2010533494 A | 10/2010 | |
| JP | 2011521624 A | 7/2011 | |
| JP | 2014082936 A | 5/2014 | |
| KR | 20040028991 A | 4/2004 | |
| WO | 2002057479 A2 | 7/2002 | |
| WO | 2003008622 A2 | 1/2003 | |
| WO | 2003016569 A1 | 2/2003 | |
| WO | 2006074162 A2 | 7/2006 | |
| WO | 2008002920 A2 | 1/2008 | |
| WO | 2008040126 A1 | 4/2008 | |
| WO | 2009012246 A2 | 1/2009 | |
| WO | 2009135093 A2 | 11/2009 | |
| WO | 2010107946 A2 | 9/2010 | |
| WO | 2012022755 A1 | 2/2012 | |
| WO | WO-2012021493 A2 * | 2/2012 | C12Q 1/6851 |
| WO | 2013040491 A2 | 3/2013 | |
| WO | 2013155056 A1 | 10/2013 | |
| WO | 2014004852 A2 | 1/2014 | |
| WO | 2015164494 A1 | 10/2015 | |
| WO | 2015168134 A1 | 11/2015 | |
| WO | 2016064894 A2 | 4/2016 | |
| WO | 2016069345 A1 | 5/2016 | |
| WO | 2016122698 A1 | 8/2016 | |

OTHER PUBLICATIONS

Extended European Search Report dated Nov. 8, 2017 in corresponding European Patent Application No. 15783300.5 (10 pages).
Translation of the Office Action received Jan. 10, 2019 in corresponding Russian Patent Application No. 2016145402/10(072953) (3 pages).
Office Action dated Jan. 29, 2019 in corresponding European Patent Application No. 15783300.5 (4 pages).
Translation of the Office Action dated Mar. 5, 2019 in corresponding Japanese Patent Application No. 2016-563818 (4 pages).
Translation of the Office Action received Apr. 26, 2019 in corresponding Russian Patent Application No. 2016145402/10(072953) (4 pages).
Translation of the Search Report received Apr. 26, 2019 in corresponding Russian Patent Application No. 2016145402/10(072953) (2 pages).
Office Action mailed Sep. 10, 2019 in corresponding Mexican Patent Application No. MX/a/2016/013877 (4 pages).
English translation of the Office Action mailed Sep. 10, 2019 in corresponding Mexican Patent Application No. MX/a/2016/013877 (4 pages).
Office Action mailed Nov. 4, 2019 in corresponding Chinese Patent Application No. 201580033738.0 (11 pages).
English translation of the Office Action mailed Nov. 4, 2019 in corresponding Chinese Patent Application No. 201580033738.0 (11 pages).
Office Action dated Nov. 19, 2019 in corresponding Brazilian Patent Application No. BR112016024622-5 (4 pages).
English explanation of the Office Action dated Nov. 19, 2019 in corresponding Brazilian Patent Application No. BR112016024622-5.
Office Action dated Jan. 17, 2020 in corresponding Ukrainian Patent Application No. a201611679 (3 pages).
English translation of the Office Action dated Jan. 17, 2020 in corresponding Ukrainian Patent Application No. a201611679 (2 pages).
Examination Report mailed Feb. 24, 2020 in corresponding Indian Patent Application No. 201617039196 7 pages).
Office Action dated Feb. 25, 2020 in corresponding Mexican Patent Application No. MX/a/2016/013877 (4 pages).
English explanation of the Office Action dated Feb. 25, 2020 in corresponding Mexican Patent Application No. MX/a/2016/013877 (4 pages).
Office Action received Jul. 14, 2020 in corresponding Argentina Patent Application No. P150101211 (5 pages).
English explanation of the Office Action received Jul. 14, 2020 in corresponding Argentina Patent Application No. P150101211 (2 pages).
Examination Report dated Aug. 10, 2020 in corresponding Australian Patent Application No. 2015249739 (5 pages).
Office Action dated Sep. 1, 2020 in corresponding Chinese Patent Application No. 201580033738.0 (3 pages).
English translation of the Office Action dated Sep. 1, 2020 in corresponding Chinese Patent Application No. 201580033738.0 (2 pages).
Extended European Search Report dated Oct. 23, 2020 in corresponding European Patent Application No. 20171648.7 (10 pages).
Office Action dated Jan. 11, 2021 in corresponding Mexican Patent Application No. MX/a/2016/013877 (5 pages).
English translation of the Office Action dated Jan. 11, 2021 in corresponding Mexican Patent Application No. MX/a/2016/013877 (6 pages).
Office Action dated Mar. 3, 2021 in corresponding Chinese Patent Application No. 201580033738.0 (3 pages).
English translation of the Office Action dated Mar. 3, 2021 in corresponding Chinese Patent Application No. 201580033738.0 (1 page).
Office Action dated Apr. 14, 2021 in corresponding Canadian Patent Application No. 2,946,737 (5 pages).
Notice of Opposition dated Mar. 9, 2021 in corresponding European Patent Application No. 15783300.5 (47 pages).
Response submitted Sep. 29, 2021 in the opposition proceedings of corresponding European Patent Application No. 15783300.5 (128 pages).
Affidavit of Professor John SantaLucia submitted Sep. 29, 2021 in the opposition proceedings of corresponding European Patent Application No. 15783300.5 (44 pages).
Office Action dated May 5, 2022 in corresponding Canadian Patent Application No. 2,946,737 (3 pages).
Office Action dated Aug. 31, 2022 in corresponding European Patent Application No. 20171648.7 (6 pages).
Ehses, Sylvia, "Isothermal In Vitro Selection and Amplification to Investigate Evolutionary Processes," Dissertation, Ruhr-University Bochum, 2005, pp. 1-172.
Summons to attend oral proceedings dated Oct. 10, 2022 in the opposition proceedings of corresponding European Patent Application No. 15783300.5 (14 pages).
Summons to attend postponed oral proceedings dated Oct. 21, 2022 in the opposition proceedings of corresponding European Patent Application No. 15783300.5 (5 pages).
Written submission from patentee dated Mar. 13, 2023, in preparation to/during oral proceedings in the opposition proceedings of corresponding European Patent Application No. 15783300.5 (3 pages).

(56) References Cited

OTHER PUBLICATIONS

Written submission from opposition dated Mar. 16, 2023, in preparation to/during oral proceedings in the opposition proceedings of corresponding European Patent Application No. 15783300.5 (25 pages).
Minutes of the oral proceedings taking place on May 16, 2023, in the opposition proceedings of corresponding European Patent Application No. 15783300.5. Document dated Aug. 31, 2023 (14 pages).
Interlocutory decision and grounds for decision dated Aug. 31, 2023, in the opposition proceedings of corresponding European Patent Application No. 15783300.5 (17 pages).
Notice of Appeal dated Nov. 11, 2023, against decision in the opposition proceedings of corresponding European Patent Application No. 15783300.5 (2 pages).
Statement of Grounds of Appeal, Jan. 10, 2024, against decision in the opposition proceedings of corresponding European Patent Application No. 15783300.5 (48 pages).
Reply to Appeal dated May 16, 2024, against decision in the opposition proceedings of corresponding European Patent Application No. 15783300.5 (29 pages).
Lodish et al,. "Glossary," 4th edition, Molecular Cell Biology, NCBI Bookshelf, 2000. New York W. H. Freeman, pp. 1-46.
Niemz et al., "Point-of-care nucleic acid testing for infectious diseases," Trends in Biotechnology, May 2011, vol. 29, No. 5, pp. 240-250.
Nie et al., Evaluation of Alere I Influenza A&B for Rapid Detection of Influenza Viruses A and B, Journal of Clinical Microbiology, Sep. 2014, vol. 52, No. 9, pp. 3339-3344.
Sambrook et al., Extraction, Purification, and Analysis of mRNA from Eukaryotic Cells, Chapter 7, Protocol 1, Molecular Cloning, 2001.
Van Ness et al,. "Isothermal reactions for the amplification of oligonucleotides," Proceedings of the National Academy of Sciences, 2003, vol. 100, No. 8, 4504-4509.
Walker et al,. "Strand displacement amplification—an isothermal, in vitro DNA amplification technique" Nucleic Acids Research, 1992, vol. 2, No. 7, pp. 1691-1696.
Walker et al,. "Isothermal in vitro amplification of DNA by a restriction enzyme/DNA polymerase system," Proceedings of the National Academy of Sciences, 1992, vol. 89, pp. 392-396.
Wikipedia extract relating to primer dimers from Feb. 27, 2012 (2 pages).
Screenshots of User Manual on Viral RNA and DNA isolation, Nucleospin 8 Virus manual from Sep. 1, 2013 (accessed using the Wayback machine).
Notice of Opposition dated Feb. 21, 2020 in corresponding European Patent Application No. 13775206.9 (22 pages).
Summons to attend oral proceedings dated Oct. 12, 2020, in the opposition proceedings of corresponding European Patent Application No. 13775206.9 (1 page).
Notice of Opposition dated Mar. 3, 2021 in corresponding European Patent Application No. 15783300.5 (36 pages).
Written submission from patentee dated Jul. 9, 2021, in preparation to/during oral proceedings in the opposition proceedings of corresponding European Patent Application No. 13775206.9 (2 pages).
Written submission from opponent dated Jul. 22, 2021, in preparation to/during oral proceedings in the opposition proceedings of corresponding European Patent Application No. 13775206.9 (13 pages).
Written submission from patentee dated Aug. 20, 2021, in preparation to/during oral proceedings in the opposition proceedings of corresponding European Patent Application No. 13775206.9 (4 pages).
Minutes of the oral proceedings taking place on Sep. 22, 2021, in the opposition proceedings of corresponding European Patent Application No. 13775206.9. Document dated Nov. 5, 2021 (2 pages).
Interlocutory decision and grounds for decision dated Nov. 8, 2021 in the opposition proceedings of corresponding European Patnet Application No. 13775206.9 (13 pages).
Notice of Appeal dated Jan. 17, 2022, against decision in the opposition proceedings of corresponding European Patent Application No. 13775206.9 (2 pages).
Comparison between granted Claim 1 of the Patent and Claim 1 of EPA 22187762.4 filed on Sep. 26, 2022.
European Search Report and Search Opinion issued on divisional application (EPA 22187762.4) and Claims 1-15 of EPA 22187762.4 filed on Sep. 26, 2022.
Notice of Opposition dated Jul. 6, 2023 in corresponding European Patent Application No. 15852795.2 (13 pages).
Reply to Notice of Opposition dated Jul. 20, 2020 in corresponding European Patent Application No. 13775206.9 (33 pages).
Reply to Notice of Opposition dated Sep. 29, 2021 in corresponding European Patent Application No. 15783300.5 (15 pages).
Provisional and Non-binding opinion of the Opposition Division dated Oct. 10, 2022 in corresponding European Application No. 15783300.5 (8 pages).
Provisional and Non-binding opinion of the Opposition Division dated Oct. 12, 2022 in corresponding European Application No. 13775206.9 (8 pages).
Ahern et al, "Biochemical, regent kits offer scientists good return on investment," The Scientist, 1995, vol. 9 No. 15, pp. 1-5.
Armitage et al., "Hairpin-Forming Peptide Nucleic Acid Oligomers", Biochemistry, 1998, vol. 37, pp. 9417-9425.
Chu, Y.L., "Fundamental Concepts of Bioinformatics for Medical Use," Shaanxi Science and Technology Press, Oct. 31, 2005, p. 222.
Craw et al., "Isothermal nucleic acid amplification technologies for point-of-care diagnostics: a critical review," Lab Chip, 2012, vol. 12, pp. 2469-2486.
Dames et al., "Characterization of Aberrant Melting Peaks in Unlabeled Probe Assays," Journal of Molecular Diagnostics, Jul. 2007, vol. 9, No. 3, pp. 290-296.
Dirks et al., "Triggered amplification by hybridization chain reaction," Proceedings of the National Academy of Sciences of the United States of America, Oct. 26, 2004, vol. 101, No. 43, pp. 15275-15278.
Ehses et al., "Optimization and design of oligonucleotide setup for strand displacement amplification," Journal of Biochemical and Biophysical Methods, Jun. 30, 2005, vol. 63, No. 3, pp. 170-186.
Holland et al., "Detection of specific polymerase chain reaction product by utilizing the 5'-3' exonuclease activity of Thermus aquaticus DNA polymerase," Proceedings of the National Academy of Sciences of the United States of America, Aug. 1991, vol. 88, pp. 7276-7280.
IDT, "The Polymerase Chain Reaction," Integrated DNA Technologies, 2011, pp. 1-21.
Ito et al., "Synthesis, thermal stability and resistance to enzymatic hydrolysis of the oligonucleotides containing 5-(N-aminohexyl) carbamoyl-2'-O-methyluridines", Nucleic Acids Research, 2003, vol. 31, No. 10, pp. 2514-2523.
Krishnan et al., "Nucleic Acid Based Molecular Devices," Angewandte Chemie International Edition, Mar. 22, 2011, vol. 50, No. 14, pp. 3124-3156.
Li et al., "Enzymatic signal amplification of molecular beacons for sensitive DNA detection," Nucleic Acids Research, 2008, vol. 36, No. 6, e36, pp. 1-17.
Mann et al., "A thermodynamic approach to PCR primer design," Nucleic Acids Research, 2009, vol. 37, No. 13, e95, pp. 1-9.
Markham et al., "UNAFold: Software for Nucleic Acid Folding and Hybridization," Bioinformatics, vol. II: Structure, Function and Applications, Sep. 2, 2008, vol. 453, pp. 1-33.
Notomi et al., "Loop-mediated isothermal amplification of DNA," Nucleic Acids Research, 2000, vol. 28, No. 12, e63, pp. 1-7.
Owczarzy et al., "IDT SciTools: a suite for analysis and design of nucleic acid oligomers", Nucleic Acids Research, 2008, vol. 36, Web Server Issue, pp. W163-W169.
Paulasova et al., "The peptide nucleic acids (PNAs): a new generation of probes for genetic and cytogenetic analyses," Annales de Génétique, 2004m vol. 47, pp. 349-358.
"PCR Primer Design Guidelines," Premier Biosoft, www.premierbiosoft.com/tech_notes/PCR_Primer_Design.html.
Prediger, Ellen, "Designing PCR Primers and Probes," Decoded, Oct. 2013, vol. 3, No. 4, pp. 2-3.

(56) References Cited

OTHER PUBLICATIONS

"Primer Dimer," Wikipedia, the free encyclopedia, retrieved from the Internet Feb. 14, 2020 (2 pages). https://en.wikipedia.org/wiki/Primer_dimer.

Santalucia, JR et al., "The Thermodynamics of DNA Structural Motifs," Annual Review of Biophysics and Biomolecular Structure, 2004, vol. 33, pp. 415-440.

Santangelo et al., "Dual FRET molecular beacons for mRNA detection in living cells," Nucleic Acids Research, 2004, vol. 32, No. 6, e57, pp. 1-9.

Stofer et al., "Free Energy Calculations of Watson-Crick Base Pairing in Aqueous Solution," Journal of the American Chemical Society, 1999, vol. 121, No. 41, pp. 9503-9508.

Stratagene Catalog, "Gene Characterization Kits," Stratagene Catalog, 1988, p. 39.

Thornton et al., "Real-time PCR (qPCR) Primer Design Using Free Online Software," Biochemistry and Molecular Biology Education, 2011, vol. 39, No. 2, pp. 145-154.

Tyagi et al., "Molecular Beacons: Probes that Fluoresce upon Hybridization," Nature Biotechnology, Mar. 1996, vol. 14, pp. 303-308.

Untergasser et al., "Primer3—new capabilities and interfaces," Nucleic Acids Research, 2012, vol. 40, No. 15, e115, pp. 1-12.

Yan et al., "Isothermal amplified detection of DNA and RNA," Molecular BioSystems, 2014, vol. 10, No. 5, pp. 970-1003.

Office Action dated Dec. 3, 2024 in corresponding Brazilian Patent Application No. BR 12 2020 003948 5 (4 pages).

\* cited by examiner

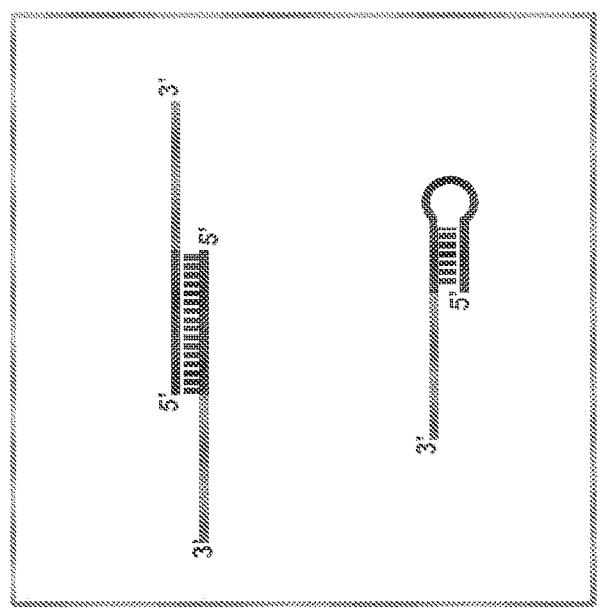
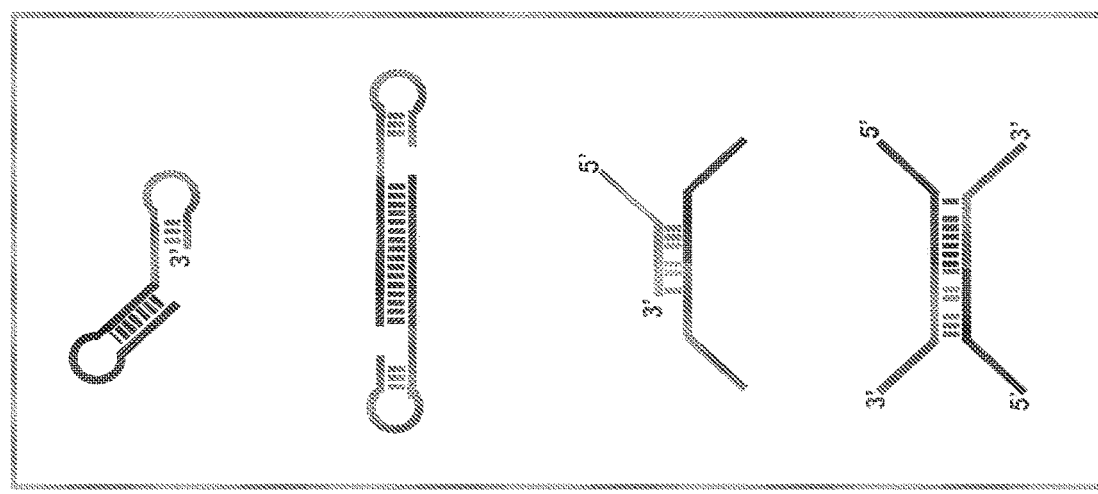
FIG. 4

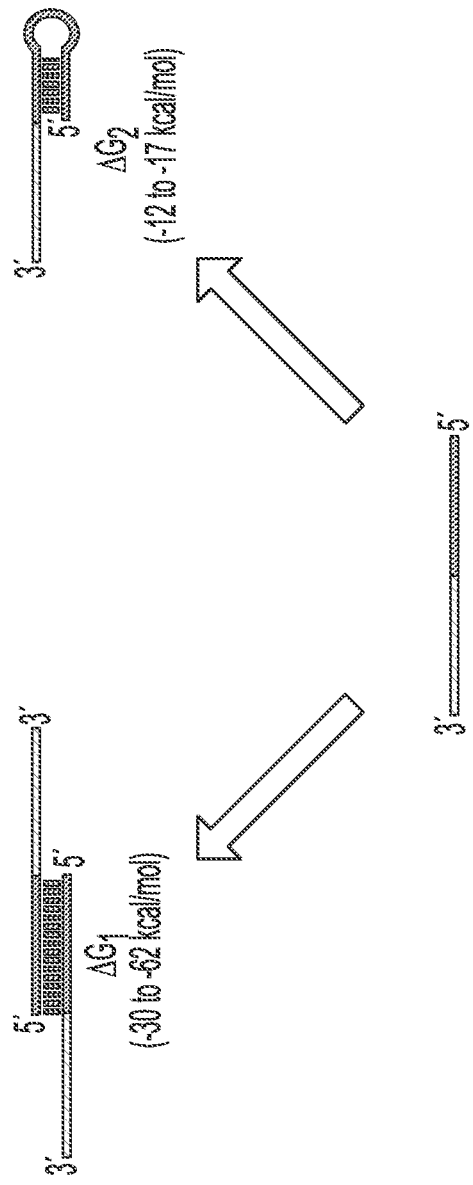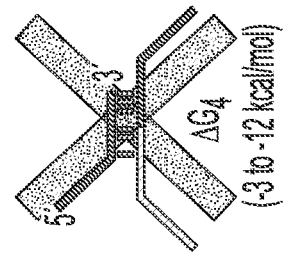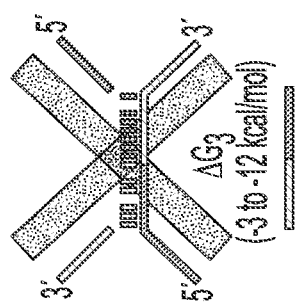
FIG. 6

Example of primer dimer structure with the nicking enzyme Nt.BstNBI recognition sequence positioned in the 3'-terminal half of the 5'-terminal inverted region.

X = any base comprising self-complementary, symmetrically inverted sequence of 5'-terminal region
Red = Nicking enzyme recognition/binding sequence
N = any base comprising 3'-terminal target-complementary primer region
Purple = modified base destabilizing mismatched base pair
• = Watson-Crick base pair between complementary nucleobases

```
                                            ↓ Nick Site
5' - XXXXGACTCXXXXXGAGTCXXXNNNNNNNNNN - 3'
        ••••••••••••••••••••••
3' - NNNNNNNNNNXXXCTGAGXXXXXCTCAGXXXX - 5'    ΔG₂₅°C ≤ -60 kcal/mol
                    ↑ Nick Site
```

FIG. 7

Sequences of 5'-tails
NNNNGACTCNNNNNNGAGTCNNNN (SEQ ID NO: 15272)
1100 Selected Sequences = 0.2% of entire sequence space (537824)
ΔG = -48 Kcal/mole to -62 kcal/mole    ΔΔG < -40 kcal/mole
GC content 68% to 84%

| SEQ ID NO: | | SEQ ID NO: | |
|---|---|---|---|
| 582 | GGCGGACTCGCGCGCGAGTCCGCC | 1974 | GGCGGACTCTCGCGAGAGTCCGCC |
| 591 | GCCCGACTCGCGCGCGAGTCGGGC | 1983 | GCCCGACTCTCGCGAGAGTCGGGC |
| 599 | GGGCGACTCGCGCGCGAGTCGCCC | 1991 | GGGCGACTCTCGCGAGAGTCGCCC |
| 603 | GGGAGACTCGCGCGCGAGTCTCCC | 1995 | GGGAGACTCTCGCGAGAGTCTCCC |
| 606 | GGGTGACTCGCGCGCGAGTCACCC | 1998 | GGGTGACTCTCGCGAGAGTCACCC |
| 602 | GGACGACTCGCGCGCGAGTCGTCC | 1994 | GGACGACTCTCGCGAGAGTCGTCC |
| 594 | GCACGACTCGCGCGCGAGTCGTGC | 1986 | GCACGACTCTCGCGAGAGTCGTGC |
| 593 | GACCGACTCGCGCGCGAGTCGGTC | 1985 | GACCGACTCTCGCGAGAGTCGGTC |
| 597 | GTCCGACTCGCGCGCGAGTCGGAC | 1989 | GTCCGACTCTCGCGAGAGTCGGAC |
| 592 | ACCCGACTCGCGCGCGAGTCGGGT | 1984 | ACCCGACTCTCGCGAGAGTCGGGT |
| 596 | TCCCGACTCGCGCGCGAGTCGGGA | 1988 | TCCCGACTCTCGCGAGAGTCGGGA |
| 595 | GCCAGACTCGCGCGCGAGTCTGGC | 1987 | GCCAGACTCTCGCGAGAGTCTGGC |
| 598 | GCCTGACTCGCGCGCGAGTCAGGC | 1990 | GCCTGACTCTCGCGAGAGTCAGGC |
| 584 | GACGGACTCGCGCGCGAGTCCGTC | 1976 | GACGGACTCTCGCGAGAGTCCGTC |
| 588 | GTCGGACTCGCGCGCGAGTCCGAC | 1980 | GTCGGACTCTCGCGAGAGTCCGAC |
| 583 | AGCGGACTCGCGCGCGAGTCCGCT | 1975 | AGCGGACTCTCGCGAGAGTCCGCT |
| 587 | TGCGGACTCGCGCGCGAGTCCGCA | 1979 | TGCGGACTCTCGCGAGAGTCCGCA |
| 585 | GGAGGACTCGCGCGCGAGTCCTCC | 1977 | GGAGGACTCTCGCGAGAGTCCTCC |
| 589 | GGTGGACTCGCGCGCGAGTCCACC | 1981 | GGTGGACTCTCGCGAGAGTCCACC |
| 586 | GGCAGACTCGCGCGCGAGTCTGCC | 1978 | GGCAGACTCTCGCGAGAGTCTGCC |
| 590 | GGCTGACTCGCGCGCGAGTCAGCC | 1982 | GGCTGACTCTCGCGAGAGTCAGCC |
| 621 | CACGGACTCGCGCGCGAGTCCGTG | 2013 | CACGGACTCTCGCGAGAGTCCGTG |
| 623 | CTCGGACTCGCGCGCGAGTCCGAG | 2015 | CTCGGACTCTCGCGAGAGTCCGAG |
| 609 | CCAGGACTCGCGCGCGAGTCCTGG | 2001 | CCAGGACTCTCGCGAGAGTCCTGG |
| 613 | CCTGGACTCGCGCGCGAGTCCAGG | 2005 | CCTGGACTCTCGCGAGAGTCCAGG |
| 622 | CCCAGACTCGCGCGCGAGTCTGGG | 2014 | CCCAGACTCTCGCGAGAGTCTGGG |
| 624 | CCCTGACTCGCGCGCGAGTCAGGG | 2016 | CCCTGACTCTCGCGAGAGTCAGGG |
| 607 | ACGGGACTCGCGCGCGAGTCCCGT | 1999 | ACGGGACTCTCGCGAGAGTCCCGT |
| 611 | TCGGGACTCGCGCGCGAGTCCCGA | 2003 | TCGGGACTCTCGCGAGAGTCCCGA |
| 608 | CAGGGACTCGCGCGCGAGTCCCTG | 2000 | CAGGGACTCTCGCGAGAGTCCCTG |
| 612 | CTGGGACTCGCGCGCGAGTCCCAG | 2004 | CTGGGACTCTCGCGAGAGTCCCAG |
| 15329 | CCGGGACTCCGCGCGGAGTCCCGG | 15399 | CCGGGACTCTGCGCAGAGTCCCGG |
| 15330 | CCCGGACTCCGCGCGGAGTCCGGG | 15400 | CCCGGACTCTGCGCAGAGTCCGGG |
| 176 | GGCGGACTCCGCGCGGAGTCCGCC | 408 | GGCGGACTCTGCGCAGAGTCCGCC |
| 15331 | GCCGGACTCCGCGCGGAGTCCGGC | 15401 | GCCGGACTCTGCGCAGAGTCCGGC |

FIG. 8A

| | | | |
|---|---|---|---|
| 185 | GCCCGACTCCGCGCGGAGTCGGGC | 417 | GCCCGACTCTGCGCAGAGTCGGGC |
| 15332 | GGCCGACTCCGCGCGGAGTCGGCC | 15402 | GGCCGACTCTGCGCAGAGTCGGCC |
| 193 | GGGCGACTCCGCGCGGAGTCGCCC | 425 | GGGCGACTCTGCGCAGAGTCGCCC |
| 197 | GGGAGACTCCGCGCGGAGTCTCCC | 429 | GGGAGACTCTGCGCAGAGTCTCCC |
| 200 | GGGTGACTCCGCGCGGAGTCACCC | 432 | GGGTGACTCTGCGCAGAGTCACCC |
| 196 | GGACGACTCCGCGCGGAGTCGTCC | 428 | GGACGACTCTGCGCAGAGTCGTCC |
| 15333 | GGTCGACTCCGCGCGGAGTCGACC | 15403 | GGTCGACTCTGCGCAGAGTCGACC |
| 188 | GCACGACTCCGCGCGGAGTCGTGC | 420 | GCACGACTCTGCGCAGAGTCGTGC |
| 15334 | GCTCGACTCCGCGCGGAGTCGAGC | 15404 | GCTCGACTCTGCGCAGAGTCGAGC |
| 187 | GACCGACTCCGCGCGGAGTCGGTC | 419 | GACCGACTCTGCGCAGAGTCGGTC |
| 191 | GTCCGACTCCGCGCGGAGTCGGAC | 423 | GTCCGACTCTGCGCAGAGTCGGAC |
| 186 | ACCCGACTCCGCGCGGAGTCGGGT | 418 | ACCCGACTCTGCGCAGAGTCGGGT |
| 190 | TCCCGACTCCGCGCGGAGTCGGGA | 422 | TCCCGACTCTGCGCAGAGTCGGGA |
| 189 | GCCAGACTCCGCGCGGAGTCTGGC | 421 | GCCAGACTCTGCGCAGAGTCTGGC |
| 192 | GCCTGACTCCGCGCGGAGTCAGGC | 424 | GCCTGACTCTGCGCAGAGTCAGGC |
| 178 | GACGGACTCCGCGCGGAGTCCGTC | 410 | GACGGACTCTGCGCAGAGTCCGTC |
| 182 | GTCGGACTCCGCGCGGAGTCCGAC | 414 | GTCGGACTCTGCGCAGAGTCCGAC |
| 15335 | ACCGGACTCCGCGCGGAGTCCGGT | 15405 | ACCGGACTCTGCGCAGAGTCCGGT |
| 15336 | TCCGGACTCCGCGCGGAGTCCGGA | 15406 | TCCGGACTCTGCGCAGAGTCCGGA |
| 177 | AGCGGACTCCGCGCGGAGTCCGCT | 409 | AGCGGACTCTGCGCAGAGTCCGCT |
| 181 | TGCGGACTCCGCGCGGAGTCCGCA | 413 | TGCGGACTCTGCGCAGAGTCCGCA |
| 179 | GGAGGACTCCGCGCGGAGTCCTCC | 411 | GGAGGACTCTGCGCAGAGTCCTCC |
| 183 | GGTGGACTCCGCGCGGAGTCCACC | 415 | GGTGGACTCTGCGCAGAGTCCACC |
| 180 | GGCAGACTCCGCGCGGAGTCTGCC | 412 | GGCAGACTCTGCGCAGAGTCTGCC |
| 184 | GGCTGACTCCGCGCGGAGTCAGCC | 416 | GGCTGACTCTGCGCAGAGTCAGCC |
| 215 | CACGGACTCCGCGCGGAGTCCGTG | 447 | CACGGACTCTGCGCAGAGTCCGTG |
| 217 | CTCGGACTCCGCGCGGAGTCCGAG | 449 | CTCGGACTCTGCGCAGAGTCCGAG |
| 203 | CCAGGACTCCGCGCGGAGTCCTGG | 435 | CCAGGACTCTGCGCAGAGTCCTGG |
| 207 | CCTGGACTCCGCGCGGAGTCCAGG | 439 | CCTGGACTCTGCGCAGAGTCCAGG |
| 216 | CCCAGACTCCGCGCGGAGTCTGGG | 448 | CCCAGACTCTGCGCAGAGTCTGGG |
| 218 | CCCTGACTCCGCGCGGAGTCAGGG | 450 | CCCTGACTCTGCGCAGAGTCAGGG |
| 201 | ACGGGACTCCGCGCGGAGTCCCGT | 433 | ACGGGACTCTGCGCAGAGTCCCGT |
| 205 | TCGGGACTCCGCGCGGAGTCCCGA | 437 | TCGGGACTCTGCGCAGAGTCCCGA |
| 202 | CAGGGACTCCGCGCGGAGTCCCTG | 434 | CAGGGACTCTGCGCAGAGTCCCTG |
| 206 | CTGGGACTCCGCGCGGAGTCCCAG | 438 | CTGGGACTCTGCGCAGAGTCCCAG |
| | | | |
| 15337 | GGCGGACTCGGGCCCGAGTCCGCC | 350 | GGCGGACTCTGGCCAGAGTCCGCC |
| 15338 | GCCCGACTCGGGCCCGAGTCGGGC | 359 | GCCCGACTCTGGCCAGAGTCGGGC |
| 15339 | GGGCGACTCGGGCCCGAGTCGCCC | 367 | GGGCGACTCTGGCCAGAGTCGCCC |
| 15340 | GGGAGACTCGGGCCCGAGTCTCCC | 371 | GGGAGACTCTGGCCAGAGTCTCCC |
| 15341 | GGGTGACTCGGGCCCGAGTCACCC | 374 | GGGTGACTCTGGCCAGAGTCACCC |
| 15342 | GGACGACTCGGGCCCGAGTCGTCC | 370 | GGACGACTCTGGCCAGAGTCGTCC |
| 15343 | GCACGACTCGGGCCCGAGTCGTGC | 362 | GCACGACTCTGGCCAGAGTCGTGC |
| 15344 | GACCGACTCGGGCCCGAGTCGGTC | 361 | GACCGACTCTGGCCAGAGTCGGTC |

FIG. 8A (CONTINUED)

| | | | |
|---|---|---|---|
| 15345 | GTCCGACTCGGGCCCGAGTCGGAC | 365 | GTCCGACTCTGGCCAGAGTCGGAC |
| 15346 | ACCCGACTCGGGCCCGAGTCGGGT | 360 | ACCCGACTCTGGCCAGAGTCGGGT |
| 15347 | TCCCGACTCGGGCCCGAGTCGGGA | 364 | TCCCGACTCTGGCCAGAGTCGGGA |
| 15348 | GCCAGACTCGGGCCCGAGTCTGGC | 363 | GCCAGACTCTGGCCAGAGTCTGGC |
| 15349 | GCCTGACTCGGGCCCGAGTCAGGC | 366 | GCCTGACTCTGGCCAGAGTCAGGC |
| 15350 | GACGGACTCGGGCCCGAGTCCGTC | 352 | GACGGACTCTGGCCAGAGTCCGTC |
| 15351 | GTCGGACTCGGGCCCGAGTCCGAC | 356 | GTCGGACTCTGGCCAGAGTCCGAC |
| 15352 | AGCGGACTCGGGCCCGAGTCCGCT | 351 | AGCGGACTCTGGCCAGAGTCCGCT |
| 15353 | TGCGGACTCGGGCCCGAGTCCGCA | 355 | TGCGGACTCTGGCCAGAGTCCGCA |
| 15354 | GGAGGACTCGGGCCCGAGTCCTCC | 353 | GGAGGACTCTGGCCAGAGTCCTCC |
| 15355 | GGTGGACTCGGGCCCGAGTCCACC | 357 | GGTGGACTCTGGCCAGAGTCCACC |
| 15356 | GGCAGACTCGGGCCCGAGTCTGCC | 354 | GGCAGACTCTGGCCAGAGTCTGCC |
| 15357 | GGCTGACTCGGGCCCGAGTCAGCC | 358 | GGCTGACTCTGGCCAGAGTCAGCC |
| 15358 | CACGGACTCGGGCCCGAGTCCGTG | 389 | CACGGACTCTGGCCAGAGTCCGTG |
| 15359 | CTCGGACTCGGGCCCGAGTCCGAG | 391 | CTCGGACTCTGGCCAGAGTCCGAG |
| 15360 | CCAGGACTCGGGCCCGAGTCCTGG | 377 | CCAGGACTCTGGCCAGAGTCCTGG |
| 15361 | CCTGGACTCGGGCCCGAGTCCAGG | 381 | CCTGGACTCTGGCCAGAGTCCAGG |
| 15362 | CCCAGACTCGGGCCCGAGTCTGGG | 390 | CCCAGACTCTGGCCAGAGTCTGGG |
| 15363 | CCCTGACTCGGGCCCGAGTCAGGG | 392 | CCCTGACTCTGGCCAGAGTCAGGG |
| 15364 | ACGGGACTCGGGCCCGAGTCCCGT | 375 | ACGGGACTCTGGCCAGAGTCCCGT |
| 15365 | TCGGGACTCGGGCCCGAGTCCCGA | 379 | TCGGGACTCTGGCCAGAGTCCCGA |
| 15366 | CAGGGACTCGGGCCCGAGTCCCTG | 376 | CAGGGACTCTGGCCAGAGTCCCTG |
| 15367 | CTGGGACTCGGGCCCGAGTCCCAG | 380 | CTGGGACTCTGGCCAGAGTCCCAG |
| | | | |
| 1046 | GGCGGACTCCCGCGGGAGTCCGCC | 1974 | GGCGGACTCTCGCGAGAGTCCGCC |
| 1055 | GCCCGACTCCCGCGGGAGTCGGGC | 1983 | GCCCGACTCTCGCGAGAGTCGGGC |
| 1063 | GGGCGACTCCCGCGGGAGTCGCCC | 1991 | GGGCGACTCTCGCGAGAGTCGCCC |
| 1067 | GGGAGACTCCCGCGGGAGTCTCCC | 1995 | GGGAGACTCTCGCGAGAGTCTCCC |
| 1070 | GGGTGACTCCCGCGGGAGTCACCC | 1998 | GGGTGACTCTCGCGAGAGTCACCC |
| 1066 | GGACGACTCCCGCGGGAGTCGTCC | 1994 | GGACGACTCTCGCGAGAGTCGTCC |
| 1058 | GCACGACTCCCGCGGGAGTCGTGC | 1986 | GCACGACTCTCGCGAGAGTCGTGC |
| 1057 | GACCGACTCCCGCGGGAGTCGGTC | 1985 | GACCGACTCTCGCGAGAGTCGGTC |
| 1061 | GTCCGACTCCCGCGGGAGTCGGAC | 1989 | GTCCGACTCTCGCGAGAGTCGGAC |
| 1056 | ACCCGACTCCCGCGGGAGTCGGGT | 1984 | ACCCGACTCTCGCGAGAGTCGGGT |
| 1060 | TCCCGACTCCCGCGGGAGTCGGGA | 1988 | TCCCGACTCTCGCGAGAGTCGGGA |
| 1059 | GCCAGACTCCCGCGGGAGTCTGGC | 1987 | GCCAGACTCTCGCGAGAGTCTGGC |
| 1062 | GCCTGACTCCCGCGGGAGTCAGGC | 1990 | GCCTGACTCTCGCGAGAGTCAGGC |
| 1048 | GACGGACTCCCGCGGGAGTCCGTC | 1976 | GACGGACTCTCGCGAGAGTCCGTC |
| 1052 | GTCGGACTCCCGCGGGAGTCCGAC | 1980 | GTCGGACTCTCGCGAGAGTCCGAC |
| 1047 | AGCGGACTCCCGCGGGAGTCCGCT | 1975 | AGCGGACTCTCGCGAGAGTCCGCT |
| 1051 | TGCGGACTCCCGCGGGAGTCCGCA | 1979 | TGCGGACTCTCGCGAGAGTCCGCA |
| 1049 | GGAGGACTCCCGCGGGAGTCCTCC | 1977 | GGAGGACTCTCGCGAGAGTCCTCC |
| 1053 | GGTGGACTCCCGCGGGAGTCCACC | 1981 | GGTGGACTCTCGCGAGAGTCCACC |
| 1050 | GGCAGACTCCCGCGGGAGTCTGCC | 1978 | GGCAGACTCTCGCGAGAGTCTGCC |

FIG. 8A (CONTINUED)

| | | | |
|---|---|---|---|
| 1054 | GGCTGACTCCCGCGGGAGTCAGCC | 1982 | GGCTGACTCTCGCGAGAGTCAGCC |
| 1085 | CACGGACTCCCGCGGGAGTCCGTG | 2013 | CACGGACTCTCGCGAGAGTCCGTG |
| 1087 | CTCGGACTCCCGCGGGAGTCCGAG | 2015 | CTCGGACTCTCGCGAGAGTCCGAG |
| 1073 | CCAGGACTCCCGCGGGAGTCCTGG | 2001 | CCAGGACTCTCGCGAGAGTCCTGG |
| 1077 | CCTGGACTCCCGCGGGAGTCCAGG | 2005 | CCTGGACTCTCGCGAGAGTCCAGG |
| 1086 | CCCAGACTCCCGCGGGAGTCTGGG | 2014 | CCCAGACTCTCGCGAGAGTCTGGG |
| 1088 | CCCTGACTCCCGCGGGAGTCAGGG | 2016 | CCCTGACTCTCGCGAGAGTCAGGG |
| 1071 | ACGGGACTCCCGCGGGAGTCCCGT | 1999 | ACGGGACTCTCGCGAGAGTCCCGT |
| 1075 | TCGGGACTCCCGCGGGAGTCCCGA | 2003 | TCGGGACTCTCGCGAGAGTCCCGA |
| 1072 | CAGGGACTCCCGCGGGAGTCCCTG | 2000 | CAGGGACTCTCGCGAGAGTCCCTG |
| 1076 | CTGGGACTCCCGCGGGAGTCCCAG | 2004 | CTGGGACTCTCGCGAGAGTCCCAG |
| | | | |
| 15368 | GGCGGACTCGGCGCCGAGTCCGCC | 408 | GGCGGACTCTGCGCAGAGTCCGCC |
| 15369 | GCCCGACTCGGCGCCGAGTCGGGC | 417 | GCCCGACTCTGCGCAGAGTCGGGC |
| 15370 | GGGCGACTCGGCGCCGAGTCGCCC | 425 | GGGCGACTCTGCGCAGAGTCGCCC |
| 15371 | GGGAGACTCGGCGCCGAGTCTCCC | 429 | GGGAGACTCTGCGCAGAGTCTCCC |
| 15372 | GGGTGACTCGGCGCCGAGTCACCC | 432 | GGGTGACTCTGCGCAGAGTCACCC |
| 15373 | GGACGACTCGGCGCCGAGTCGTCC | 428 | GGACGACTCTGCGCAGAGTCGTCC |
| 15374 | GCACGACTCGGCGCCGAGTCGTGC | 420 | GCACGACTCTGCGCAGAGTCGTGC |
| 15375 | GACCGACTCGGCGCCGAGTCGGTC | 419 | GACCGACTCTGCGCAGAGTCGGTC |
| 15376 | GTCCGACTCGGCGCCGAGTCGGAC | 423 | GTCCGACTCTGCGCAGAGTCGGAC |
| 15377 | ACCCGACTCGGCGCCGAGTCGGGT | 418 | ACCCGACTCTGCGCAGAGTCGGGT |
| 15378 | TCCCGACTCGGCGCCGAGTCGGGA | 422 | TCCCGACTCTGCGCAGAGTCGGGA |
| 15379 | GCCAGACTCGGCGCCGAGTCTGGC | 421 | GCCAGACTCTGCGCAGAGTCTGGC |
| 15380 | GCCTGACTCGGCGCCGAGTCAGGC | 424 | GCCTGACTCTGCGCAGAGTCAGGC |
| 15381 | GACGGACTCGGCGCCGAGTCCGTC | 410 | GACGGACTCTGCGCAGAGTCCGTC |
| 15382 | GTCGGACTCGGCGCCGAGTCCGAC | 414 | GTCGGACTCTGCGCAGAGTCCGAC |
| 15383 | AGCGGACTCGGCGCCGAGTCCGCT | 409 | AGCGGACTCTGCGCAGAGTCCGCT |
| 15384 | TGCGGACTCGGCGCCGAGTCCGCA | 413 | TGCGGACTCTGCGCAGAGTCCGCA |
| 15385 | GGAGGACTCGGCGCCGAGTCCTCC | 411 | GGAGGACTCTGCGCAGAGTCCTCC |
| 15386 | GGTGGACTCGGCGCCGAGTCCACC | 415 | GGTGGACTCTGCGCAGAGTCCACC |
| 15387 | GGCAGACTCGGCGCCGAGTCTGCC | 412 | GGCAGACTCTGCGCAGAGTCTGCC |
| 15388 | GGCTGACTCGGCGCCGAGTCAGCC | 416 | GGCTGACTCTGCGCAGAGTCAGCC |
| 15389 | CACGGACTCGGCGCCGAGTCCGTG | 447 | CACGGACTCTGCGCAGAGTCCGTG |
| 15390 | CTCGGACTCGGCGCCGAGTCCGAG | 449 | CTCGGACTCTGCGCAGAGTCCGAG |
| 15391 | CCAGGACTCGGCGCCGAGTCCTGG | 435 | CCAGGACTCTGCGCAGAGTCCTGG |
| 15392 | CCTGGACTCGGCGCCGAGTCCAGG | 439 | CCTGGACTCTGCGCAGAGTCCAGG |
| 15393 | CCCAGACTCGGCGCCGAGTCTGGG | 448 | CCCAGACTCTGCGCAGAGTCTGGG |
| 15394 | CCCTGACTCGGCGCCGAGTCAGGG | 450 | CCCTGACTCTGCGCAGAGTCAGGG |
| 15395 | ACGGGACTCGGCGCCGAGTCCCGT | 433 | ACGGGACTCTGCGCAGAGTCCCGT |
| 15396 | TCGGGACTCGGCGCCGAGTCCCGA | 437 | TCGGGACTCTGCGCAGAGTCCCGA |
| 15397 | CAGGGACTCGGCGCCGAGTCCCTG | 434 | CAGGGACTCTGCGCAGAGTCCCTG |
| 15398 | CTGGGACTCGGCGCCGAGTCCCAG | 438 | CTGGGACTCTGCGCAGAGTCCCAG |

FIG. 8A (CONTINUED)

| | | | |
|---|---|---|---|
| 640 | GGCGGACTCGCCGGCGAGTCCGCC | 2032 | GGCGGACTCTCCGGAGAGTCCGCC |
| 649 | GCCCGACTCGCCGGCGAGTCGGGC | 2041 | GCCCGACTCTCCGGAGAGTCGGGC |
| 657 | GGGCGACTCGCCGGCGAGTCGCCC | 2049 | GGGCGACTCTCCGGAGAGTCGCCC |
| 661 | GGGAGACTCGCCGGCGAGTCTCCC | 2053 | GGGAGACTCTCCGGAGAGTCTCCC |
| 664 | GGGTGACTCGCCGGCGAGTCACCC | 2056 | GGGTGACTCTCCGGAGAGTCACCC |
| 660 | GGACGACTCGCCGGCGAGTCGTCC | 2052 | GGACGACTCTCCGGAGAGTCGTCC |
| 652 | GCACGACTCGCCGGCGAGTCGTGC | 2044 | GCACGACTCTCCGGAGAGTCGTGC |
| 651 | GACCGACTCGCCGGCGAGTCGGTC | 2043 | GACCGACTCTCCGGAGAGTCGGTC |
| 655 | GTCCGACTCGCCGGCGAGTCGGAC | 2047 | GTCCGACTCTCCGGAGAGTCGGAC |
| 650 | ACCCGACTCGCCGGCGAGTCGGGT | 2042 | ACCCGACTCTCCGGAGAGTCGGGT |
| 654 | TCCCGACTCGCCGGCGAGTCGGGA | 2046 | TCCCGACTCTCCGGAGAGTCGGGA |
| 653 | GCCAGACTCGCCGGCGAGTCTGGC | 2045 | GCCAGACTCTCCGGAGAGTCTGGC |
| 656 | GCCTGACTCGCCGGCGAGTCAGGC | 2048 | GCCTGACTCTCCGGAGAGTCAGGC |
| 642 | GACGGACTCGCCGGCGAGTCCGTC | 2034 | GACGGACTCTCCGGAGAGTCCGTC |
| 646 | GTCGGACTCGCCGGCGAGTCCGAC | 2038 | GTCGGACTCTCCGGAGAGTCCGAC |
| 641 | AGCGGACTCGCCGGCGAGTCCGCT | 2033 | AGCGGACTCTCCGGAGAGTCCGCT |
| 645 | TGCGGACTCGCCGGCGAGTCCGCA | 2037 | TGCGGACTCTCCGGAGAGTCCGCA |
| 643 | GGAGGACTCGCCGGCGAGTCCTCC | 2035 | GGAGGACTCTCCGGAGAGTCCTCC |
| 647 | GGTGGACTCGCCGGCGAGTCCACC | 2039 | GGTGGACTCTCCGGAGAGTCCACC |
| 644 | GGCAGACTCGCCGGCGAGTCTGCC | 2036 | GGCAGACTCTCCGGAGAGTCTGCC |
| 648 | GGCTGACTCGCCGGCGAGTCAGCC | 2040 | GGCTGACTCTCCGGAGAGTCAGCC |
| 679 | CACGGACTCGCCGGCGAGTCCGTG | 2071 | CACGGACTCTCCGGAGAGTCCGTG |
| 681 | CTCGGACTCGCCGGCGAGTCCGAG | 2073 | CTCGGACTCTCCGGAGAGTCCGAG |
| 667 | CCAGGACTCGCCGGCGAGTCCTGG | 2059 | CCAGGACTCTCCGGAGAGTCCTGG |
| 671 | CCTGGACTCGCCGGCGAGTCCAGG | 2063 | CCTGGACTCTCCGGAGAGTCCAGG |
| 680 | CCCAGACTCGCCGGCGAGTCTGGG | 2072 | CCCAGACTCTCCGGAGAGTCTGGG |
| 682 | CCCTGACTCGCCGGCGAGTCAGGG | 2074 | CCCTGACTCTCCGGAGAGTCAGGG |
| 665 | ACGGGACTCGCCGGCGAGTCCCGT | 2057 | ACGGGACTCTCCGGAGAGTCCCGT |
| 669 | TCGGGACTCGCCGGCGAGTCCCGA | 2061 | TCGGGACTCTCCGGAGAGTCCCGA |
| 666 | CAGGGACTCGCCGGCGAGTCCCTG | 2058 | CAGGGACTCTCCGGAGAGTCCCTG |
| 670 | CTGGGACTCGCCGGCGAGTCCCAG | 2062 | CTGGGACTCTCCGGAGAGTCCCAG |

FIG. 8A (CONTINUED)

| SEQ ID NO: | | SEQ ID NO: | |
|---|---|---|---|
| 814 | GGCGGACTCACGCGTGAGTCCGCC | 1278 | GGCGGACTCGTGCACGAGTCCGCC |
| 823 | GCCCGACTCACGCGTGAGTCGGGC | 1287 | GCCCGACTCGTGCACGAGTCGGGC |
| 831 | GGGCGACTCACGCGTGAGTCGCCC | 1295 | GGGCGACTCGTGCACGAGTCGCCC |
| 835 | GGGAGACTCACGCGTGAGTCTCCC | 1299 | GGGAGACTCGTGCACGAGTCTCCC |
| 838 | GGGTGACTCACGCGTGAGTCACCC | 1302 | GGGTGACTCGTGCACGAGTCACCC |
| 834 | GGACGACTCACGCGTGAGTCGTCC | 1298 | GGACGACTCGTGCACGAGTCGTCC |
| 826 | GCACGACTCACGCGTGAGTCGTGC | 1290 | GCACGACTCGTGCACGAGTCGTGC |
| 825 | GACCGACTCACGCGTGAGTCGGTC | 1289 | GACCGACTCGTGCACGAGTCGGTC |
| 829 | GTCCGACTCACGCGTGAGTCGGAC | 1293 | GTCCGACTCGTGCACGAGTCGGAC |
| 824 | ACCCGACTCACGCGTGAGTCGGGT | 1288 | ACCCGACTCGTGCACGAGTCGGGT |
| 828 | TCCCGACTCACGCGTGAGTCGGGA | 1292 | TCCCGACTCGTGCACGAGTCGGGA |
| 827 | GCCAGACTCACGCGTGAGTCTGGC | 1291 | GCCAGACTCGTGCACGAGTCTGGC |
| 830 | GCCTGACTCACGCGTGAGTCAGGC | 1294 | GCCTGACTCGTGCACGAGTCAGGC |
| 816 | GACGGACTCACGCGTGAGTCCGTC | 1280 | GACGGACTCGTGCACGAGTCCGTC |
| 820 | GTCGGACTCACGCGTGAGTCCGAC | 1284 | GTCGGACTCGTGCACGAGTCCGAC |
| 815 | AGCGGACTCACGCGTGAGTCCGCT | 1279 | AGCGGACTCGTGCACGAGTCCGCT |
| 819 | TGCGGACTCACGCGTGAGTCCGCA | 1283 | TGCGGACTCGTGCACGAGTCCGCA |
| 817 | GGAGGACTCACGCGTGAGTCCTCC | 1281 | GGAGGACTCGTGCACGAGTCCTCC |
| 821 | GGTGGACTCACGCGTGAGTCCACC | 1285 | GGTGGACTCGTGCACGAGTCCACC |
| 818 | GGCAGACTCACGCGTGAGTCTGCC | 1282 | GGCAGACTCGTGCACGAGTCTGCC |
| 822 | GGCTGACTCACGCGTGAGTCAGCC | 1286 | GGCTGACTCGTGCACGAGTCAGCC |
| 853 | CACGGACTCACGCGTGAGTCCGTG | 1317 | CACGGACTCGTGCACGAGTCCGTG |
| 855 | CTCGGACTCACGCGTGAGTCCGAG | 1319 | CTCGGACTCGTGCACGAGTCCGAG |
| 841 | CCAGGACTCACGCGTGAGTCCTGG | 1305 | CCAGGACTCGTGCACGAGTCCTGG |
| 845 | CCTGGACTCACGCGTGAGTCCAGG | 1309 | CCTGGACTCGTGCACGAGTCCAGG |
| 854 | CCCAGACTCACGCGTGAGTCTGGG | 1318 | CCCAGACTCGTGCACGAGTCTGGG |
| 856 | CCCTGACTCACGCGTGAGTCAGGG | 1320 | CCCTGACTCGTGCACGAGTCAGGG |
| 839 | ACGGGACTCACGCGTGAGTCCCGT | 1303 | ACGGGACTCGTGCACGAGTCCCGT |
| 843 | TCGGGACTCACGCGTGAGTCCCGA | 1307 | TCGGGACTCGTGCACGAGTCCCGA |
| 840 | CAGGGACTCACGCGTGAGTCCCTG | 1304 | CAGGGACTCGTGCACGAGTCCCTG |
| 844 | CTGGGACTCACGCGTGAGTCCCAG | 1308 | CTGGGACTCGTGCACGAGTCCCAG |
| 15407 | CCGGGACTCAGCGCTGAGTCCCGG | 15416 | CCGGGACTCCTCGAGGAGTCCCGG |
| 15408 | CCCGGACTCAGCGCTGAGTCCGGG | 15417 | CCCGGACTCCTCGAGGAGTCCGGG |
| 2264 | GGCGGACTCAGCGCTGAGTCCGCC | 1568 | GGCGGACTCCTCGAGGAGTCCGCC |
| 15409 | GCCGGACTCAGCGCTGAGTCCGGC | 15418 | GCCGGACTCCTCGAGGAGTCCGGC |

FIG. 8A (CONTINUED)

| | | | |
|---|---|---|---|
| 2273 | GCCGACTCAGCGCTGAGTCGGGC | 1577 | GCCCGACTCCTCGAGGAGTCGGGC |
| 15410 | GGCCGACTCAGCGCTGAGTCGGCC | 15419 | GGCCGACTCCTCGAGGAGTCGGCC |
| 2281 | GGGCGACTCAGCGCTGAGTCGCCC | 1585 | GGGCGACTCCTCGAGGAGTCGCCC |
| 2285 | GGGAGACTCAGCGCTGAGTCTCCC | 1589 | GGGAGACTCCTCGAGGAGTCTCCC |
| 2288 | GGGTGACTCAGCGCTGAGTCACCC | 1592 | GGGTGACTCCTCGAGGAGTCACCC |
| 2284 | GGACGACTCAGCGCTGAGTCGTCC | 1588 | GGACGACTCCTCGAGGAGTCGTCC |
| 15411 | GGTCGACTCAGCGCTGAGTCGACC | 15420 | GGTCGACTCCTCGAGGAGTCGACC |
| 2276 | GCACGACTCAGCGCTGAGTCGTGC | 1580 | GCACGACTCCTCGAGGAGTCGTGC |
| 15412 | GCTCGACTCAGCGCTGAGTCGAGC | 15421 | GCTCGACTCCTCGAGGAGTCGAGC |
| 2275 | GACCGACTCAGCGCTGAGTCGGTC | 1579 | GACCGACTCCTCGAGGAGTCGGTC |
| 2279 | GTCCGACTCAGCGCTGAGTCGGAC | 1583 | GTCCGACTCCTCGAGGAGTCGGAC |
| 2274 | ACCCGACTCAGCGCTGAGTCGGGT | 1578 | ACCCGACTCCTCGAGGAGTCGGGT |
| 2278 | TCCCGACTCAGCGCTGAGTCGGGA | 1582 | TCCCGACTCCTCGAGGAGTCGGGA |
| 2277 | GCCAGACTCAGCGCTGAGTCTGGC | 1581 | GCCAGACTCCTCGAGGAGTCTGGC |
| 2280 | GCCTGACTCAGCGCTGAGTCAGGC | 1584 | GCCTGACTCCTCGAGGAGTCAGGC |
| 2266 | GACGGACTCAGCGCTGAGTCCGTC | 1570 | GACGGACTCCTCGAGGAGTCCGTC |
| 2270 | GTCGGACTCAGCGCTGAGTCCGAC | 1574 | GTCGGACTCCTCGAGGAGTCCGAC |
| 15413 | ACCGGACTCAGCGCTGAGTCCGGT | 15422 | ACCGGACTCCTCGAGGAGTCCGGT |
| 15414 | TCCGGACTCAGCGCTGAGTCCGGA | 15423 | TCCGGACTCCTCGAGGAGTCCGGA |
| 2265 | AGCGGACTCAGCGCTGAGTCCGCT | 1569 | AGCGGACTCCTCGAGGAGTCCGCT |
| 2269 | TGCGGACTCAGCGCTGAGTCCGCA | 1573 | TGCGGACTCCTCGAGGAGTCCGCA |
| 2267 | GGAGGACTCAGCGCTGAGTCCTCC | 1571 | GGAGGACTCCTCGAGGAGTCCTCC |
| 2271 | GGTGGACTCAGCGCTGAGTCCACC | 1575 | GGTGGACTCCTCGAGGAGTCCACC |
| 2268 | GGCAGACTCAGCGCTGAGTCTGCC | 1572 | GGCAGACTCCTCGAGGAGTCTGCC |
| 2272 | GGCTGACTCAGCGCTGAGTCAGCC | 1576 | GGCTGACTCCTCGAGGAGTCAGCC |
| 2303 | CACGGACTCAGCGCTGAGTCCGTG | 1607 | CACGGACTCCTCGAGGAGTCCGTG |
| 2305 | CTCGGACTCAGCGCTGAGTCCGAG | 1609 | CTCGGACTCCTCGAGGAGTCCGAG |
| 2291 | CCAGGACTCAGCGCTGAGTCCTGG | 1595 | CCAGGACTCCTCGAGGAGTCCTGG |
| 2295 | CCTGGACTCAGCGCTGAGTCCAGG | 1599 | CCTGGACTCCTCGAGGAGTCCAGG |
| 2304 | CCCAGACTCAGCGCTGAGTCTGGG | 1608 | CCCAGACTCCTCGAGGAGTCTGGG |
| 2306 | CCCTGACTCAGCGCTGAGTCAGGG | 1610 | CCCTGACTCCTCGAGGAGTCAGGG |
| 2289 | ACGGGACTCAGCGCTGAGTCCCGT | 1593 | ACGGGACTCCTCGAGGAGTCCCGT |
| 2293 | TCGGGACTCAGCGCTGAGTCCCGA | 1597 | TCGGGACTCCTCGAGGAGTCCCGA |
| 2290 | CAGGGACTCAGCGCTGAGTCCCTG | 1594 | CAGGGACTCCTCGAGGAGTCCCTG |
| 2294 | CTGGGACTCAGCGCTGAGTCCCAG | 1598 | CTGGGACTCCTCGAGGAGTCCCAG |
| | | | |
| 2206 | GCGGACTCAGGCCTGAGTCCGCC | 15424 | GCCCGACTCGGTACCGAGTCGGGC |
| 2215 | GCCCGACTCAGGCCTGAGTCGGGC | 15424 | GCCCGACTCGGTACCGAGTCGGGC |
| 2223 | GGGCGACTCAGGCCTGAGTCGCCC | 15425 | GGGCGACTCGGTACCGAGTCGCCC |
| 2227 | GGGAGACTCAGGCCTGAGTCTCCC | 15426 | GGGAGACTCGGTACCGAGTCTCCC |
| 2230 | GGGTGACTCAGGCCTGAGTCACCC | 15427 | GGGTGACTCGGTACCGAGTCACCC |
| 2226 | GGACGACTCAGGCCTGAGTCGTCC | 15428 | GGACGACTCGGTACCGAGTCGTCC |
| 2218 | GCACGACTCAGGCCTGAGTCGTGC | 15429 | GCACGACTCGGTACCGAGTCGTGC |
| 2217 | GACCGACTCAGGCCTGAGTCGGTC | 15430 | GACCGACTCGGTACCGAGTCGGTC |

FIG. 8A (CONTINUED)

| | | | |
|---|---|---|---|
| 2221 | GTCCGACTCAGGCCTGAGTCGGAC | 15431 | GTCCGACTCGGTACCGAGTCGGAC |
| 2216 | ACCCGACTCAGGCCTGAGTCGGGT | 15432 | ACCCGACTCGGTACCGAGTCGGGT |
| 2220 | TCCCGACTCAGGCCTGAGTCGGGA | 15433 | TCCCGACTCGGTACCGAGTCGGGA |
| 2219 | GCCAGACTCAGGCCTGAGTCTGGC | 15434 | GCCAGACTCGGTACCGAGTCTGGC |
| 2222 | GCCTGACTCAGGCCTGAGTCAGGC | 15435 | GCCTGACTCGGTACCGAGTCAGGC |
| 2208 | GACGGACTCAGGCCTGAGTCCGTC | 15436 | GACGGACTCGGTACCGAGTCCGTC |
| 2212 | GTCGGACTCAGGCCTGAGTCCGAC | 15437 | GTCGGACTCGGTACCGAGTCCGAC |
| 2207 | AGCGGACTCAGGCCTGAGTCCGCT | 15438 | AGCGGACTCGGTACCGAGTCCGCT |
| 2211 | TGCGGACTCAGGCCTGAGTCCGCA | 15439 | TGCGGACTCGGTACCGAGTCCGCA |
| 2209 | GGAGGACTCAGGCCTGAGTCCTCC | 15440 | GGAGGACTCGGTACCGAGTCCTCC |
| 2213 | GGTGGACTCAGGCCTGAGTCCACC | 15441 | GGTGGACTCGGTACCGAGTCCACC |
| 2210 | GGCAGACTCAGGCCTGAGTCTGCC | 15442 | GGCAGACTCGGTACCGAGTCTGCC |
| 2214 | GGCTGACTCAGGCCTGAGTCAGCC | 15443 | GGCTGACTCGGTACCGAGTCAGCC |
| 2245 | CACGGACTCAGGCCTGAGTCCGTG | 15444 | CACGGACTCGGTACCGAGTCCGTG |
| 2247 | CTCGGACTCAGGCCTGAGTCCGAG | 15445 | CTCGGACTCGGTACCGAGTCCGAG |
| 2233 | CCAGGACTCAGGCCTGAGTCCTGG | 15446 | CCAGGACTCGGTACCGAGTCCTGG |
| 2237 | CCTGGACTCAGGCCTGAGTCCAGG | 15447 | CCTGGACTCGGTACCGAGTCCAGG |
| 2246 | CCCAGACTCAGGCCTGAGTCTGGG | 15448 | CCCAGACTCGGTACCGAGTCTGGG |
| 2248 | CCCTGACTCAGGCCTGAGTCAGGG | 15449 | CCCTGACTCGGTACCGAGTCAGGG |
| 2231 | ACGGGACTCAGGCCTGAGTCCCGT | 15450 | ACGGGACTCGGTACCGAGTCCCGT |
| 2235 | TCGGGACTCAGGCCTGAGTCCCGA | 15451 | TCGGGACTCGGTACCGAGTCCCGA |
| 2232 | CAGGGACTCAGGCCTGAGTCCCTG | 15452 | CAGGGACTCGGTACCGAGTCCCTG |
| 2236 | CTGGGACTCAGGCCTGAGTCCCAG | 15453 | CTGGGACTCGGTACCGAGTCCCAG |
| | | | |
| 814 | GGCGGACTCACGCGTGAGTCCGCC | 1510 | GGCGGACTCCTGCAGGAGTCCGCC |
| 823 | GCCCGACTCACGCGTGAGTCGGGC | 1519 | GCCCGACTCCTGCAGGAGTCGGGC |
| 831 | GGGCGACTCACGCGTGAGTCGCCC | 1527 | GGGCGACTCCTGCAGGAGTCGCCC |
| 835 | GGGAGACTCACGCGTGAGTCTCCC | 1531 | GGGAGACTCCTGCAGGAGTCTCCC |
| 838 | GGGTGACTCACGCGTGAGTCACCC | 1534 | GGGTGACTCCTGCAGGAGTCACCC |
| 834 | GGACGACTCACGCGTGAGTCGTCC | 1530 | GGACGACTCCTGCAGGAGTCGTCC |
| 826 | GCACGACTCACGCGTGAGTCGTGC | 1522 | GCACGACTCCTGCAGGAGTCGTGC |
| 825 | GACCGACTCACGCGTGAGTCGGTC | 1521 | GACCGACTCCTGCAGGAGTCGGTC |
| 829 | GTCCGACTCACGCGTGAGTCGGAC | 1525 | GTCCGACTCCTGCAGGAGTCGGAC |
| 824 | ACCCGACTCACGCGTGAGTCGGGT | 1520 | ACCCGACTCCTGCAGGAGTCGGGT |
| 828 | TCCCGACTCACGCGTGAGTCGGGA | 1524 | TCCCGACTCCTGCAGGAGTCGGGA |
| 827 | GCCAGACTCACGCGTGAGTCTGGC | 1523 | GCCAGACTCCTGCAGGAGTCTGGC |
| 830 | GCCTGACTCACGCGTGAGTCAGGC | 1526 | GCCTGACTCCTGCAGGAGTCAGGC |
| 816 | GACGGACTCACGCGTGAGTCCGTC | 1512 | GACGGACTCCTGCAGGAGTCCGTC |
| 820 | GTCGGACTCACGCGTGAGTCCGAC | 1516 | GTCGGACTCCTGCAGGAGTCCGAC |
| 815 | AGCGGACTCACGCGTGAGTCCGCT | 1511 | AGCGGACTCCTGCAGGAGTCCGCT |
| 819 | TGCGGACTCACGCGTGAGTCCGCA | 1515 | TGCGGACTCCTGCAGGAGTCCGCA |
| 817 | GGAGGACTCACGCGTGAGTCCTCC | 1513 | GGAGGACTCCTGCAGGAGTCCTCC |
| 821 | GGTGGACTCACGCGTGAGTCCACC | 1517 | GGTGGACTCCTGCAGGAGTCCACC |
| 818 | GGCAGACTCACGCGTGAGTCTGCC | 1514 | GGCAGACTCCTGCAGGAGTCTGCC |

FIG. 8A (CONTINUED)

| | | | |
|---|---|---|---|
| 822 | GGCTGACTCACGCGTGAGTCAGCC | 1518 | GGCTGACTCCTGCAGGAGTCAGCC |
| 853 | CACGGACTCACGCGTGAGTCCGTG | 1549 | CACGGACTCCTGCAGGAGTCCGTG |
| 855 | CTCGGACTCACGCGTGAGTCCGAG | 1551 | CTCGGACTCCTGCAGGAGTCCGAG |
| 841 | CCAGGACTCACGCGTGAGTCCTGG | 1537 | CCAGGACTCCTGCAGGAGTCCTGG |
| 845 | CCTGGACTCACGCGTGAGTCCAGG | 1541 | CCTGGACTCCTGCAGGAGTCCAGG |
| 854 | CCCAGACTCACGCGTGAGTCTGGG | 1550 | CCCAGACTCCTGCAGGAGTCTGGG |
| 856 | CCCTGACTCACGCGTGAGTCAGGG | 1552 | CCCTGACTCCTGCAGGAGTCAGGG |
| 839 | ACGGGACTCACGCGTGAGTCCCGT | 1535 | ACGGGACTCCTGCAGGAGTCCCGT |
| 843 | TCGGGACTCACGCGTGAGTCCCGA | 1539 | TCGGGACTCCTGCAGGAGTCCCGA |
| 840 | CAGGGACTCACGCGTGAGTCCCTG | 1536 | CAGGGACTCCTGCAGGAGTCCCTG |
| 844 | CTGGGACTCACGCGTGAGTCCCAG | 1540 | CTGGGACTCCTGCAGGAGTCCCAG |
| 2264 | GGCGGACTCAGCGCTGAGTCCGCC | 1336 | GGCGGACTCGTCGACGAGTCCGCC |
| 2273 | GCCGGACTCAGCGCTGAGTCGGGC | 1345 | GCCGGACTCGTCGACGAGTCGGGC |
| 2281 | GGGCGACTCAGCGCTGAGTCGCCC | 1353 | GGGCGACTCGTCGACGAGTCGCCC |
| 2285 | GGGAGACTCAGCGCTGAGTCTCCC | 1357 | GGGAGACTCGTCGACGAGTCTCCC |
| 2288 | GGGTGACTCAGCGCTGAGTCACCC | 1360 | GGGTGACTCGTCGACGAGTCACCC |
| 2284 | GGACGACTCAGCGCTGAGTCGTCC | 1356 | GGACGACTCGTCGACGAGTCGTCC |
| 2276 | GCACGACTCAGCGCTGAGTCGTGC | 1348 | GCACGACTCGTCGACGAGTCGTGC |
| 2275 | GACCGACTCAGCGCTGAGTCGGTC | 1347 | GACCGACTCGTCGACGAGTCGGTC |
| 2279 | GTCCGACTCAGCGCTGAGTCGGAC | 1351 | GTCCGACTCGTCGACGAGTCGGAC |
| 2274 | ACCCGACTCAGCGCTGAGTCGGGT | 1346 | ACCCGACTCGTCGACGAGTCGGGT |
| 2278 | TCCCGACTCAGCGCTGAGTCGGGA | 1350 | TCCCGACTCGTCGACGAGTCGGGA |
| 2277 | GCCAGACTCAGCGCTGAGTCTGGC | 1349 | GCCAGACTCGTCGACGAGTCTGGC |
| 2280 | GCCTGACTCAGCGCTGAGTCAGGC | 1352 | GCCTGACTCGTCGACGAGTCAGGC |
| 2266 | GACGGACTCAGCGCTGAGTCCGTC | 1338 | GACGGACTCGTCGACGAGTCCGTC |
| 2270 | GTCGGACTCAGCGCTGAGTCCGAC | 1342 | GTCGGACTCGTCGACGAGTCCGAC |
| 2265 | AGCGGACTCAGCGCTGAGTCCGCT | 1337 | AGCGGACTCGTCGACGAGTCCGCT |
| 2269 | TGCGGACTCAGCGCTGAGTCCGCA | 1341 | TGCGGACTCGTCGACGAGTCCGCA |
| 2267 | GGAGGACTCAGCGCTGAGTCCTCC | 1339 | GGAGGACTCGTCGACGAGTCCTCC |
| 2271 | GGTGGACTCAGCGCTGAGTCCACC | 1343 | GGTGGACTCGTCGACGAGTCCACC |
| 2268 | GGCAGACTCAGCGCTGAGTCTGCC | 1340 | GGCAGACTCGTCGACGAGTCTGCC |
| 2272 | GGCTGACTCAGCGCTGAGTCAGCC | 1344 | GGCTGACTCGTCGACGAGTCAGCC |
| 2303 | CACGGACTCAGCGCTGAGTCCGTG | 1375 | CACGGACTCGTCGACGAGTCCGTG |
| 2305 | CTCGGACTCAGCGCTGAGTCCGAG | 1377 | CTCGGACTCGTCGACGAGTCCGAG |
| 2291 | CCAGGACTCAGCGCTGAGTCCTGG | 1363 | CCAGGACTCGTCGACGAGTCCTGG |
| 2295 | CCTGGACTCAGCGCTGAGTCCAGG | 1367 | CCTGGACTCGTCGACGAGTCCAGG |
| 2304 | CCCAGACTCAGCGCTGAGTCTGGG | 1376 | CCCAGACTCGTCGACGAGTCTGGG |
| 2306 | CCCTGACTCAGCGCTGAGTCAGGG | 1378 | CCCTGACTCGTCGACGAGTCAGGG |
| 2289 | ACGGGACTCAGCGCTGAGTCCCGT | 1361 | ACGGGACTCGTCGACGAGTCCCGT |
| 2293 | TCGGGACTCAGCGCTGAGTCCCGA | 1365 | TCGGGACTCGTCGACGAGTCCCGA |
| 2290 | CAGGGACTCAGCGCTGAGTCCCTG | 1362 | CAGGGACTCGTCGACGAGTCCCTG |
| 2294 | CTGGGACTCAGCGCTGAGTCCCAG | 1366 | CTGGGACTCGTCGACGAGTCCCAG |

FIG. 8A (CONTINUED)

| | | | |
|---|---|---|---|
| 872 | GGCGGACTCACCGGTGAGTCCGCC | 1336 | GGCGGACTCGTCGACGAGTCCGCC |
| 881 | GCCCGACTCACCGGTGAGTCGGGC | 1345 | GCCCGACTCGTCGACGAGTCGGGC |
| 889 | GGGCGACTCACCGGTGAGTCGCCC | 1353 | GGGCGACTCGTCGACGAGTCGCCC |
| 893 | GGGAGACTCACCGGTGAGTCTCCC | 1357 | GGGAGACTCGTCGACGAGTCTCCC |
| 896 | GGGTGACTCACCGGTGAGTCACCC | 1360 | GGGTGACTCGTCGACGAGTCACCC |
| 892 | GGACGACTCACCGGTGAGTCGTCC | 1356 | GGACGACTCGTCGACGAGTCGTCC |
| 884 | GCACGACTCACCGGTGAGTCGTGC | 1348 | GCACGACTCGTCGACGAGTCGTGC |
| 883 | GACCGACTCACCGGTGAGTCGGTC | 1347 | GACCGACTCGTCGACGAGTCGGTC |
| 887 | GTCCGACTCACCGGTGAGTCGGAC | 1351 | GTCCGACTCGTCGACGAGTCGGAC |
| 882 | ACCCGACTCACCGGTGAGTCGGGT | 1346 | ACCCGACTCGTCGACGAGTCGGGT |
| 886 | TCCCGACTCACCGGTGAGTCGGGA | 1350 | TCCCGACTCGTCGACGAGTCGGGA |
| 885 | GCCAGACTCACCGGTGAGTCTGGC | 1349 | GCCAGACTCGTCGACGAGTCTGGC |
| 888 | GCCTGACTCACCGGTGAGTCAGGC | 1352 | GCCTGACTCGTCGACGAGTCAGGC |
| 874 | GACGGACTCACCGGTGAGTCCGTC | 1338 | GACGGACTCGTCGACGAGTCCGTC |
| 878 | GTCGGACTCACCGGTGAGTCCGAC | 1342 | GTCGGACTCGTCGACGAGTCCGAC |
| 873 | AGCGGACTCACCGGTGAGTCCGCT | 1337 | AGCGGACTCGTCGACGAGTCCGCT |
| 877 | TGCGGACTCACCGGTGAGTCCGCA | 1341 | TGCGGACTCGTCGACGAGTCCGCA |
| 875 | GGAGGACTCACCGGTGAGTCCTCC | 1339 | GGAGGACTCGTCGACGAGTCCTCC |
| 879 | GGTGGACTCACCGGTGAGTCCACC | 1343 | GGTGGACTCGTCGACGAGTCCACC |
| 876 | GGCAGACTCACCGGTGAGTCTGCC | 1340 | GGCAGACTCGTCGACGAGTCTGCC |
| 880 | GGCTGACTCACCGGTGAGTCAGCC | 1344 | GGCTGACTCGTCGACGAGTCAGCC |
| 911 | CACGGACTCACCGGTGAGTCCGTG | 1375 | CACGGACTCGTCGACGAGTCCGTG |
| 913 | CTCGGACTCACCGGTGAGTCCGAG | 1377 | CTCGGACTCGTCGACGAGTCCGAG |
| 899 | CCAGGACTCACCGGTGAGTCCTGG | 1363 | CCAGGACTCGTCGACGAGTCCTGG |
| 15415 | CCTGGACTACCGGTGAGTCCAGG | 1367 | CCTGGACTCGTCGACGAGTCCAGG |
| 912 | CCCAGACTCACCGGTGAGTCTGGG | 1376 | CCCAGACTCGTCGACGAGTCTGGG |
| 914 | CCCTGACTCACCGGTGAGTCAGGG | 1378 | CCCTGACTCGTCGACGAGTCAGGG |
| 897 | ACGGGACTCACCGGTGAGTCCCGT | 1361 | ACGGGACTCGTCGACGAGTCCCGT |
| 901 | TCGGGACTCACCGGTGAGTCCCGA | 1365 | TCGGGACTCGTCGACGAGTCCCGA |
| 898 | CAGGGACTCACCGGTGAGTCCCTG | 1362 | CAGGGACTCGTCGACGAGTCCCTG |
| 902 | CTGGGACTCACCGGTGAGTCCCAG | 1366 | CTGGGACTCGTCGACGAGTCCCAG |

FIG. 8A (CONTINUED)

| SEQ ID NO: | | SEQ ID NO: | |
|---|---|---|---|
| 524 | GGCGGACTCGCTAGCGAGTCCGCC | 466 | GGCGGACTCGCATGCGAGTCCGCC |
| 533 | GCCCGACTCGCTAGCGAGTCGGGC | 475 | GCCCGACTCGCATGCGAGTCGGGC |
| 541 | GGGCGACTCGCTAGCGAGTCGCCC | 483 | GGGCGACTCGCATGCGAGTCGCCC |
| 545 | GGGAGACTCGCTAGCGAGTCTCCC | 487 | GGGAGACTCGCATGCGAGTCTCCC |
| 548 | GGGTGACTCGCTAGCGAGTCACCC | 490 | GGGTGACTCGCATGCGAGTCACCC |
| 544 | GGACGACTCGCTAGCGAGTCGTCC | 486 | GGACGACTCGCATGCGAGTCGTCC |
| 536 | GCACGACTCGCTAGCGAGTCGTGC | 478 | GCACGACTCGCATGCGAGTCGTGC |
| 535 | GACCGACTCGCTAGCGAGTCGGTC | 477 | GACCGACTCGCATGCGAGTCGGTC |
| 539 | GTCCGACTCGCTAGCGAGTCGGAC | 481 | GTCCGACTCGCATGCGAGTCGGAC |
| 534 | ACCCGACTCGCTAGCGAGTCGGGT | 476 | ACCCGACTCGCATGCGAGTCGGGT |
| 538 | TCCCGACTCGCTAGCGAGTCGGGA | 480 | TCCCGACTCGCATGCGAGTCGGGA |
| 537 | GCCAGACTCGCTAGCGAGTCTGGC | 479 | GCCAGACTCGCATGCGAGTCTGGC |
| 540 | GCCTGACTCGCTAGCGAGTCAGGC | 482 | GCCTGACTCGCATGCGAGTCAGGC |
| 526 | GACGGACTCGCTAGCGAGTCCGTC | 468 | GACGGACTCGCATGCGAGTCCGTC |
| 530 | GTCGGACTCGCTAGCGAGTCCGAC | 472 | GTCGGACTCGCATGCGAGTCCGAC |
| 525 | AGCGGACTCGCTAGCGAGTCCGCT | 467 | AGCGGACTCGCATGCGAGTCCGCT |
| 529 | TGCGGACTCGCTAGCGAGTCCGCA | 471 | TGCGGACTCGCATGCGAGTCCGCA |
| 527 | GGAGGACTCGCTAGCGAGTCCTCC | 469 | GGAGGACTCGCATGCGAGTCCTCC |
| 531 | GGTGGACTCGCTAGCGAGTCCACC | 473 | GGTGGACTCGCATGCGAGTCCACC |
| 528 | GGCAGACTCGCTAGCGAGTCTGCC | 470 | GGCAGACTCGCATGCGAGTCTGCC |
| 532 | GGCTGACTCGCTAGCGAGTCAGCC | 474 | GGCTGACTCGCATGCGAGTCAGCC |
| 563 | CACGGACTCGCTAGCGAGTCCGTG | 505 | CACGGACTCGCATGCGAGTCCGTG |
| 565 | CTCGGACTCGCTAGCGAGTCCGAG | 507 | CTCGGACTCGCATGCGAGTCCGAG |
| 551 | CCAGGACTCGCTAGCGAGTCCTGG | 493 | CCAGGACTCGCATGCGAGTCCTGG |
| 555 | CCTGGACTCGCTAGCGAGTCCAGG | 497 | CCTGGACTCGCATGCGAGTCCAGG |
| 564 | CCCAGACTCGCTAGCGAGTCTGGG | 506 | CCCAGACTCGCATGCGAGTCTGGG |
| 566 | CCCTGACTCGCTAGCGAGTCAGGG | 508 | CCCTGACTCGCATGCGAGTCAGGG |
| 549 | ACGGGACTCGCTAGCGAGTCCCGT | 491 | ACGGGACTCGCATGCGAGTCCCGT |
| 553 | TCGGGACTCGCTAGCGAGTCCCGA | 495 | TCGGGACTCGCATGCGAGTCCCGA |
| 550 | CAGGGACTCGCTAGCGAGTCCCTG | 492 | CAGGGACTCGCATGCGAGTCCCTG |
| 554 | CTGGGACTCGCTAGCGAGTCCCAG | 496 | CTGGGACTCGCATGCGAGTCCCAG |
| 15454 | CCGGGACTCCACGTGGAGTCCCGG | 15492 | CCGGGACTCCGTACGGAGTCCCGG |
| 15455 | CCCGGACTCCACGTGGAGTCCGGG | 15493 | CCCGGACTCCGTACGGAGTCCGGG |
| 1800 | GGCGGACTCCACGTGGAGTCCGCC | 60 | GGCGGACTCCGTACGGAGTCCGCC |
| 15456 | GCCGGACTCCACGTGGAGTCCGGC | 15494 | GCCGGACTCCGTACGGAGTCCGGC |

FIG. 8A (CONTINUED)

| | | | |
|---|---|---|---|
| 1809 | GCCCGACTCCACGTGGAGTCGGGC | 69 | GCCCGACTCCGTACGGAGTCGGGC |
| 15457 | GGCCGACTCCACGTGGAGTCGGCC | 15495 | GGCCGACTCCGTACGGAGTCGGCC |
| 1817 | GGGCGACTCCACGTGGAGTCGCCC | 77 | GGGCGACTCCGTACGGAGTCGCCC |
| 1821 | GGGAGACTCCACGTGGAGTCTCCC | 81 | GGGAGACTCCGTACGGAGTCTCCC |
| 1824 | GGGTGACTCCACGTGGAGTCACCC | 84 | GGGTGACTCCGTACGGAGTCACCC |
| 1820 | GGACGACTCCACGTGGAGTCGTCC | 80 | GGACGACTCCGTACGGAGTCGTCC |
| 15458 | GGTCGACTCCACGTGGAGTCGACC | 15496 | GGTCGACTCCGTACGGAGTCGACC |
| 1812 | GCACGACTCCACGTGGAGTCGTGC | 72 | GCACGACTCCGTACGGAGTCGTGC |
| 15459 | GCTCGACTCCACGTGGAGTCGAGC | 15497 | GCTCGACTCCGTACGGAGTCGAGC |
| 1811 | GACCGACTCCACGTGGAGTCGGTC | 71 | GACCGACTCCGTACGGAGTCGGTC |
| 1815 | GTCCGACTCCACGTGGAGTCGGAC | 75 | GTCCGACTCCGTACGGAGTCGGAC |
| 1810 | ACCCGACTCCACGTGGAGTCGGGT | 70 | ACCCGACTCCGTACGGAGTCGGGT |
| 1814 | TCCCGACTCCACGTGGAGTCGGGA | 74 | TCCCGACTCCGTACGGAGTCGGGA |
| 1813 | GCCAGACTCCACGTGGAGTCTGGC | 73 | GCCAGACTCCGTACGGAGTCTGGC |
| 1816 | GCCTGACTCCACGTGGAGTCAGGC | 76 | GCCTGACTCCGTACGGAGTCAGGC |
| 1802 | GACGGACTCCACGTGGAGTCCGTC | 62 | GACGGACTCCGTACGGAGTCCGTC |
| 1806 | GTCGGACTCCACGTGGAGTCCGAC | 66 | GTCGGACTCCGTACGGAGTCCGAC |
| 15460 | ACCGGACTCCACGTGGAGTCCGGT | 15498 | ACCGGACTCCGTACGGAGTCCGGT |
| 15461 | TCCGGACTCCACGTGGAGTCCGGA | 15499 | TCCGGACTCCGTACGGAGTCCGGA |
| 1801 | AGCGGACTCCACGTGGAGTCCGCT | 61 | AGCGGACTCCGTACGGAGTCCGCT |
| 1805 | TGCGGACTCCACGTGGAGTCCGCA | 65 | TGCGGACTCCGTACGGAGTCCGCA |
| 1803 | GGAGGACTCCACGTGGAGTCCTCC | 63 | GGAGGACTCCGTACGGAGTCCTCC |
| 1807 | GGTGGACTCCACGTGGAGTCCACC | 67 | GGTGGACTCCGTACGGAGTCCACC |
| 1804 | GGCAGACTCCACGTGGAGTCTGCC | 64 | GGCAGACTCCGTACGGAGTCTGCC |
| 1808 | GGCTGACTCCACGTGGAGTCAGCC | 68 | GGCTGACTCCGTACGGAGTCAGCC |
| 1839 | CACGGACTCCACGTGGAGTCCGTG | 99 | CACGGACTCCGTACGGAGTCCGTG |
| 1841 | CTCGGACTCCACGTGGAGTCCGAG | 101 | CTCGGACTCCGTACGGAGTCCGAG |
| 1827 | CCAGGACTCCACGTGGAGTCCTGG | 87 | CCAGGACTCCGTACGGAGTCCTGG |
| 1831 | CCTGGACTCCACGTGGAGTCCAGG | 91 | CCTGGACTCCGTACGGAGTCCAGG |
| 1840 | CCCAGACTCCACGTGGAGTCTGGG | 100 | CCCAGACTCCGTACGGAGTCTGGG |
| 1842 | CCCTGACTCCACGTGGAGTCAGGG | 102 | CCCTGACTCCGTACGGAGTCAGGG |
| 1825 | ACGGGACTCCACGTGGAGTCCCGT | 85 | ACGGGACTCCGTACGGAGTCCCGT |
| 1829 | TCGGGACTCCACGTGGAGTCCCGA | 89 | TCGGGACTCCGTACGGAGTCCCGA |
| 1826 | CAGGGACTCCACGTGGAGTCCCTG | 86 | CAGGGACTCCGTACGGAGTCCCTG |
| 1830 | CTGGGACTCCACGTGGAGTCCCAG | 90 | CTGGGACTCCGTACGGAGTCCCAG |
| | | | |
| 930 | GGCGGACTCCCATGGGAGTCCGCC | 15500 | CCGGGACTCCGATCGGAGTCCCGG |
| 939 | GCCGGACTCCCATGGGAGTCGGGC | 15501 | CCCGGACTCCGATCGGAGTCCGGG |
| 947 | GGGCGACTCCCATGGGAGTCGCCC | 2 | GGCGGACTCCGATCGGAGTCCGCC |
| 951 | GGGAGACTCCCATGGGAGTCTCCC | 15502 | GCCGGACTCCGATCGGAGTCCGGC |
| 954 | GGGTGACTCCCATGGGAGTCACCC | 11 | GCCCGACTCCGATCGGAGTCGGGC |
| 950 | GGACGACTCCCATGGGAGTCGTCC | 15503 | GGCCGACTCCGATCGGAGTCGGCC |
| 942 | GCACGACTCCCATGGGAGTCGTGC | 19 | GGGCGACTCCGATCGGAGTCGCCC |
| 941 | GACCGACTCCCATGGGAGTCGGTC | 23 | GGGAGACTCCGATCGGAGTCTCCC |

FIG. 8A (CONTINUED)

| | | | |
|---|---|---|---|
| 945 | GTCCGACTCCCATGGGAGTCGGAC | 26 | GGGTGACTCCGATCGGAGTCACCC |
| 940 | ACCCGACTCCCATGGGAGTCGGGT | 22 | GGACGACTCCGATCGGAGTCGTCC |
| 944 | TCCCGACTCCCATGGGAGTCGGGA | 15504 | GGTCGACTCCGATCGGAGTCGACC |
| 943 | GCCAGACTCCCATGGGAGTCTGGC | 14 | GCACGACTCCGATCGGAGTCGTGC |
| 946 | GCCTGACTCCCATGGGAGTCAGGC | 15505 | GCTCGACTCCGATCGGAGTCGAGC |
| 932 | GACGGACTCCCATGGGAGTCCGTC | 13 | GACCGACTCCGATCGGAGTCGGTC |
| 936 | GTCGGACTCCCATGGGAGTCCGAC | 17 | GTCCGACTCCGATCGGAGTCGGAC |
| 931 | AGCGGACTCCCATGGGAGTCCGCT | 12 | ACCCGACTCCGATCGGAGTCGGGT |
| 935 | TGCGGACTCCCATGGGAGTCCGCA | 16 | TCCCGACTCCGATCGGAGTCGGGA |
| 933 | GGAGGACTCCCATGGGAGTCCTCC | 15 | GCCAGACTCCGATCGGAGTCTGGC |
| 937 | GGTGGACTCCCATGGGAGTCCACC | 18 | GCCTGACTCCGATCGGAGTCAGGC |
| 934 | GGCAGACTCCCATGGGAGTCTGCC | 4 | GACGGACTCCGATCGGAGTCCGTC |
| 938 | GGCTGACTCCCATGGGAGTCAGCC | 8 | GTCGGACTCCGATCGGAGTCCGAC |
| 969 | CACGGACTCCCATGGGAGTCCGTG | 15506 | ACCGGACTCCGATCGGAGTCCGGT |
| 971 | CTCGGACTCCCATGGGAGTCCGAG | 15507 | TCCGGACTCCGATCGGAGTCCGGA |
| 957 | CCAGGACTCCCATGGGAGTCCTGG | 3 | AGCGGACTCCGATCGGAGTCCGCT |
| 961 | CCTGGACTCCCATGGGAGTCCAGG | 7 | TGCGGACTCCGATCGGAGTCCGCA |
| 970 | CCCAGACTCCCATGGGAGTCTGGG | 5 | GGAGGACTCCGATCGGAGTCCTCC |
| 972 | CCCTGACTCCCATGGGAGTCAGGG | 9 | GGTGGACTCCGATCGGAGTCCACC |
| 955 | ACGGGACTCCCATGGGAGTCCCGT | 6 | GGCAGACTCCGATCGGAGTCTGCC |
| 959 | TCGGGACTCCCATGGGAGTCCCGA | 10 | GGCTGACTCCGATCGGAGTCAGCC |
| 956 | CAGGGACTCCCATGGGAGTCCCTG | 41 | CACGGACTCCGATCGGAGTCCGTG |
| 960 | CTGGGACTCCCATGGGAGTCCCAG | 43 | CTCGGACTCCGATCGGAGTCCGAG |
| | | 29 | CCAGGACTCCGATCGGAGTCCTGG |
| 15462 | GCCCGACTCGGATCCGAGTCGGGC | 33 | CCTGGACTCCGATCGGAGTCCAGG |
| 15462 | GCCCGACTCGGATCCGAGTCGGGC | 42 | CCCAGACTCCGATCGGAGTCTGGG |
| 15463 | GGGCGACTCGGATCCGAGTCGCCC | 44 | CCCTGACTCCGATCGGAGTCAGGG |
| 15464 | GGGAGACTCGGATCCGAGTCTCCC | 27 | ACGGGACTCCGATCGGAGTCCCGT |
| 15465 | GGGTGACTCGGATCCGAGTCACCC | 31 | TCGGGACTCCGATCGGAGTCCCGA |
| 15466 | GGACGACTCGGATCCGAGTCGTCC | 28 | CAGGGACTCCGATCGGAGTCCCTG |
| 15467 | GCACGACTCGGATCCGAGTCGTGC | 32 | CTGGGACTCGATCGGAGTCCCAG |
| 15468 | GACCGACTCGGATCCGAGTCGGTC | | |
| 15469 | GTCCGACTCGGATCCGAGTCGGAC | 466 | GGCGGACTCGCATGCGAGTCCGCC |
| 15470 | ACCCGACTCGGATCCGAGTCGGGT | 475 | GCCCGACTCGCATGCGAGTCGGGC |
| 15471 | TCCCGACTCGGATCCGAGTCGGGA | 483 | GGGCGACTCGCATGCGAGTCGCCC |
| 15472 | GCCAGACTCGGATCCGAGTCTGGC | 487 | GGGAGACTCGCATGCGAGTCTCCC |
| 15473 | GCCTGACTCGGATCCGAGTCAGGC | 490 | GGGTGACTCGCATGCGAGTCACCC |
| 15474 | GACGGACTCGGATCCGAGTCCGTC | 486 | GGACGACTCGCATGCGAGTCGTCC |
| 15475 | GTCGGACTCGGATCCGAGTCCGAC | 478 | GCACGACTCGCATGCGAGTCGTGC |
| 15476 | AGCGGACTCGGATCCGAGTCCGCT | 477 | GACCGACTCGCATGCGAGTCGGTC |
| 15477 | TGCGGACTCGGATCCGAGTCCGCA | 481 | GTCCGACTCGCATGCGAGTCGGAC |
| 15478 | GGAGGACTCGGATCCGAGTCCTCC | 476 | ACCCGACTCGCATGCGAGTCGGGT |
| 15479 | GGTGGACTCGGATCCGAGTCCACC | 480 | TCCCGACTCGCATGCGAGTCGGGA |
| 15480 | GGCAGACTCGGATCCGAGTCTGCC | 479 | GCCAGACTCGCATGCGAGTCTGGC |

FIG. 8A (CONTINUED)

| | | | |
|---|---|---|---|
| 15481 | GGCTGACTCGGATCCGAGTCAGCC | 482 | GCCTGACTCGCATGCGAGTCAGGC |
| 15482 | CACGGACTCGGATCCGAGTCCGTG | 468 | GACGGACTCGCATGCGAGTCCGTC |
| 15483 | CTCGGACTCGGATCCGAGTCCGAG | 472 | GTCGGACTCGCATGCGAGTCCGAC |
| 15484 | CCAGGACTCGGATCCGAGTCCTGG | 467 | AGCGGACTCGCATGCGAGTCCGCT |
| 15485 | CCTGGACTCGGATCCGAGTCCAGG | 471 | TGCGGACTCGCATGCGAGTCCGCA |
| 15486 | CCCAGACTCGGATCCGAGTCTGGG | 469 | GGAGGACTCGCATGCGAGTCCTCC |
| 15487 | CCCTGACTCGGATCCGAGTCAGGG | 473 | GGTGGACTCGCATGCGAGTCCACC |
| 15488 | ACGGGACTCGGATCCGAGTCCCGT | 470 | GGCAGACTCGCATGCGAGTCTGCC |
| 15489 | TCGGGACTCGGATCCGAGTCCCGA | 474 | GGCTGACTCGCATGCGAGTCAGCC |
| 15490 | CAGGGACTCGGATCCGAGTCCCTG | 505 | CACGGACTCGCATGCGAGTCCGTG |
| 15491 | CTGGGACTCGGATCCGAGTCCCAG | 507 | CTCGGACTCGCATGCGAGTCCGAG |
| | | 493 | CCAGGACTCGCATGCGAGTCCTGG |
| 524 | GGCGGACTCGCTAGCGAGTCCGCC | 497 | CCTGGACTCGCATGCGAGTCCAGG |
| 533 | GCCCGACTCGCTAGCGAGTCGGGC | 506 | CCCAGACTCGCATGCGAGTCTGGG |
| 541 | GGGCGACTCGCTAGCGAGTCGCCC | 508 | CCCTGACTCGCATGCGAGTCAGGG |
| 545 | GGGAGACTCGCTAGCGAGTCTCCC | 491 | ACGGGACTCGCATGCGAGTCCCGT |
| 548 | GGGTGACTCGCTAGCGAGTCACCC | 495 | TCGGGACTCGCATGCGAGTCCCGA |
| 544 | GGACGACTCGCTAGCGAGTCGTCC | 492 | CAGGGACTCGCATGCGAGTCCCTG |
| 536 | GCACGACTCGCTAGCGAGTCGTGC | 496 | CTGGGACTCGCATGCGAGTCCCAG |
| 535 | GACCGACTCGCTAGCGAGTCGGTC | | |
| 539 | GTCCGACTCGCTAGCGAGTCGGAC | 1742 | GGCGGACTCCAGCTGGAGTCCGCC |
| 534 | ACCCGACTCGCTAGCGAGTCGGGT | 1751 | GCCCGACTCCAGCTGGAGTCGGGC |
| 538 | TCCCGACTCGCTAGCGAGTCGGGA | 1759 | GGGCGACTCCAGCTGGAGTCGCCC |
| 537 | GCCAGACTCGCTAGCGAGTCTGGC | 1763 | GGGAGACTCCAGCTGGAGTCTCCC |
| 540 | GCCTGACTCGCTAGCGAGTCAGGC | 1766 | GGGTGACTCCAGCTGGAGTCACCC |
| 526 | GACGGACTCGCTAGCGAGTCCGTC | 1762 | GGACGACTCCAGCTGGAGTCGTCC |
| 530 | GTCGGACTCGCTAGCGAGTCCGAC | 1754 | GCACGACTCCAGCTGGAGTCGTGC |
| 525 | AGCGGACTCGCTAGCGAGTCCGCT | 1753 | GACCGACTCCAGCTGGAGTCGGTC |
| 529 | TGCGGACTCGCTAGCGAGTCCGCA | 1757 | GTCCGACTCCAGCTGGAGTCGGAC |
| 527 | GGAGGACTCGCTAGCGAGTCCTCC | 1752 | ACCCGACTCCAGCTGGAGTCGGGT |
| 531 | GGTGGACTCGCTAGCGAGTCCACC | 1756 | TCCCGACTCCAGCTGGAGTCGGGA |
| 528 | GGCAGACTCGCTAGCGAGTCTGCC | 1755 | GCCAGACTCCAGCTGGAGTCTGGC |
| 532 | GGCTGACTCGCTAGCGAGTCAGCC | 1758 | GCCTGACTCCAGCTGGAGTCAGGC |
| 563 | CACGGACTCGCTAGCGAGTCCGTG | 1744 | GACGGACTCCAGCTGGAGTCCGTC |
| 565 | CTCGGACTCGCTAGCGAGTCCGAG | 1748 | GTCGGACTCCAGCTGGAGTCCGAC |
| 551 | CCAGGACTCGCTAGCGAGTCCTGG | 1743 | AGCGGACTCCAGCTGGAGTCCGCT |
| 555 | CCTGGACTCGCTAGCGAGTCCAGG | 1747 | TGCGGACTCCAGCTGGAGTCCGCA |
| 564 | CCCAGACTCGCTAGCGAGTCTGGG | 1745 | GGAGGACTCCAGCTGGAGTCCTCC |
| 566 | CCCTGACTCGCTAGCGAGTCAGGG | 1749 | GGTGGACTCCAGCTGGAGTCCACC |
| 549 | ACGGGACTCGCTAGCGAGTCCCGT | 1746 | GGCAGACTCCAGCTGGAGTCTGCC |
| 553 | TCGGGACTCGCTAGCGAGTCCCGA | 1750 | GGCTGACTCCAGCTGGAGTCAGCC |
| 550 | CAGGGACTCGCTAGCGAGTCCCTG | 1781 | CACGGACTCCAGCTGGAGTCCGTG |
| 554 | CTGGGACTCGCTAGCGAGTCCCAG | 1783 | CTCGGACTCCAGCTGGAGTCCGAG |
| 1767 | ACGGGACTCCAGCTGGAGTCCCGT | 1769 | CCAGGACTCCAGCTGGAGTCCTGG |

FIG. 8A (CONTINUED)

1771 TCGGGACTCCAGCTGGAGTCCCGA
1768 CAGGGACTCCAGCTGGAGTCCCTG
1772 CTGGGACTCCAGCTGGAGTCCCAG

1773 CCTGGACTCCAGCTGGAGTCCAGG
1782 CCCAGACTCCAGCTGGAGTCTGGG
1784 CCCTGACTCCAGCTGGAGTCAGGG

FIG. 8A (CONTINUED)

Sequences of 5'-tails
NNNNGACTCNNNNGAGTCNNNN  (SEQ ID NO: 15258)
200 Selected Sequences = 0.08% of entire sequence space (248832)
ΔG = -47 Kcal/mole to -55 kcal/mole          ΔΔG < -40 kcal/mole
GC content 72% to 82%

| SEQ ID NO: | | SEQ ID NO: | |
|---|---|---|---|
| 10411 | GGCGGACTCCGCGGAGTCCGCC | 10469 | GGCGGACTCTGCAGAGTCCGCC |
| 10420 | GCCCGACTCCGCGGAGTCGGGC | 10478 | GCCCGACTCTGCAGAGTCGGGC |
| 10428 | GGGCGACTCCGCGGAGTCGCCC | 10486 | GGGCGACTCTGCAGAGTCGCCC |
| 15516 | CCGGGACTCCGCGGAGTCCCGG | 15521 | CCGGGACTCTGCAGAGTCCCGG |
| 15517 | CCCGGACTCCGCGGAGTCCGGG | 15522 | CCCGGACTCTGCAGAGTCCGGG |
| 15518 | GCCGGACTCCGCGGAGTCCGGC | 15523 | GCCGGACTCTGCAGAGTCCGGC |
| 15519 | GGCCGACTCCGCGGAGTCGGCC | 15524 | GGCCGACTCTGCAGAGTCGGCC |
| 10548 | GGGAGACTCGCGCGAGTCTCCC | 10991 | GGCGGACTCAGCTGAGTCCGCC |
| 10435 | GGGTGACTCCGCGGAGTCACCC | 11000 | GCCCGACTCAGCTGAGTCGGGC |
| 10431 | GGACGACTCCGCGGAGTCGTCC | 11008 | GGGCGACTCAGCTGAGTCGCCC |
| 10423 | GCACGACTCCGCGGAGTCGTGC | 15525 | CCGGGACTCAGCTGAGTCCCGG |
| 10422 | GACCGACTCCGCGGAGTCGGTC | 15526 | CCCGGACTCAGCTGAGTCCGGG |
| 10426 | GTCCGACTCCGCGGAGTCGGAC | 15527 | GCCGGACTCAGCTGAGTCCGGC |
| 10421 | ACCCGACTCCGCGGAGTCGGGT | 15528 | GGCCGACTCAGCTGAGTCGGCC |
| 10425 | TCCCGACTCCGCGGAGTCGGGA | 10817 | GGCGGACTCCTAGGAGTCCGCC |
| 10424 | GCCAGACTCCGCGGAGTCTGGC | 10826 | GCCCGACTCCTAGGAGTCGGGC |
| 10427 | GCCTGACTCCGCGGAGTCAGGC | 10834 | GGGCGACTCCTAGGAGTCGCCC |
| 10413 | GACGGACTCCGCGGAGTCCGTC | 15529 | CCGGGACTCCTAGGAGTCCCGG |
| 10417 | GTCGGACTCCGCGGAGTCCGAC | 15530 | CCCGGACTCCTAGGAGTCCGGG |
| 10412 | AGCGGACTCCGCGGAGTCCGCT | 15531 | GCCGGACTCCTAGGAGTCCGGC |
| 10416 | TGCGGACTCCGCGGAGTCCGCA | 15532 | GGCCGACTCCTAGGAGTCGGCC |
| 10414 | GGAGGACTCCGCGGAGTCCTCC | 10875 | GGCGGACTCCATGGAGTCCGCC |
| 10418 | GGTGGACTCCGCGGAGTCCACC | 10884 | GCCCGACTCCATGGAGTCGGGC |
| 10415 | GGCAGACTCCGCGGAGTCTGCC | 10892 | GGGCGACTCCATGGAGTCGCCC |
| 10419 | GGCTGACTCCGCGGAGTCAGCC | 15533 | CCGGGACTCCATGGAGTCCCGG |
| 10450 | CACGGACTCCGCGGAGTCCGTG | 15534 | CCCGGACTCCATGGAGTCCGGG |
| 10452 | CTCGGACTCCGCGGAGTCCGAG | 15535 | GCCGGACTCCATGGAGTCCGGC |
| 10438 | CCAGGACTCCGCGGAGTCCTGG | 15536 | GGCCGACTCCATGGAGTCGGCC |
| 10442 | CCTGGACTCCGCGGAGTCCAGG | 15537 | CCGGGACTCGCGCGAGTCCCGG |
| 10451 | CCCAGACTCCGCGGAGTCTGGG | 15538 | CCCGGACTCGCGCGAGTCCGGG |
| 10453 | CCCTGACTCCGCGGAGTCAGGG | 10527 | GGCGGACTCGCGCGAGTCCGCC |
| 10436 | ACGGGACTCCGCGGAGTCCCGT | 15539 | GCCGGACTCGCGCGAGTCCGGC |
| 10440 | TCGGGACTCCGCGGAGTCCCGA | 10536 | GCCCGACTCGCGCGAGTCGGGC |
| 10437 | CAGGGACTCCGCGGAGTCCCTG | 15540 | GGCCGACTCGCGCGAGTCGGCC |
| 10441 | CTGGGACTCCGCGGAGTCCCAG | 10544 | GGGCGACTCGCGCGAGTCGCCC |
| 15520 | ACCGGACTCCGCGGAGTCCGGT | 10548 | GGGAGACTCGCGCGAGTCTCCC |

FIG. 8B

| SEQ ID NO: | | SEQ ID NO: | |
|---|---|---|---|
| 10551 | GGGTGACTCGCGCGAGTCACCC | 15547 | CCCGGACTCACGTGAGTCCGGG |
| 10547 | GGACGACTCGCGCGAGTCGTCC | 10585 | GGCGGACTCACGTGAGTCCGCC |
| 10539 | GCACGACTCGCGCGAGTCGTGC | 15548 | GCCGGACTCACGTGAGTCCGGC |
| 10538 | GACCGACTCGCGCGAGTCGGTC | 10594 | GCCCGACTCACGTGAGTCGGGC |
| 10542 | GTCCGACTCGCGCGAGTCGGAC | 15549 | GGCCGACTCACGTGAGTCGGCC |
| 10537 | ACCCGACTCGCGCGAGTCGGGT | 10602 | GGGCGACTCACGTGAGTCGCCC |
| 10541 | TCCCGACTCGCGCGAGTCGGGA | 15550 | CCGGGACTCGTACGAGTCCCGG |
| 10540 | GCCAGACTCGCGCGAGTCTGGC | 15551 | CCCGGACTCGTACGAGTCCGGG |
| 10543 | GCCTGACTCGCGCGAGTCAGGC | 10759 | GGCGGACTCGTACGAGTCCGCC |
| 10529 | GACGGACTCGCGCGAGTCCGTC | 15552 | GCCGGACTCGTACGAGTCCGGC |
| 10533 | GTCGGACTCGCGCGAGTCCGAC | 10768 | GCCCGACTCGTACGAGTCGGGC |
| 15541 | ACCGGACTCGCGCGAGTCCGGT | 15553 | GGCCGACTCGTACGAGTCGGCC |
| 10528 | AGCGGACTCGCGCGAGTCCGCT | 10776 | GGGCGACTCGTACGAGTCGCCC |
| 10532 | TGCGGACTCGCGCGAGTCCGCA | 15554 | CCGGGACTCGATCGAGTCCCGG |
| 10530 | GGAGGACTCGCGCGAGTCCTCC | 15555 | CCCGGACTCGATCGAGTCCGGG |
| 10534 | GGTGGACTCGCGCGAGTCCACC | 15556 | GGCGGACTCGATCGAGTCCGCC |
| 10531 | GGCAGACTCGCGCGAGTCTGCC | 15557 | GCCGGACTCGATCGAGTCCGGC |
| 10535 | GGCTGACTCGCGCGAGTCAGCC | 15558 | GCCCGACTCGATCGAGTCGGGC |
| 10566 | CACGGACTCGCGCGAGTCCGTG | 15559 | GGCCGACTCGATCGAGTCGGCC |
| 10568 | CTCGGACTCGCGCGAGTCCGAG | 15560 | GGGCGACTCGATCGAGTCGCCC |
| 10554 | CCAGGACTCGCGCGAGTCCTGG | 10643 | GGCGGACTCGGCCGAGTCCGCC |
| 10558 | CCTGGACTCGCGCGAGTCCAGG | 10652 | GCCCGACTCGGCCGAGTCGGGC |
| 10567 | CCCAGACTCGCGCGAGTCTGGG | 10660 | GGGCGACTCGGCCGAGTCGCCC |
| 10569 | CCCTGACTCGCGCGAGTCAGGG | 15561 | CCGGGACTCGGCCGAGTCCCGG |
| 10552 | ACGGGACTCGCGCGAGTCCCGT | 15562 | CCCGGACTCGGCCGAGTCCGGG |
| 10556 | TCGGGACTCGCGCGAGTCCCGA | 15563 | GCCGGACTCGGCCGAGTCCGGC |
| 10553 | CAGGGACTCGCGCGAGTCCCTG | 15564 | GGCCGACTCGGCCGAGTCGGCC |
| 10557 | CTGGGACTCGCGCGAGTCCCAG | 10664 | GGGAGACTCGGCCGAGTCTCCC |
| 15542 | CCGGGACTCTCGAGAGTCCCGG | 10667 | GGGTGACTCGGCCGAGTCACCC |
| 15543 | CCCGGACTCTCGAGAGTCCGGG | 10663 | GGACGACTCGGCCGAGTCGTCC |
| 10933 | GGCGGACTCTCGAGAGTCCGCC | 10655 | GCACGACTCGGCCGAGTCGTGC |
| 15544 | GCCGGACTCTCGAGAGTCCGGC | 10654 | GACCGACTCGGCCGAGTCGGTC |
| 10942 | GCCCGACTCTCGAGAGTCGGGC | 10658 | GTCCGACTCGGCCGAGTCGGAC |
| 15545 | GGCCGACTCTCGAGAGTCGGCC | 10653 | ACCCGACTCGGCCGAGTCGGGT |
| 10950 | GGGCGACTCTCGAGAGTCGCCC | 10657 | TCCCGACTCGGCCGAGTCGGGA |
| 15546 | CCGGGACTCACGTGAGTCCCGG | 10656 | GCCAGACTCGGCCGAGTCTGGC |

FIG. 8B (CONTINUED)

| SEQ ID NO: | | SEQ ID NO: | |
|---|---|---|---|
| 10659 | GCCTGACTCGGCCGAGTCAGGC | 10717 | GCCTGACTCCCGGGAGTCAGGC |
| 10645 | GACGGACTCGGCCGAGTCCGTC | 10703 | GACGGACTCCCGGGAGTCCGTC |
| 10649 | GTCGGACTCGGCCGAGTCCGAC | 10707 | GTCGGACTCCCGGGAGTCCGAC |
| 10644 | AGCGGACTCGGCCGAGTCCGCT | 10702 | AGCGGACTCCCGGGAGTCCGCT |
| 10648 | TGCGGACTCGGCCGAGTCCGCA | 10706 | TGCGGACTCCCGGGAGTCCGCA |
| 10646 | GGAGGACTCGGCCGAGTCCTCC | 10704 | GGAGGACTCCCGGGAGTCCTCC |
| 10650 | GGTGGACTCGGCCGAGTCCACC | 10708 | GGTGGACTCCCGGGAGTCCACC |
| 10647 | GGCAGACTCGGCCGAGTCTGCC | 10705 | GGCAGACTCCCGGGAGTCTGCC |
| 10651 | GGCTGACTCGGCCGAGTCAGCC | 10709 | GGCTGACTCCCGGGAGTCAGCC |
| 10682 | CACGGACTCGGCCGAGTCCGTG | 10740 | CACGGACTCCCGGGAGTCCGTG |
| 10684 | CTCGGACTCGGCCGAGTCCGAG | 10742 | CTCGGACTCCCGGGAGTCCGAG |
| 10670 | CCAGGACTCGGCCGAGTCCTGG | 10728 | CCAGGACTCCCGGGAGTCCTGG |
| 10674 | CCTGGACTCGGCCGAGTCCAGG | 10732 | CCTGGACTCCCGGGAGTCCAGG |
| 10683 | CCCAGACTCGGCCGAGTCTGGG | 10741 | CCCAGACTCCCGGGAGTCTGGG |
| 10685 | CCCTGACTCGGCCGAGTCAGGG | 10743 | CCCTGACTCCCGGGAGTCAGGG |
| 10668 | ACGGGACTCGGCCGAGTCCCGT | 10726 | ACGGGACTCCCGGGAGTCCCGT |
| 10672 | TCGGGACTCGGCCGAGTCCCGA | 10730 | TCGGGACTCCCGGGAGTCCCGA |
| 10669 | CAGGGACTCGGCCGAGTCCCTG | 10727 | CAGGGACTCCCGGGAGTCCCTG |
| 10673 | CTGGGACTCGGCCGAGTCCCAG | 10731 | CTGGGACTCCCGGGAGTCCCAG |
| 15565 | ACCGGACTCGGCCGAGTCCGGT | 15570 | ACCGGACTCCCGGGAGTCCGGT |
| 10701 | GGCGGACTCCCGGGAGTCCGCC | | |
| 10710 | GCCGACTCCCGGGAGTCGGGC | | |
| 10718 | GGGCGACTCCCGGGAGTCGCCC | | |
| 15566 | CCGGGACTCCCGGGAGTCCCGG | | |
| 15567 | CCCGGACTCCCGGGAGTCCGGG | | |
| 15568 | GCCGGACTCCCGGGAGTCCGGC | | |
| 15569 | GGCCGACTCCCGGGAGTCGGCC | | |
| 10722 | GGGAGACTCCCGGGAGTCTCCC | | |
| 10725 | GGGTGACTCCCGGGAGTCACCC | | |
| 10721 | GGACGACTCCCGGGAGTCGTCC | | |
| 10713 | GCACGACTCCCGGGAGTCGTGC | | |
| 10712 | GACCGACTCCCGGGAGTCGGTC | | |
| 10716 | GTCCGACTCCCGGGAGTCGGAC | | |
| 10711 | ACCCGACTCCCGGGAGTCGGGT | | |
| 10715 | TCCCGACTCCCGGGAGTCGGGA | | |
| 10714 | GCCAGACTCCCGGGAGTCTGGC | | |

FIG. 8B (CONTINUED)

Design of an Isothermal DNA Amplification Assay for Soy Lectin From a Single Pair of Predicted Optimal Primer Structures without Screening a Multitude of Candidate Primer Combinations of Unknown Performance

- Assay target sequence in Soy Lectin gene selected based on absence of SNP's a 30 to 60 bp sequence window:
- 5'-ccaaggttcattacctatgatgcctccaccagcctcttgttcttgtctacccttcacagagaa-3'
- Underlined are the sequence regions selected for design of the forward and reverse primers, respectively.
- Target binding region of Fwd primer: 5'-ATTACCTATGATGCC-3'
- $\Delta G_{25°C}$ of Fwd Primer-Target Hybrid (PTH) = -25.99 kcal/mole; $\Delta G_{25°C}$ of Primer-Target binding region self dimer (PTBRHD) = -3.14 kcal/mole; $\Delta \Delta G_{25°C} = \Delta G_{PTH} - \Delta G_{PTBRHD} = -22.85$ kcal/mole
- Target binding region of Rev primer: 5'-ACCAAAGAAGCAAC-3'
- $\Delta G_{25°C}$ of rev Primer-Target Hybrid (PTH) = -25.35 kcal/mole; $\Delta G_{25°C}$ of Primer-Target binding region self dimer (PTBRHD) = -3.14 kcal/mole; $\Delta \Delta G_{25°C} = \Delta G_{PTH} - \Delta G_{PTBRHD} = -22.21$ kcal/mole

FIG. 12

Design of an Isothermal DNA Amplification Assay for Pathogenic *Salmonella enterica* *invA* Gene From a Single Pair of Predicted Optimal Primer Structures without Screening a Multitude of Candidate Primer Combinations of Unknown Performance

- *Salmonella enterica invA* assay target sequence selected based on absence of SNP's a

FIG. 15

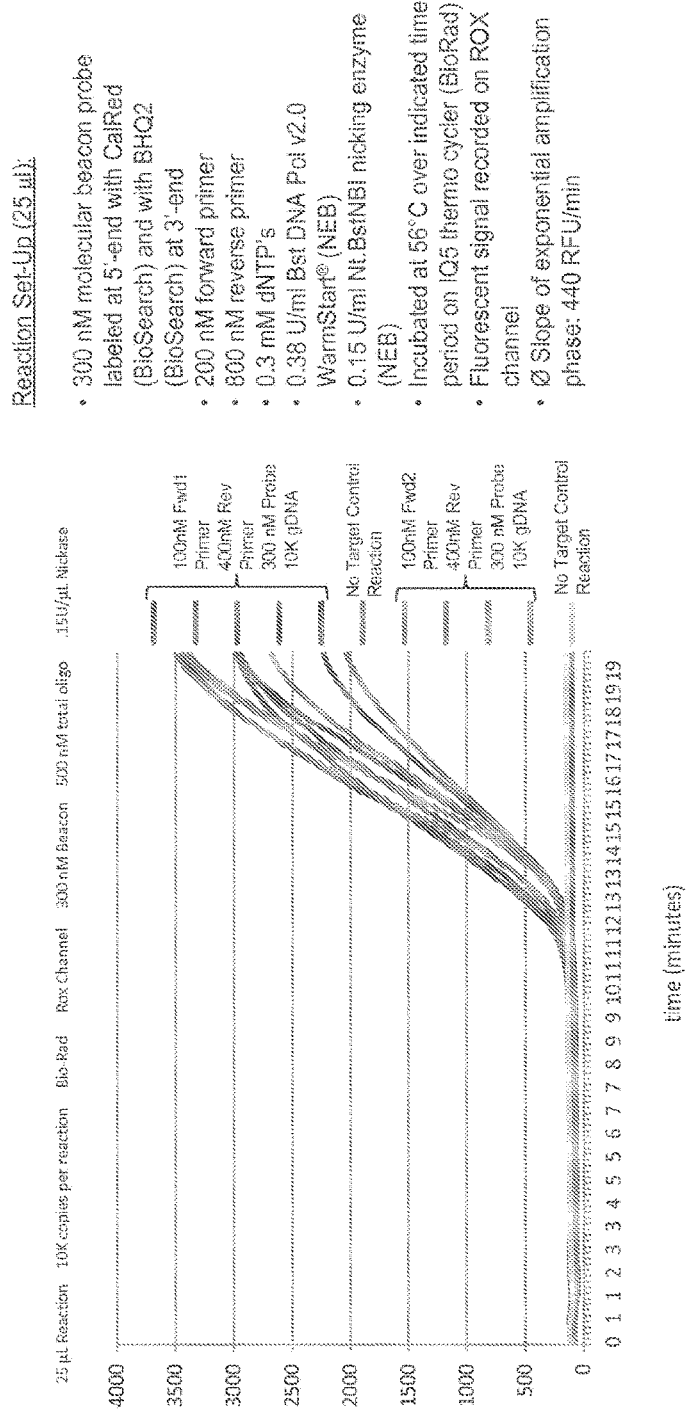

Salmonella invA Assay - First Trial Experimental Results
Empirical Confirmation of Assay Performance Prediction Primer and probe sequences used in the assay (all synthesized by BioSearch Inc., Novato, CA)
5'-GGCTGACTCCTGCAGGAGTCAGGCATAGCCATATCATCTGmUmUmAmCmC-3' fwd 1 primer ("m" stands for 2'-methoxy nucleotide)
5'-GGCTGACTCCTGCAGGAGTCAGGAGTCAGGCATACTCATCTGTmUmUmAmCmC-3' fwd2 primer
5'-GGCTGACTCCTGCAGGAGTCAGGCCTTTTCTCTGmGmAmUmGmG-3' rev primer
5'-CalRed$_{610}$-ACCTGTTTACCGGGCATACAAACAGGT-BHQ2 molecular beacon probe ("I" stands for universal inosine nucleotide)

COMPOSITIONS AND METHODS FOR ENHANCING AND/OR PREDICTING DNA AMPLIFICATION

CROSS REFERENCE TO RELATED APPLICATIONS

This application is a continuation of U.S. application Ser. No. 15/306,032, filed Oct. 21, 2016, which is the U.S. National Stage Application, pursuant to 35 U.S.C. § 371, of PCT International Application No. PCT/US2015/027074, filed Apr. 22, 2015, designating the United States and published in English, which claims priority to and the benefit of U.S. Provisional Application No. 61/982,784, filed Apr. 22, 2014, entitled "Compositions and Methods for Enhancing and/or Predicting DNA Amplification," the entire contents of each of which are incorporated herein by reference in their entirety.

SEQUENCE LISTING

The instant application contains a Sequence Listing which has been submitted electronically in XML format and is hereby incorporated by reference in its entirety. Said XML copy, created on Dec. 19, 2022, is named 167665_010329_US_CON_SL.xml and is 20,756,625 bytes in size.

BACKGROUND OF THE INVENTION

While methods of nucleic acid amplification are common and well-known, nucleic acid amplification reactions still suffer from unpredictable and/or poor performance due in large part to the difficulties associated with primer design. The unpredictability of nucleic acid amplification reactions is due in large part to a lack of sequence-predictable design parameters for primer and probes that allow a quantitative assessment of target-specific prime and probe hybridization versus off-target binding, self/self and self/non-self dimerization. Indeed, variability in the selection of possible primer sequences and sequence constraints imposed by target nucleic acid sequences, has made it difficult to empirically and systematically interrogate the landscape of primer combinations and their outcomes.

PCR assay-based design parameters have focused on primer and probe melting temperatures, GC (guanine and cytosine) content, primer length, and minimizing interactions of the primer with all but the target nucleic acid (see e.g., premier biosoft primer design website). In particular, use of a primer having intermolecular interactions with itself (e.g., primer-dimers) is highly discouraged, as such primers are believed to undesirably affect the interaction of the primer with the target nucleic acid molecule. Additionally, it is proposed that the optimal length of nucleic acid primers is 18-22 nucleotides, which is considered long enough for adequate specificity and short enough for primers to bind easily to the template at the annealing temperature. Regarding GC content, a GC content of 40-60% is recommended. Erroneously, common assay design practice assumes that when all the above mentioned parameters are designed equally for a forward and reverse primer of an amplification assay the hybridization kinetics of these two primers will turn out similar as well. None of these commonly used design parameters adequately correlate with complex thermodynamics of two stage oligonucleotide hybridization, which involves changes in enthalpy, entropy, solvation, nearest neighbor effects, and hydrogen bonding in the transition from the single stranded from to the double stranded hybrid stage. Moreover, even the use of the two stage model of oligonucleotide hybridization as the foundation of thermodynamic algorithms is overly simplified and does not reflect the real situation accurately. Therefore, the performance of primers meeting all of the recommended criteria remains unpredictable.

Progress in determining the effectiveness of a set of primers to predictably amplify a target nucleic acid under essentially isothermal conditions has the potential to reduce the expenditure of resources, including the effort, time, and expense of synthesizing and empirically testing a large multitude of primer sets (e.g., designing multiple primers and pairwise screening of multiple primer combinations). New parameters and methods are required to enhance and better predict the performance and yield of nucleic acid amplification reactions.

SUMMARY OF THE INVENTION

As described herein, the present invention provides improved methods for designing primers capable of predictably amplifying a target nucleic acid molecule, and methods of using these primers for nucleic acid amplification, including enhancing amplification of a target nucleic acid molecule and/or reducing or eliminating the generation of background products. Further, the invention provides compositions and methods for the amplification and detection of a sample target oligonucleotide. In particular embodiments, compositions and methods of the invention are compatible with isothermal nucleic acid amplification reactions.

In one aspect, the invention provides an isolated primer oligonucleotide containing from 5' to 3', a first region having a self-complementary sequence containing from 5' to 3' the reverse complement of a nicking enzyme recognition sequence, a palindromic sequence, and said nicking enzyme recognition sequence, and a second region at least 16 nucleotides long that specifically binds to a complementary region on a target nucleic acid molecule to form a double-stranded hybrid having a ΔG that is at least 15 kcal/mol lower than the ΔG of any alternate structure involving or interacting with the second region, where the second region has at the 3' end one or more 2' modified nucleotides.

In another aspect, the invention provides an isolated primer-dimer having two oligonucleotide monomers containing from 5' to 3', a first region having a self-complementary sequence containing from 5' to 3' the reverse complement of a nicking enzyme recognition sequence, a palindromic sequence, and said nicking enzyme recognition sequence, and a second region at least 16 nucleotides long that specifically binds to a complementary region on a target nucleic acid molecule to form a double-stranded hybrid having a ΔG that is at least 15 kcal/mol lower than the ΔG of any alternate structure involving or interacting with the second region, where the second region has at the 3' end one or more 2' modified nucleotides.

In another aspect, the invention provides an isolated oligonucleotide probe for detecting a target nucleic acid molecule containing: an oligonucleotide; a fluorescent reporter; and a quenching molecule capable of absorbing the excitation energy from the fluorescent reporter; where the fluorescent reporter and quenching molecule are covalently attached to opposite 5' and 3' ends of the oligonucleotide, where the oligonucleotide contains a first region having a nucleic acid sequence that is substantially complementary to a target nucleic acid sequence and a second region 5' upstream of the first region, and a third region 3' downstream of the first region that has a nucleic acid sequence complementary to the second region, where the oligonucleotide is capable of forming a stem-loop hairpin structure by hybridization of the second and third regions when the oligonucleotide is not bound to the target nucleic acid molecule, and where the ΔG of the double-stranded hybrid between the target sequence and the first sequence of the oligonucleotide probe is at least 15 kcal/mol lower than the ΔG of any alternate structure involving or interacting with the oligonucleotide probe.

In another aspect, the invention provides a method of amplifying a specific product in a nicking and extension amplification reaction, the method involving: contacting a target nucleic acid molecule under substantially isothermal conditions with a polymerase, two or more primers, each of which specifically binds to a complementary sequence on the target nucleic acid molecule, a nicking enzyme, and a detectable polynucleotide probe, where at least one primer contains from 5' to 3', a first region having a self-complementary sequence containing from 5' to 3' the reverse complement of a nicking enzyme recognition sequence, a palindromic sequence, and said nicking enzyme recognition sequence, and a second region at least 16 nucleotides long that specifically binds to a complementary region on a target nucleic acid molecule to form a double-stranded hybrid having a ΔG that is at least 15 kcal/mol lower than the ΔG of any alternate structure involving or interacting with the second region, where the second region has at the 3' end one or more 2' modified nucleotides; and generating amplicons containing at least a portion of the target nucleic acid molecule.

In another aspect, the invention provides a method of detecting a specific product in a nicking and extension amplification reaction, the method involving: contacting a target nucleic acid molecule under substantially isothermal conditions with a polymerase, two or more primers, each of which specifically binds to a complementary sequence on the target nucleic acid molecule, a nicking enzyme, and a detectable oligonucleotide probe, where at least one primer contains from 5' to 3', a first region having a self-complementary sequence containing from 5' to 3' the reverse complement of a nicking enzyme recognition sequence, a palindromic sequence, and said nicking enzyme recognition sequence, and a second region at least 16 nucleotides long that specifically binds to a complementary region on a target nucleic acid molecule to form a double-stranded hybrid having a ΔG that is at least 15 kcal/mol lower than the ΔG of any alternate structure involving or interacting with the second region, where the second region has at the 3' end one or more 2' modified nucleotides; generating amplicons containing at least a portion of said target nucleic acid molecule; and detecting a signal specific for oligonucleotide probe hybridization to the target nucleic acid molecule or amplicon thereof, where the signal indicates the presence of the target nucleic acid molecule present in the sample or an amplicon thereof.

In another aspect, the invention provides a kit for amplifying a target sequence in a nicking amplification reaction, the kit containing one or more primer oligonucleotides containing from 5' to 3', a first region having a self-complementary sequence containing from 5' to 3' the reverse complement of a nicking enzyme recognition sequence, a palindromic sequence, and said nicking enzyme recognition sequence, and a second region at least 16 nucleotides long that specifically binds to a complementary region on a target nucleic acid molecule to form a double-stranded hybrid having a ΔG that is at least 15 kcal/mol lower than the ΔG of any alternate structure involving or interacting with the second region, where the second region has at the 3' end one or more 2' modified nucleotides; and directions for use of the primer oligonucleotides in the methods of the invention.

In a related aspect, the invention provides a method of selecting a primer oligonucleotide according to any aspect of the invention delineated herein, including providing computer program instructions on a tangible, non-transitory computer readable medium for implementing such methods of selecting a primer oligonucleotide.

In various embodiments of the above aspects, the first region is 12, 13, 14, 15, 16, 17, 18, 19, 20, 21, 22, 23, or 24 nucleotides in length. In various embodiments, the first region is fully self-complementary. In various embodiments of the above aspects, the palindromic sequence in the first region is 2, 4, or 6 nucleotides long. In various embodiments of the above aspects, the second region is 16, 17, 18, 19, 20, 21, 22, 23, 24, 25, 26, 27, 28, 29, or 30 nucleotides in length.

In various embodiments of the above aspects, the alternate structure is one or more of a partially double-stranded hybrid that the second region can form with itself (e.g., self-self dimers), with a partial sequence of the first region (e.g., heteromdimers), with other oligonucleotides, primers, or probes in an amplification reaction, or with partially complementary nucleic acid sequences outside of the target sequence region (e.g., off-target hybrids).

In various embodiments of the above aspects, the oligonucleotide (e.g., primer oligonucleotide, oligonucleotide monomer) is in the form of a homodimer (e.g., primer-dimer) formed by hybridization of the self-complementary first region sequences of two primer oligonucleotide molecules. In various embodiments, the homodimer has a ΔG that is at least 15 kcal/mol lower than the ΔG of any alternate structure involving or interacting with the primer oligonucleotide, including the most stable alternate structure comprising the primer oligonucleotide. In various embodiments of the above aspects, the free energy (ΔG) is determined or calculated for a nucleic acid at 25° C. ($\Delta G_{25° C.}$) and/or at 1 atmosphere (atm) of pressure (~101.3 kPa). In various embodiments of the above aspects, the free energy (ΔG) is determined or calculated by the mFold algorithm.

In various embodiments of the above aspects, the second region of the oligonucleotide (e.g., primer oligonucleotide, oligonucleotide monomer) includes one or more 2' modified nucleotides, where the 2' modification is selected from the group consisting of 2'-O-methyl, 2'-methoxyethoxy, 2'-fluoro, 2'-hydroxyl, 2'-alkyl, 2'-allyl, 2'-O-[2-(methylamino) oxoethyl], 4'-thio, 4'-CH$_2$—O-2'-bridge, 4'-(CH$_2$)$_2$—O-2'-bridge, and 2'-O—(N-methylcarbamate) or those containing base analogs. In particular embodiments, the one or more 2' modified nucleotides are positioned at the 3' terminus of the second region. In other embodiments, the two or more 2' modified nucleotides are contiguous. In still other embodiments, the number of contiguous 2' modified nucleotides is 2, 3, 4, 5, or 6. In various embodiments of any aspect delineated herein, the nicking enzyme is one or more of Nt·BspD6I and Nt·BstNBI. In various embodiments of any aspect delineated herein, the nicking enzyme recognition sequence within the first region is 5'-GAGTC-3' (and the reverse complement of the nicking enzyme recognition sequence is 5'-GACTC-3'). In various embodiments of any aspect delineated herein, the oligonucleotide (e.g., primer oligonucleotide, oligonucleotide monomer) has recognition sequence of the nicking agent is positioned to cleave the phosphodiester bond between the first and second regions. In various embodiments of the above aspects, the polymerase is a *Geobacillus* spp. or *Bacillus stearothermophilus*

DNA polymerase I, or active fragments and derivatives thereof. In certain embodiments, the polymerase is one or more of Bst DNA polymerase I, Gst DNA polymerase I, or Gka DNA polymerase I.

In various embodiments of any aspect delineated herein, the oligonucleotide (e.g., primer oligonucleotide, oligonucleotide monomer) has a first region including a nucleic acid sequence set forth below:

```
                                       (SEQ ID NO: 15241)
5'-GACTCN₁N₁,GAGTC-3';

(SEQ ID NO: 15242)
5'-GACTCN₁N₁,GAGTCN-3';

(SEQ ID NO: 15243)
5'-N₂GACTCN₁N₁,GAGTCN₂,-3';

(SEQ ID NO: 15244)
5'-N₂GACTCN₁N₁,GAGTCN₂,N-3';

(SEQ ID NO: 15245)
5'-N₃N₂GACTCN₁N₁,GAGTCN₂,N₃,-3';

(SEQ ID NO: 15246)
5'-N₃N₂GACTCN₁N₁,GAGTCN₂,N₃,N-3';

(SEQ ID NO: 15247)
5'-N₄N₃N₂GACTCN₁N₁,GAGTCN₂,N₃,N₄,-3';

(SEQ ID NO: 15248)
5'-N₄N₃N₂GACTCN₁N₁,GAGTCN₂,N₃,N₄,N-3';

(SEQ ID NO: 15249)
5'-N₅N₄N₃N₂GACTCN₁N₁,GAGTCN₂,N₃,N₄,N₅,-3';

(SEQ ID NO: 15250)
5'-GACTCN₂N₁N₁,N₂,GAGTC-3';

(SEQ ID NO: 15251)
5'-GACTCN₂N₁N₁,N₂,GAGTCN-3';

(SEQ ID NO: 15252)
5'-N₃GACTCN₂N₁N₁,N₂,GAGTCN₃,-3';

(SEQ ID NO: 15253)
5'-N₃GACTCN₂N₁N₁,N₂,GAGTCN₃,N-3';

(SEQ ID NO: 15254)
5'-N₄N₃GACTCN₂N₁N₁,N₂,GAGTCN₃,N₄,-3';

(SEQ ID NO: 15255)
5'-N₄N₃GACTCN₂N₁N₁,N₂,GAGTCN₃,N₄,N-3';

(SEQ ID NO: 15256)
5'-N₅N₄N₃GACTCN₂N₁N₁,N₂,GAGTCN₃,N₄,N₅,-3';

(SEQ ID NO: 15257)
5'-N₅N₄N₃GACTCN₂N₁N₁,N₂,GAGTCN₃,N₄,N₅,N-3';
and
                                       (SEQ ID NO: 15258)
5'-N₆N₅N₄N₃GACTCN₂N₁N₁,N₂,GAGTCN₃,N₄,N₅,N₆,-3', (SEQ ID NO: 15259)
5'-GACTCN₃N₂N₁N₁,N₂,N₃,GAGTC-3';

(SEQ ID NO: 15260)
5'-GACTCN₃N₂N₁N₁,N₂,N₃,GAGTCN-3';

(SEQ ID NO: 15261)
5'-GACTCN₃N₂N₁N₁,N₂,N₃,GAGTCNN-3';

(SEQ ID NO: 15262)
5'-GACTCN₃N₂N₁N₁,N₂,N₃,GAGTCNNN-3';

(SEQ ID NO: 15263)
5'-GACTCN₃N₂N₁N₁,N₂,N₃,GAGTCNNNN-3';
```

-continued
```
                                       (SEQ ID NO: 15264)
5'-N₄GACTCN₃N₂N₁N₁,N₂,N₃,GAGTCN₄,-3';

(SEQ ID NO: 15265)
5'-N₄GACTCN₃N₂N₁N₁,N₂,N₃,GAGTCN₄,N-3';

(SEQ ID NO: 15266)
5'-N₄GACTCN₃N₂N₁N₁,N₂,N₃,GAGTCN₄,NN-3';

(SEQ ID NO: 15267)
5'-N₄GACTCN₃N₂N₁N₁,N₂,N₃,GAGTCN₄,NNN-3';

(SEQ ID NO: 15268)
5'-N₅N₄GACTCN₃N₂N₁N₁,N₂,N₃,GAGTCN₄,N₅,-3';

(SEQ ID NO: 15269)
5'-N₅N₄GACTCN₃N₂N₁N₁,N₂,N₃,GAGTCN₄,N₅,N-3';

(SEQ ID NO: 15270)
5'-N₆N₅N₄GACTCN₃N₂N₁N₁,N₂,N₃,GAGTCN₄,N₅,N₆,-3';

(SEQ ID NO: 15271)
5'-N₆N₅N₄GACTCN₃N₂N₁N₁,N₂,N₃,GAGTCN₄,N₅,N₆,N-3';
and
                                       (SEQ ID NO: 15272)
5'-N₇N₆N₅N₄GACTCN₃N₂N₁N₁,N₂,N₃,GAGTCN₄,N₅,N₆,N₇,-3',
``` where "N" is any nucleotide (e.g., having an adenine (A), thymine (T), cytosine (C), or guanine (G) nucleobase), and $N_1$ is complementary to $N_{1'}$, $N_2$ to $N_{2'}$, $N_3$ to $N_{3'}$, $N_4$ to $N_{4'}$, $N_5$ to $N_{5'}$, $N_6$ to $N_{6'}$, and $N_7$ to $N_{7'}$. In certain embodiments, the oligonucleotide (e.g., primer oligonucleotide, oligonucleotide monomer) comprises a 5' tail region comprising a sequence set forth in the Sequence Listing submitted herewith.

In various embodiments of any aspect delineated herein, the oligonucleotide probe for detecting a target nucleic acid molecule contains: an oligonucleotide; a fluorescent reporter; and a quenching molecule capable of absorbing the excitation energy from the fluorescent reporter; where the fluorescent reporter and quenching molecule are covalently attached to opposite 5' and 3' ends of the oligonucleotide, where the oligonucleotide contains a first region having a nucleic acid sequence that is substantially complementary to a target nucleic acid sequence and a second region 5' upstream of the first region, and a third region 3' downstream of the first region that has a nucleic acid sequence complementary to the second region, where the oligonucleotide is capable of forming a stem-loop hairpin structure by hybridization of the second and third regions when the oligonucleotide is not bound to the target nucleic acid molecule. In various embodiments of any aspect delineated herein, the ΔG of the double-stranded hybrid between the target sequence and the first sequence of the oligonucleotide probe is at least 15 kcal/mol lower than the ΔG of any alternate structure involving or interacting with the oligonucleotide probe. In various aspects, the second and the third regions of the oligonucleotide probe are 4-8 nucleotides in length.

In various embodiments of any aspect delineated herein, directions are provided for use of the primer oligonucleotides and/or oligonucleotide probes of the invention. In various embodiments of any aspect delineated herein, the primers and probes in a reaction are designed and/or selected to perform together in an amplification and detection reaction.

Other features and advantages of the invention will be apparent from the detailed description, and from the claims.

Definitions

By "amplicon" is meant a polynucleotide generated during the amplification of a polynucleotide of interest. In one example, an amplicon is generated during a polymerase chain reaction.

By "amplification rate modifiers" is meant an agent capable of affecting the rate of polymerase extension.

By "base substitution" is meant a substituent of a nucleobase polymer that does not cause significant disruption of the hybridization between complementary nucleotide strands.

In this disclosure, "comprises," "comprising," "containing" and "having" and the like can have the meaning ascribed to them in U.S. patent law and can mean "includes," "including," and the like; "consisting essentially of" or "consists essentially" likewise has the meaning ascribed in U.S. patent law and the term is open-ended, allowing for the presence of more than that which is recited so long as basic or novel characteristics of that which is recited is not changed by the presence of more than that which is recited, but excludes prior art embodiments.

By "complementary" or "complementarity" is meant that a nucleic acid can form hydrogen bond(s) with another nucleic acid sequence by either traditional Watson-Crick or Hoogsteen base pairing. Complementary base pairing includes not only G-C and A-T base pairing, but also includes base pairing involving universal bases, such as inosine. A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). To determine that a percent complementarity is of at least a certain percentage, the percentage of contiguous residues in a nucleic acid molecule that can form hydrogen bonds (e.g., Watson-Crick base pairing) with a second nucleic acid sequence is calculated and rounded to the nearest whole number (e.g., 12, 13, 14, 15, 16, or 17 nucleotides out of a total of 23 nucleotides in the first oligonucleotide being based paired to a second nucleic acid sequence having 23 nucleotides represents 52%, 57%, 61%, 65%, 70%, and 74%, respectively; and has at least 50%, 50%, 60%, 60%, 70%, and 70% complementarity, respectively). As used herein, "substantially complementary" refers to complementarity between the strands such that they are capable of hybridizing under biological conditions. Substantially complementary sequences have 60%, 70%, 80%, 90%, 95%, or even 100% complementarity. Additionally, techniques to determine if two strands are capable of hybridizing under biological conditions by examining their nucleotide sequences are well known in the art.

As used herein, "duplex" refers to a double helical structure formed by the interaction of two single stranded nucleic acids. A duplex is typically formed by the pairwise hydrogen bonding of bases, i.e., "base pairing", between two single stranded nucleic acids which are oriented antiparallel with respect to each other. Base pairing in duplexes generally occurs by Watson-Crick base pairing, e.g., guanine (G) forms a base pair with cytosine (C) in DNA and RNA, adenine (A) forms a base pair with thymine (T) in DNA, and adenine (A) forms a base pair with uracil (U) in RNA. Conditions under which base pairs can form include physiological or biologically relevant conditions (e.g., intracellular: pH 7.2, 140 mM potassium ion; extracellular pH 7.4, 145 mM sodium ion). Furthermore, duplexes are stabilized by stacking interactions between adjacent nucleotides. As used herein, a duplex may be established or maintained by base pairing or by stacking interactions. A duplex is formed by two complementary nucleic acid strands, which may be substantially complementary or fully complementary. Single-stranded nucleic acids that base pair over a number of bases are said to "hybridize."

"Detect" refers to identifying the presence, absence or amount of the analyte to be detected.

By "detectable moiety" is meant a composition that when linked to a molecule of interest renders the latter detectable, via spectroscopic, photochemical, biochemical, immunochemical, or chemical means. For example, useful labels include radioactive isotopes, magnetic beads, metallic beads, colloidal particles, fluorescent dyes, electron-dense reagents, enzymes (for example, as commonly used in an ELISA), biotin, digoxigenin, or haptens.

By "fragment" is meant a portion of a nucleic acid molecule. This portion contains, preferably, at least 10%, 20%, 30%, 40%, 50%, 60%, 70%, 80%, or 90% of the entire length of the reference nucleic acid molecule or polypeptide. A fragment may contain 5, 10, 15, 20, 30, 40, 50, 60, 70, 80, 90, or 100 nucleotides.

By "free energy ($\Delta G$)" is meant the net exchange of energy between the system and its environment at a constant temperature and pressure described by the formula: $\Delta G = \Delta H - T\Delta S$. Free energy represents how favorable the formation of a structure is, where the formation of a structure having a more negative $\Delta G$ (e.g., expressed in kcal/mol) is thermodynamically more favored in a dynamic equilibrium of multiple alternate structures. Accordingly, $\Delta\Delta G$ measures the difference in favorability between the formation of two different structures having two different $\Delta Gs$. In one aspect, $\Delta\Delta G$ provides a numerical score measuring the favorability of formation of a desired oligonucleotide structure over the possible formation of other undesirable structures in dynamic equilibrium. In one embodiment, the first structure is the duplex hybrid formed between the first region (5' tail region) of one oligonucleotide and the first region (5' tail region) of a second oligonucleotide having the same nucleic acid sequence as the first oligonucleotide; and the second structure is any other alternate structure comprising the oligonucleotide.

By "hybridize" is meant to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507). Hybridization occurs by hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

By "nucleic acid hybrid" is meant a substantially double-stranded molecule formed by the binding of complementary nucleic acid molecules. In one embodiment, the double-stranded molecule is partially or fully double-stranded.

By "isolated polynucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "melting temperature (Tm)" is meant the temperature of a system in equilibrium where 50% of the molecular population is in one state and 50% of the population is in another state. With regard to the nucleic acids of the invention, Tm is the temperature at which 50% of the population is single-stranded and 50% is double-stranded (e.g., intramolecularly or intermolecularly).

By "monitoring a reaction" is meant detecting the progress of a reaction. In one embodiment, monitoring reaction progression involves detecting polymerase extension and/or detecting the completion of an amplification reaction.

As used herein, "obtaining" as in "obtaining an agent" includes synthesizing, purchasing, or otherwise acquiring the agent.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, 2' modified nucleotides (e.g., 2'-O-methyl ribonucleotides, 2'-F nucleotides).

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-O-methyl, 2'-methoxyethoxy, 2'-fluoro, 2'-hydroxyl (RNA), 2'-allyl, 2'-O-[2-(methylamino)-2-oxoethyl], 4'-thio, 4'-CH$_2$—O-2'-bridge, 4'-(CH$_2$)$_2$—O-2'-bridge, and 2'-O—(N-methylcarbamate) or those comprising base analogs.

By "nucleotide adduct" is meant a moiety that is bound covalently or otherwise fixed to a standard nucleotide base.

By "nicking agent" is meant a chemical entity capable of recognizing and binding to a specific structure in double stranded nucleic acid molecules and breaking a phosphodiester bond between adjoining nucleotides on a single strand upon binding to its recognized specific structure, thereby creating a free 3'-hydroxyl group on the terminal nucleotide preceding the nick site. In preferred embodiments, the 3' end can be extended by an exonuclease deficient polymerase. Exemplary nicking agents include nicking enzymes, RNAzymes, DNAzymes, and transition metal chelators.

By "palindromic" is meant nucleic acid sequences that are identical when read from 5' to 3' on one strand or 5' to 3' on the complementary strand. A perfect palindrome refers to a sequence having two adjacent subsequences, such that when one subsequence is read from the 5' to 3' direction, it is identical to the other subsequence read from the 3' to 5' direction.

By "polymerase-arresting molecule" is meant a moiety associated with a polynucleotide template or primer that prevents or significantly reduces the progression of a polymerase on the polynucleotide template. Preferably, the moiety is incorporated into the polynucleotide. In one preferred embodiment, the moiety prevents the polymerase from progressing on the template.

By "polymerase extension" is meant the forward progression of a polymerase that matches incoming monomers to their binding partners on a template polynucleotide.

As used herein, "primer-dimer" is meant a dimer of two monomer oligonucleotide primers. In the oligonucleotide primers of the invention, the 5' tail regions of monomer primers dimerize.

By "specific product" is meant a polynucleotide product resulting from the hybridization of primer oligonucleotides to a complementary target sequence and subsequent polymerase mediated extension of the target sequence.

By "substantially isothermal condition" is meant at a single temperature or within a narrow range of temperatures that does not vary significantly. In one embodiment, a reaction carried out under substantially isothermal conditions is carried out at a temperature that varies by only about 1-5° C. (e.g., varying by 1, 2, 3, 4, or 5 degrees). In another embodiment, the reaction is carried out at a single temperature within the operating parameters of the instrument utilized.

By "reference" is meant a standard or control condition. As is apparent to one skilled in the art, an appropriate reference is where an element is changed in order to determine the effect of the element.

By "subject" is meant a mammal, including, but not limited to, a human or non-human mammal, such as a bovine, equine, canine, ovine, or feline.

By "target nucleic acid molecule" is meant a polynucleotide to be analyzed. Such polynucleotide may be a sense or antisense strand of the target sequence. The term "target nucleic acid molecule" also refers to amplicons of the original target sequence.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

Unless specifically stated or obvious from context, as used herein, the term "or" is understood to be inclusive. Unless specifically stated or obvious from context, as used herein, the terms "a", "an", and "the" are understood to be singular or plural.

Unless specifically stated or obvious from context, as used herein, the term "about" is understood as within a range of normal tolerance in the art, for example within 2 standard deviations of the mean. About can be understood as within 10%, 9%, 8%, 7%, 6%, 5%, 4%, 3%, 2%, 1%, 0.5%, 0.1%, 0.05%, or 0.01% of the stated value. Unless otherwise clear from context, all numerical values provided herein are modified by the term about.

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof.

Any compositions or methods provided herein can be combined with one or more of any of the other compositions and methods provided herein.

BRIEF DESCRIPTION OF THE DRAWINGS

FIG. 4 shows desirable (right) and undesirable (left) primer structures. The primers of the invention may adopt a structure favorable to the amplification reaction, including primer-dimers and/or a hairpin, due to the presence of self-complementary sequences. Without being bound to theory, primer dimers are more stable and form when primers are present at high concentration in the reaction (e.g., at the start of the reaction) and hairpins form when primer concentration is reduced (e.g., during the course of the reaction).

FIG. 6 shows that an optimal primer is one in which the dimer configuration is highly favored (i.e., $\Delta G_1 >> \Delta G_2$), especially over the next favored configuration (e.g., where the primer interacts with itself intramolecularly). This configuration is in contrast to FIG. 5, where a dynamic equilibrium exists between configurations. Primers can be designed to have stable configurations and structures favorable for nucleic acid amplification reactions, while reducing or eliminating the formation of undesirable primer configurations and structures. For primers having a 5' tail dimerization region, the 5' tail sequence is selected to favor and be more stable than other structures ($\Delta G_1 \leq -30$ to $-62$ kcal/mol). For primers in nicking amplification reactions, the 5' tail sequence is substantially self-complementary and symmetrically inverted. Such primers may have the potential to form intramolecular interactions (e.g., a hair-pin loop). However, such configurations are minimized when the symmetrically inverted sequences are fully self-complementary, as indicated by the stability of the primer-dimer over the hair-pin loop structure (a very low $\Delta G_1$ in comparison to $\Delta G_2$). Thus, when the primer is at a high enough concentration, the hair-pin is not effectively formed.

FIG. 7 depicts sequences of stable primer-dimer structures of primers useful in nicking amplification reactions. FIG. 7 depicts a homodimer of a primer dimer having a 5' tail region with a nicking enzyme recognition sequence for a top strand nicking enzyme (Nt·BstNBI). The nick site is designed to be positioned between the nucleotide at the 3' end of the 5' tail region and the nucleotide at the 5' end of the 3' recognition region. Without being bound to theory, the nicking enzyme does not cleave at the nick site when the 3' recognition is single-stranded. However, cleavage at the nick site occurs when the 3' recognition region is double stranded (e.g., when the primer is incorporated into a double-stranded target nucleic acid molecule during the course of the nucleic acid amplification reaction). FIG. 7 discloses SEQ ID NOS 15515 and 15515, respectively, in order of appearance.

FIGS. 8A-8B depict exemplary 5' tail region sequences. FIG. 8A depicts exemplary 5' tail region sequences 24 nucleotides in length having a Nt·BstNBI recognition sequence and based on the following formula: 5'-NNNNGACTCNNNNNNNGAGTCNNNN-3' (SEQ ID NO: 15272). Based on this formula, there are 537,824 5' tail sequences having the following properties: ΔG=−34.2 Kcal/mole to −65 kcal/mole; ΔΔG<−40 kcal/mole; and GC content 68% to 84%. Of these, 1100 selected sequences are provided, representing 0.2% of the entire sequence space (248,832). FIG. 8A discloses the sequences in the first column as SEQ ID NOS 582, 591, 599, 603, 606, 602, 594, 593, 597, 592, 596, 595, 598, 584, 588, 583, 587, 585, 589, 586, 590, 621, 623, 609, 613, 622, 624, 607, 611, 608, 612, 15329, 15330, 176, 15331, 185, 15332, 193, 197, 200, 196, 15333, 188, 15334, 187, 191, 186, 190, 189, 192, 178, 182, 15335, 15336, 177, 181, 179, 183, 180, 184, 215, 217, 203, 207, 216, 218, 201, 205, 202, 206, 15337, 15338, 15339, 15340, 15341, 15342, 15343, 15344, 15345, 15346, 15347, 15348, 15349, 15350, 15351, 15352, 15353, 15354, 15355, 15356, 15357, 15358, 15359, 15360, 15361, 15362, 15363, 15364, 15365, 15366, 15367, 1046, 1055, 1063, 1067, 1070, 1066, 1058, 1057, 1061, 1056, 1060, 1059, 1062, 1048, 1052, 1047, 1051, 1049, 1053, 1050, 1054, 1085, 1087, 1073, 1077, 1086, 1088, 1071, 1075, 1072, 1076, 15368, 15369, 15370, 15371, 15372, 15373, 15374, 15375, 15376, 15377, 15378, 15379, 15380, 15381, 15382, 15383, 15384, 15385, 15386, 15387, 15388, 15389, 15390, 15391, 15392, 15393, 15394, 15395, 15396, 15397, 15398, 640, 649, 657, 661, 664, 660, 652, 651, 655, 650, 654, 653, 656, 642, 646, 641, 645, 643, 647, 644, 648, 679, 681, 667, 671, 680, 682, 665, 669, 666, 670, 814, 823, 831, 835, 838, 834, 826, 825, 829, 824, 828, 827, 830, 816, 820, 815, 819, 817, 821, 818, 822, 853, 855, 841, 845, 854, 856, 839, 843, 840, 844, 15407, 15408, 2264, 15409, 2273, 15410, 2281, 2285, 2288, 2284, 15411, 2276, 15412, 2275, 2279, 2274, 2278, 2277, 2280, 2266, 2270, 15413, 15414, 2265, 2269, 2267, 2271, 2268, 2272, 2303, 2305, 2291, 2295, 2304, 2306, 2289, 2293, 2290, 2294, 2206, 2215, 2223, 2227, 2230, 2226, 2218, 2217, 2221, 2216, 2220, 2219, 2222, 2208, 2212, 2207, 2211, 2209, 2213, 2210, 2214, 2245, 2247, 2233, 2237, 2246, 2248, 2231, 2235, 2232, 2236, 814, 823, 831, 835, 838, 834, 826, 825, 829, 824, 828, 827, 830, 816, 820, 815, 819, 817, 821, 818, 822, 853, 855, 841, 845, 854, 856, 839, 843, 840, 844, 2264, 2273, 2281, 2285, 2288, 2284, 2276, 2275, 2279, 2274, 2278, 2277, 2280, 2266, 2270, 2265, 2269, 2267, 2271, 2268, 2272, 2303, 2305, 2291, 2295, 2304, 2306, 2289, 2293, 2290, 2294, 872, 881, 889, 893, 896, 892, 884, 883, 887, 882, 886, 885, 888, 874, 878, 873, 877, 875, 879, 876, 880, 911, 913, 899, 15415, 912, 914, 897, 901, 898, 902, 524, 533, 541, 545, 548, 544, 536, 535, 539, 534, 538, 537, 540, 526, 530, 525, 529, 527, 531, 528, 532, 563, 565, 551, 555, 564, 566, 549, 553, 550, 554, 15454, 15455, 1800, 15456, 1809, 15457, 1817, 1821, 1824, 1820, 15458, 1812, 15459, 1811, 1815, 1810, 1814, 1813, 1816, 1802, 1806, 15460, 15461, 1801, 1805, 1803, 1807, 1804, 1808, 1839, 1841, 1827, 1831, 1840, 1842, 1825, 1829, 1826, 1830, 930, 939, 947, 951, 954, 950, 942, 941, 945, 940, 944, 943, 946, 932, 936, 931, 935, 933, 937, 934, 938, 969, 971, 957, 961, 970, 972, 955, 959, 956, 960, 15462, 15462, 15463, 15464, 15465, 15466, 15467, 15468, 15469, 15470, 15471, 15472, 15473, 15474, 15475, 15476, 15477, 15478, 15479, 15480, 15481, 15482, 15483, 15484, 15485, 15486, 15487, 15488, 15489, 15490, 15491, 524, 533, 541, 545, 548, 544, 536, 535, 539, 534, 538, 537, 540, 526, 530, 525, 529, 527, 531, 528, 532, 563, 565, 551, 555, 564, 566, 549, 553, 550, 554, 1767, 1771, 1768 and 1772, and the sequences in the second column as SEQ ID NOS 1974, 1983, 1991, 1995, 1998, 1994, 1986, 1985, 1989, 1984, 1988, 1987, 1990, 1976, 1980, 1975, 1979, 1977, 1981, 1978, 1982, 2013, 2015, 2001, 2005, 2014, 2016, 1999, 2003, 2000, 2004, 15399, 15400, 408, 15401, 417, 15402, 425, 429, 432, 428, 15403, 420, 15404, 419, 423, 418, 422, 421, 424, 410, 414, 15405, 15406, 409, 413, 411, 415, 412, 416, 447, 449, 435, 439, 448, 450, 433, 437, 434, 438, 350, 359, 367, 371, 374, 370, 362, 361, 365, 360, 364, 363, 366, 352, 356, 351, 355, 353, 357, 354, 358, 389, 391, 377, 381, 390, 392, 375, 379, 376, 380, 1974, 1983, 1991, 1995, 1998, 1994, 1986, 1985, 1989, 1984, 1988, 1987, 1990, 1976, 1980, 1975, 1979, 1977, 1981, 1978, 1982, 2013, 2015, 2001, 2005, 2014, 2016, 1999, 2003, 2000, 2004, 408, 417, 425, 429, 432, 428, 420, 419, 423, 418, 422, 421, 424, 410, 414, 409, 413, 411, 415, 412, 416, 447, 449, 435, 439, 448, 450, 433, 437, 434, 438, 2032, 2041, 2049, 2053, 2056, 2052, 2044, 2043, 2047, 2042, 2046, 2045, 2048, 2034, 2038, 2033, 2037, 2035, 2039, 2036, 2040, 2071, 2073, 2059, 2063, 2072, 2074, 2057, 2061, 2058, 2062, 1278, 1287, 1295, 1299, 1302, 1298, 1290, 1289, 1293, 1288, 1292, 1291, 1294, 1280, 1284, 1279, 1283, 1281, 1285, 1282, 1286, 1317, 1319, 1305, 1309, 1318, 1320, 1303, 1307, 1304, 1308, 15416, 15417, 1568, 15418, 1577, 15419, 1585, 1589, 1592, 1588, 15420, 1580, 15421, 1579, 1583, 1578, 1582, 1581, 1584, 1570, 1574, 15422, 15423, 1569, 1573, 1571, 1575, 1572, 1576, 1607, 1609, 1595, 1599, 1608, 1610, 1593, 1597, 1594, 1598, 15424, 15424, 15425, 15426, 15427, 15428, 15429, 15430, 15431, 15432, 15433, 15434, 15435, 15436, 15437, 15438, 15439, 15440, 15441, 15442, 15443, 15444, 15445, 15446, 15447, 15448, 15449, 15450, 15451, 15452, 15453, 1510, 1519, 1527, 1531, 1534, 1530, 1522, 1521, 1525, 1520, 1524, 1523, 1526, 1512, 1516, 1511, 1515, 1513, 1517, 1514, 1518, 1549, 1551, 1537, 1541, 1550, 1552, 1535, 1539, 1536, 1540, 1336, 1345, 1353, 1357, 1360, 1356, 1348, 1347, 1351, 1346, 1350, 1349, 1352, 1338, 1342, 1337, 1341, 1339, 1343, 1340, 1344, 1375, 1377, 1363, 1367, 1376, 1378, 1361, 1365, 1362, 1366, 1336, 1345, 1353, 1357, 1360, 1356, 1348, 1347, 1351, 1346, 1350, 1349, 1352, 1338, 1342, 1337, 1341, 1339, 1343, 1340, 1344, 1375, 1377, 1363, 1367, 1376, 1378, 1361, 1365, 1362, 1366, 466, 475, 483, 487, 490, 486, 478, 477, 481, 476, 480, 479, 482, 468, 472, 467, 471, 469, 473, 470, 474, 505, 507, 493, 497, 506, 508, 491, 495, 492, 496, 15492, 15493, 60, 15494, 69, 15495, 77, 81, 84, 80, 15496, 72, 15497, 71, 75, 70, 74, 73, 76, 62, 66, 15498, 15499, 61, 65, 63, 67, 64, 68, 99, 101, 87, 91, 100, 102, 85, 89, 86, 90, 15500, 15501, 2, 15502, 11, 15503, 19, 23, 26, 22, 15504, 14, 15505, 13, 17, 12, 16, 15, 18, 4, 8, 15506, 15507, 3, 7, 5, 9, 6, 10, 41, 43, 29, 33, 42, 44, 27, 31, 28, 32, 466, 475, 483, 487, 490, 486, 478, 477, 481, 476, 480, 479, 482, 468, 472, 467, 471, 469, 473, 470, 474, 505, 507, 493, 497, 506, 508, 491, 495, 492, 496, 1742, 1751, 1759, 1763, 1766, 1762, 1754, 1753, 1757, 1752, 1756, 1755, 1758, 1744, 1748, 1743, 1747, 1745, 1749, 1746, 1750, 1781, 1783, 1769, 1773, 1782 and 1784, all respectively, in order of appearance. FIG. 8B depicts exemplary 5' tail region sequences 22 nucleotides in length having a Nt·BstNBI recognition sequence and based on the following formula: 5'-NNNNGACTCNNNN-GAGTCNNNN-3' (SEQ ID NO: 15258). Based on this formula, there are 248,832 5' tail sequences having the following properties: $\Delta G=-47$ Kcal/mole to $-55$ kcal/mole; $\Delta\Delta G<-40$ kcal/mole; and GC content 72% to 82%. Of these, 200 selected sequences are provided, representing 0.08% of the entire sequence space (248,832). FIG. 8B discloses the sequences in the first column as SEQ ID NOS 10411, 10420, 10428, 15516, 15517, 15518, 15519, 10548, 10435, 10431, 10423, 10422, 10426, 10421, 10425, 10424, 10427, 10413, 10417, 10412, 10416, 10414, 10418, 10415, 10419, 10450, 10452, 10438, 10442, 10451, 10453, 10436, 10440, 10437, 10441, 15520, 10551, 10547, 10539, 10538, 10542, 10537, 10541, 10540, 10543, 10529, 10533, 15541, 10528, 10532, 10530, 10534, 10531, 10535, 10566, 10568, 10554, 10558, 10567, 10569, 10552, 10556, 10553, 10557, 15542, 15543, 10933, 15544, 10942, 15545, 10950, 15546, 10659, 10645, 10649, 10644, 10648, 10646, 10650, 10647, 10651, 10682, 10684, 10670, 10674, 10683, 10685, 10668, 10672, 10669, 10673, 15565, 10701, 10710, 10718, 15566, 15567, 15568, 15569, 10722, 10725, 10721, 10713, 10712, 10716, 10711, 10715 and 10714, and the sequences in the second column as SEQ ID NOS 10469, 10478, 10486, 15521, 15522, 15523, 15524, 10991, 11000, 11008, 15525, 15526, 15527, 15528, 10817, 10826, 10834, 15529, 15530, 15531, 15532, 10875, 10884, 10892, 15533, 15534, 15535, 15536, 15537, 15538, 10527, 15539, 10536, 15540, 10544, 10548, 15547, 10585, 15548, 10594, 15549, 10602, 15550, 15551, 10759, 15552, 10768, 15553, 10776, 15554, 15555, 15556, 15557, 15558, 15559, 15560, 10643, 10652, 10660, 15561, 15562, 15563, 15564, 10664, 10667, 10663, 10655, 10654, 10658, 10653, 10657, 10656, 10717, 10703, 10707, 10702, 10706, 10704, 10708, 10705, 10709, 10740, 10742, 10728, 10732, 10741, 10743, 10726, 10730, 10727, 10731 and 15570, all respectively, in order of appearance.

FIG. 12 depicts the design of an isothermal DNA amplification assay for Soy Lectin from a single pair of predicted optimal primer structures and a single predicted optimal probe without screening a multitude of candidate primer combinations of unknown performance. FIG. 12 discloses SEQ ID NOS 15316-15318, respectively, in order of appearance.

FIG. 13 discloses SEQ ID NOS 15319-15321, respectively, in order of appearance.

FIG. 14 depicts the design of an isothermal DNA amplification assay for pathogenic *Salmonella enterica* invA gene from a single pair of predicted optimal primer structures and a single predicted optimal probe without screening a multitude of candidate primer combinations of unknown performance. FIG. 14 discloses SEQ ID NOS 15322-15324, respectively, in order of appearance.

FIG. 15 is a graph depicting results of the first experimental trial of the isothermal DNA amplification assay for pathogenic *Salmonella enterica* invA gene, which empirically confirm assay performance prediction. Target specific amplification was observed in reactions containing soy genomic DNA. No amplification was observed in no target control reactions. FIG. 15 discloses SEQ ID NOS 15325-15328, respectively, in order of appearance.

FIG. 17A is a graph plotting $\Delta\Delta G$ in kcal/mol of first primer region (5'-tail) self-self dimer of working assay primers and failed assay primers against $\Delta\Delta G$ in kcal/mol of second primer region/target hybrid duplex. Clustering of working assay primers and failed assay primers showed correlation with function/non-function. FIG. 17B is a graph plotting length in bases of second primer target-complementary region of working assay primers and failed assay primers against % GC content of second primer target-complementary region. Working assay primers and failed assay primers showed a random distribution. FIG. 17C is a graph plotting length in bases of second primer target-complementary region of working assay primers and failed assay primers against $\Delta G$ in kcal/mol of second primer region/target hybrid duplex. Working assay primers and failed assay primers showed a random distribution. FIG. 17D is a graph plotting $T_M$ in ° C. of second primer region/target hybrid duplex of working assay primers and failed assay primers against $\Delta G$ in kcal/mol of second primer region/target hybrid duplex. Working assay primers and failed assay primers showed no correlation with function/non-function. FIG. 17E is a graph plotting $\Delta G$ in kcal/mol of most favored second primer region/off-target hybrid duplex of working assay primers and failed assay primers against $\Delta G$ in kcal/mol of primer region/target hybrid duplex. Working assay primers and failed assay primers showed a random distribution. FIG. 17F is a graph plotting % GC content of second primer region of working assay primers and failed assay primers against $T_M$ in ° C. of second primer region/target hybrid duplex. Working assay primers and failed assay primers showed a random distribution. FIG. 17G is a graph plotting % GC content of second primer region of working assay primers and failed assay primers against $\Delta G$ in kcal/mol of second primer region/target hybrid duplex. Working assay primers and failed assay primers showed a random distribution. FIG. 17H is a graph plotting % GC content of second primer region of working assay primers and failed assay primers against $T_M$ in ° C. of second primer region/target hybrid duplex. Working assay primers and failed assay primers showed a random distribution. FIG. 17I is a graph plotting length in bases of primer (3' target recognition region) of working assay primers and failed assay primers against $T_M$ in ° C. of primer-target hybrid duplex. Working assay primers and failed assay primers showed a random distribution.

DETAILED DESCRIPTION OF THE INVENTION

The invention methods that are useful for the predictable design of primers, and methods of using such primers for the amplification of a target nucleic acid molecule in a nucleic acid amplification reaction. The compositions and methods are also useful for the amplification and detection of a target nucleic acid molecule in a nucleic acid amplification reaction, including in a nicking amplification reaction.

The invention is based, at least in part, on several discoveries relating to oligonucleotides used in nucleic amplification reactions, including primers and probes, and their effect on enhancing or enabling nucleic acid amplification reactions. Applicants were the first to appreciate that one or more of these discoveries in combination could be applied to design primers and probes for nucleic acid amplification reactions and/or detection assays.

The invention is based, at least in part, on the discovery that oligonucleotides (e.g., primers and probes) in certain configurations have the potential to enhance nucleic acid amplification reaction performance, and that the ability of the oligonucleotides to adopt favorable configurations can be determined by examining the difference in free energy change ($\Delta G$) between desired specific oligonucleotide-target sequence hybrids and various non-specific intramolecular (partially double-stranded monomers) and intermolecular complexes (primer-primer and primer-probe dimers, off-target hybrids) of the oligonucleotide. To date, primer and probe design has not employed the difference in free energy change between target-specific and non-specific primer and probe structures as a score ranking tool to identify the most suitable primer/probe set for a target sequence amplification assay. Application of the foregoing considerations to primer design results in the design of primers that function predictaby, minimizing or eliminating the need for empirical testing. Accordingly, the invention provides methods for primer sequence selection, primer modification, and/or probe design that facilitates operational nucleic acid amplification and detection reactions.

Figure 11:
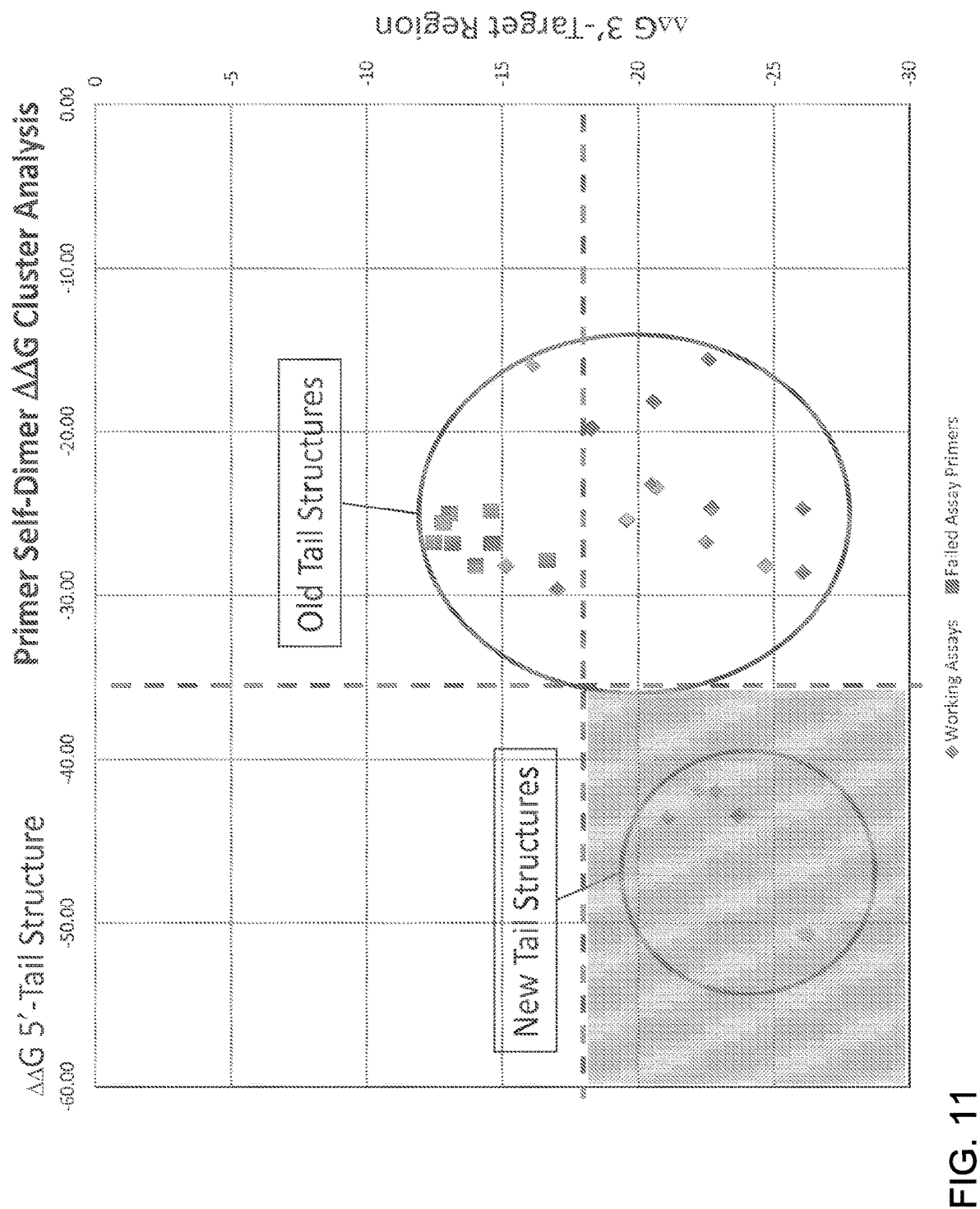
FIG. 11 is a graph of working and failed assay primers plotted according to their relative stabilities. Primers having a 3' recognition region having a $\Delta\Delta G \leq$ about $-16$ kcal/mole were observed to work in nicking amplification assays, while primers having a $\Delta\Delta G$>about $-16$ were prone to failure. Primers having a 3' recognition region having a $\Delta\Delta G \leq$ about $-16$ kcal/mole and a 5' tail having a $\Delta\Delta G \leq$ about $-30$ kcal/mole were all observed to work.

Applicants have discovered that a primer having a 3' recognition sequence whose primer-target formation is stable (e.g., $\Delta G_{25° C.}$≤about −20 kcal/mol or more) has the potential to enhance nucleic acid amplification reaction performance. In particular embodiments, the 3' target recognition sequence comprises 12-24, 12-17, or 12-14 bases. In particular embodiments, the primer-target formation is more stable than self dimer formation (e.g., $\Delta\Delta G$≤about −15, −16, −17, −18, −19, −20 kcal/mol or more). Indeed, it has been found that a difference between a working and non-working assay is when the $\Delta\Delta G$<about −15 kcal/mol (see, e.g., FIG. 11).

Figure 1:
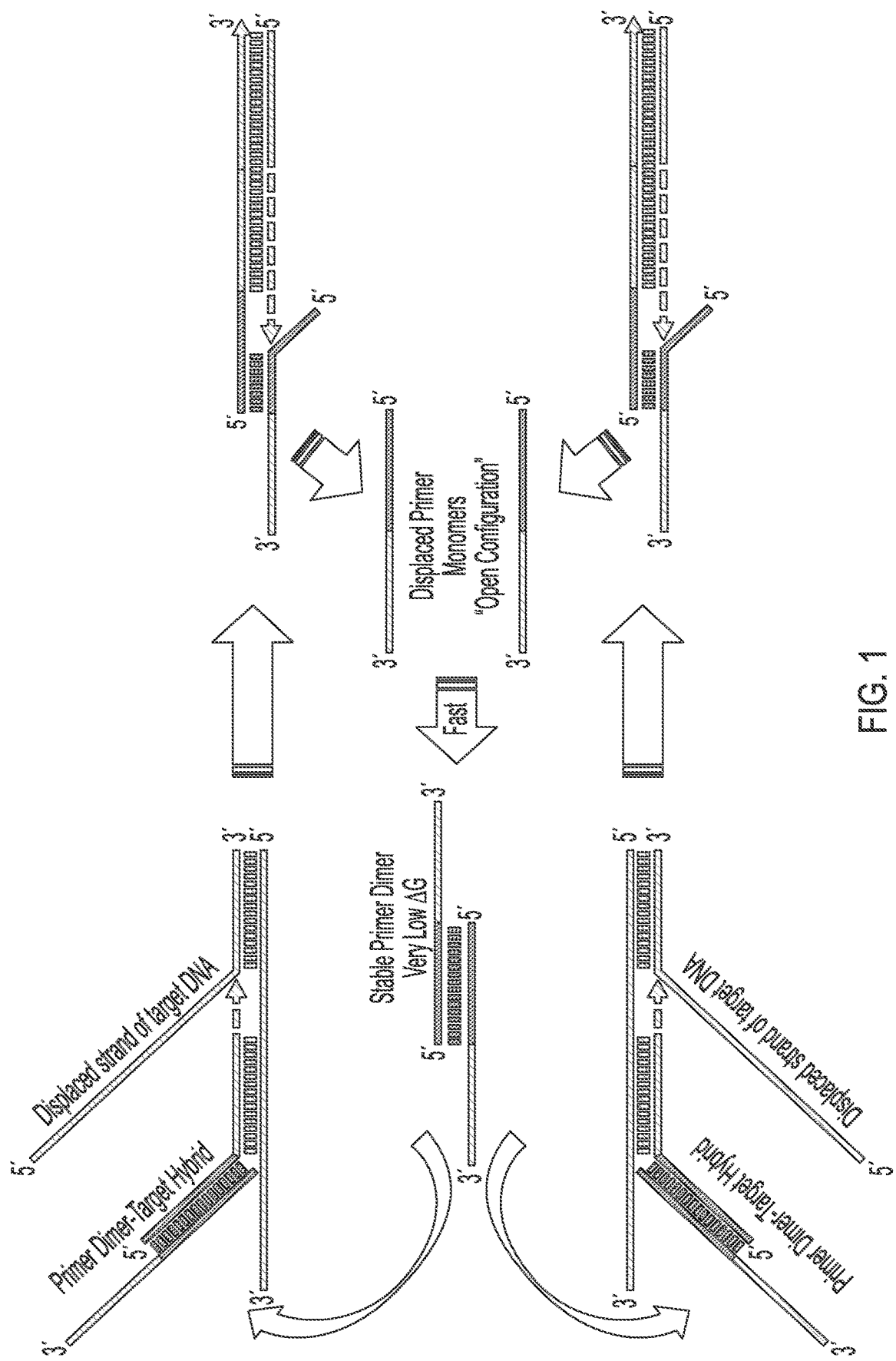
FIG. 1 depicts a mechanism describing a strand displacement nucleic acid amplification reaction of a target nucleic acid molecule having efficient, exponential amplification. The interaction of the 3' end of a target nucleic acid molecule (gray) with a corresponding, sequence-specific primer having a 3' recognition region (red) and "5' tail" region capable of dimerization (black) is shown. For target specific amplification, the 3' recognition region (red) is complementary in sequence to and capable of specifically hybridizing to the target nucleic acid. The primer in an active configuration is a stable homodimer (termed a "primer-dimer") formed by the dimerization of the 5' tail regions of two monomer primers. In one specific embodiment, the primer has a self-complementary, symmetrically inverted sequence. The resulting primer-dimer has a double-stranded or substantially double-stranded dimerization region (black) that is 5' with respect to the single-stranded recognition regions (red). That is, the target specific portion of the primer (capable of annealing to the target nucleic acid molecule) is exposed in the primer-dimer as the 3' single-stranded regions. At the start of the reaction, a 3' single-strand portion of the primer-dimer anneals to a target nucleic acid molecule, and initiates replication of the target nucleic acid molecule. During the course of the reaction, monomer primers are released from extended primer-dimers by polymerase strand displacement action from synthesis of the complementary strand. To enhance the specificity and/or efficiency of the amplification reaction, monomer primers are designed to have (1) a 5' tail region having a sequence that is self-complementary, symmetrical or substantially symmetrical, and capable of base pairing to itself and (2) a 3' recognition region perfectly or substantially complementary in sequence to and capable of specifically hybridizing to the target nucleic acid molecule. When ΔG for primer-dimer formation is low, the time a primer is present as a monomer with an open configuration is minimized. Monomer primers are undesirable because they can serve as either a template or primer in non-target-specific primer extension reactions, thereby generating and/or amplifying background. Preferably, the transition from monomer to dimer is "virtually instantaneous" or as brief as kinetically possible. Thermodynamic factors (e.g., very low ΔG of primer-dimer formation, high primer concentration, high dimer Tm) are used to favor primer-dimer formation.
Figure 2:
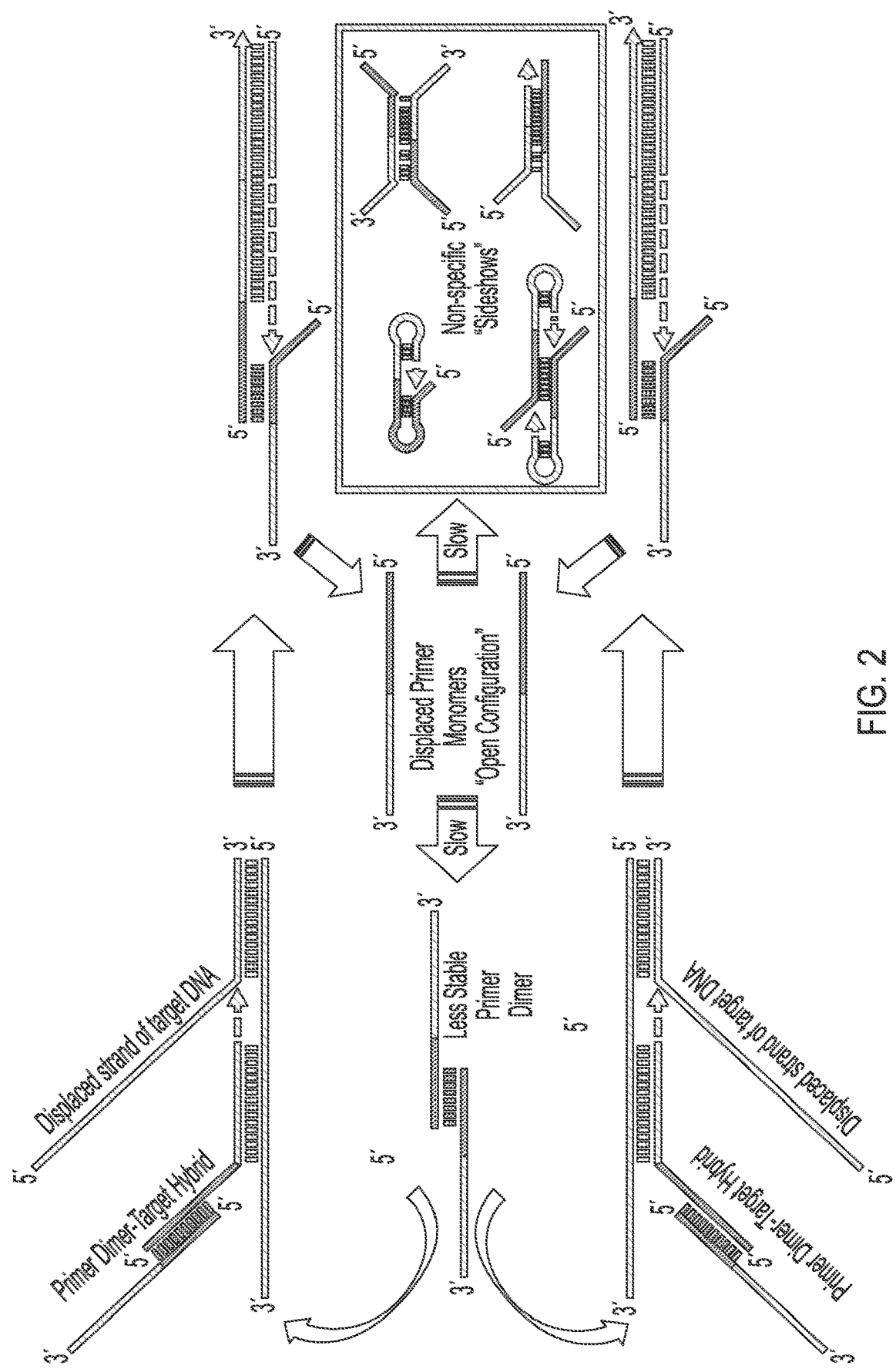
FIG. 2 depicts a mechanism describing a strand displacement nucleic acid amplification reaction of a target nucleic acid having inefficient amplification. The interaction of the 3' end of a target nucleic acid molecule (gray) with a corresponding, sequence-specific primer (red and black) is shown. Isothermal reactions where monomer primers in an open configuration persist throughout the reaction lead to linear non-specific background amplification. Primer monomers that do not favor primer-dimer formation have, for example, minimal or no self-complementary sequences in the 5' portion of the monomer primer (black), resulting in a high ΔG for primer-dimer formation. Because interaction of the primer-dimer with the target nucleic acid molecule drives the annealing and extension reactions, formation of primer-dimers affects the efficiency of target nucleic acid synthesis and/or amplification. In the fully or partially open configuration, a primer monomer can serve either as a template or a primer in non-target-specific primer extension reactions (see inset), which leads to additional reaction inefficiencies. Where the open configuration of monomer primers is not minimized (e.g., by sequence design), the transition from monomer to dimer is slow, because it is not favored by thermodynamic factors (e.g., multiple dimer and partial dimer configurations co-having similar ΔG's and low dimer Tm's).
Figure 3:
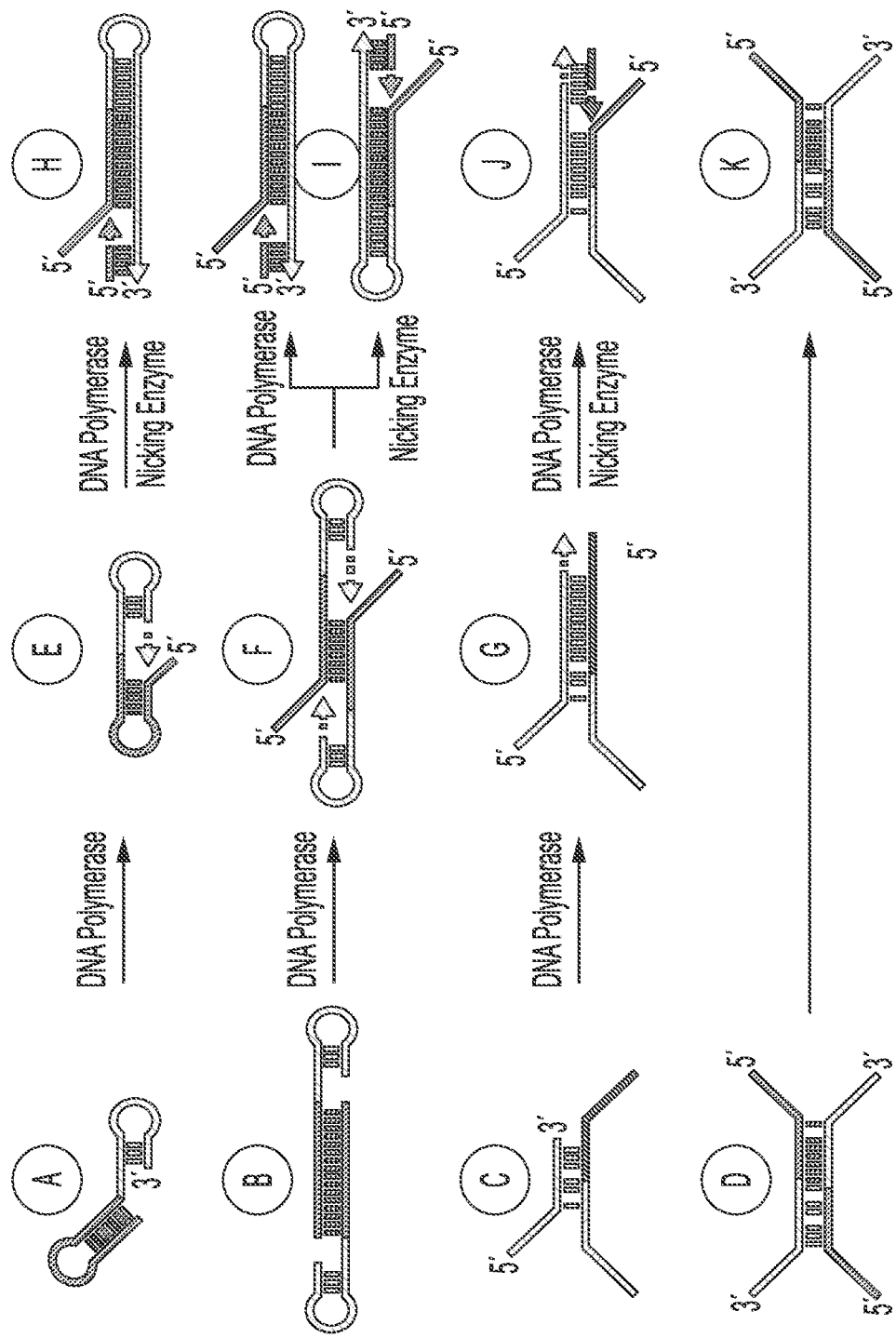
FIG. 3 depicts primer structures that inhibit primer-dimer formation including, for example, structures (A) to (C) which lead to amplification of non-specific by-products (structures (H) to (J)) or structures (D) and (K), which are incapable of target hybridization. Interactions between primers (red and black) nucleic acid fragments (gray) are shown. Structure (A) depicts a primer monomer having a discontinuous inverted sequence in the target specific region that is capable of "looping" back to create an extendable 3'-end for "self-replication." Structure (A) also has a 5' region that loops back on itself to form a hairpin structure. Structure (B) depicts a primer-dimer having discontinuous inverted sequences in the target specific region of the primer that are capable of "looping" back to create extendable 3'-ends for "self-replication. Structure (C) depicts a false hybrid structure between a primer monomer in "open" configuration and a single stranded DNA fragment (gray) displaced by DNA polymerase nick-extension reactions from closely positioned random and/or sequence-specific nicks in template DNA. Structure (D) depicts a partially double-stranded dimer structure, where a significant part of the target-specific region is not accessible for target hybridization. Structure (D) may be formed by inverted sequence repeats in the primer monomer. Structure (E) depicts an intermediate, false primer extension/strand displacement reaction product generated from structure (A). Structure (G) depicts an intermediate, false primer extension/strand displacement reaction product generated from structure (B). Structure (H) depicts a mature, false reaction product in "nick & kick" mode, resulting in continuous recycling and amplification of single stranded by-products. Structure (J) depicts mature, false reaction products in "nick & kick" mode, resulting in continuous recycling and amplification of single stranded by-products. Structure (K) depicts the persistence of the partially double-stranded dimer of structure (D) in the reaction. Because a significant part of the target-specific region is not accessible for target hybridization, target nucleic acid replication and/or amplification is inhibited or fails to initiate. Primer design in accordance with the invention promotes optimal primer-dimer formation, which minimizes the formation of undesirable primer structures and their inhibitory effects on target specific nucleic acid amplification.
Figure 5:
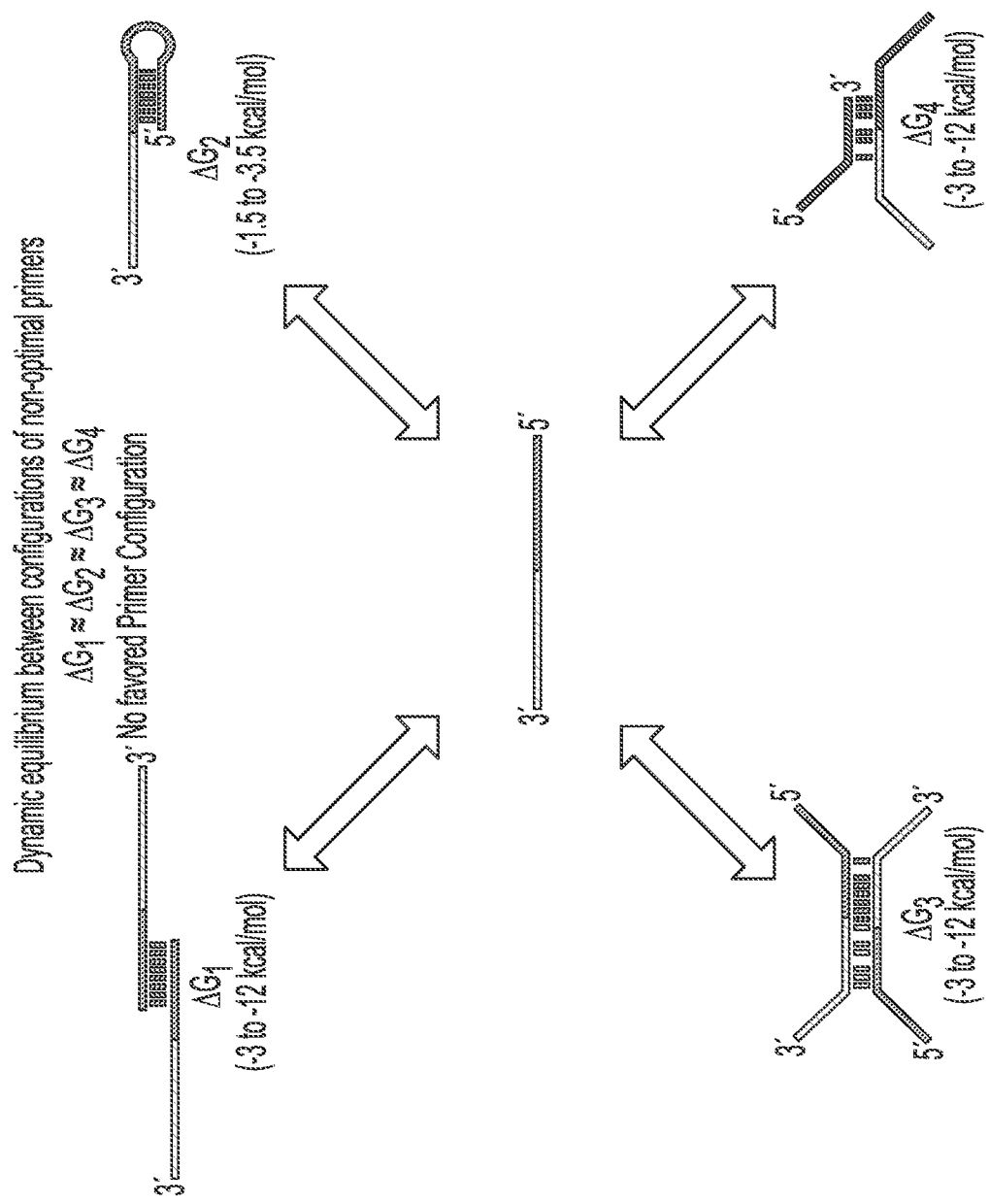
FIG. 5 depicts an undesirable primer configuration where a dynamic equilibrium exists between configurations of non-optimal primers. Where the ΔG's corresponding to the formation of each structure are about the same (i.e., $\Delta G_1 \approx \Delta G_2 \approx \Delta G_3 \approx \Delta G_4$), there is no favored primer configuration or structure. When a primer exists in such multiple configurations, it is not optimally configured to promote the nucleic acid amplification reaction.
Figure 9:
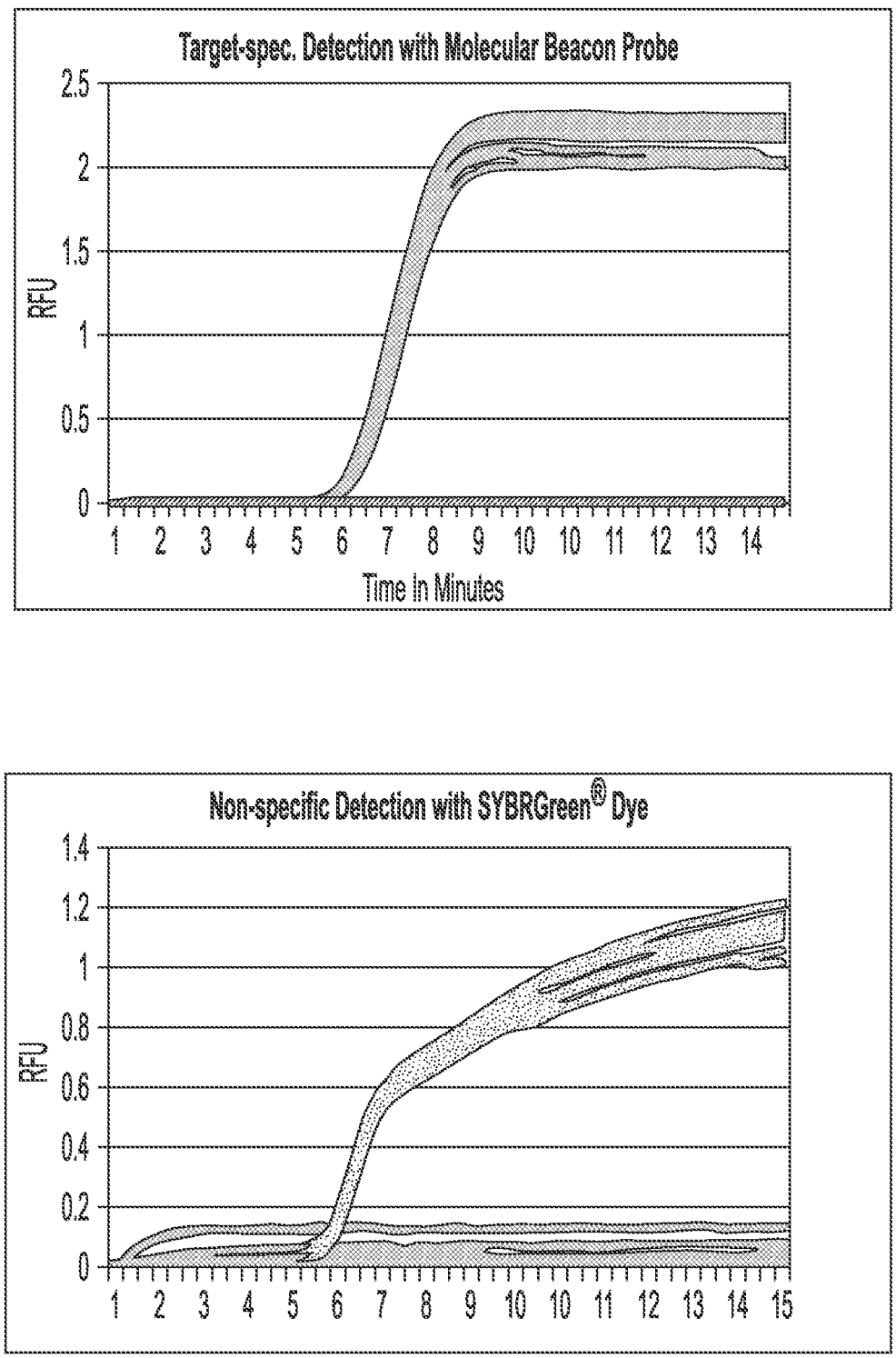
FIG. 9 are graphs showing target specific nucleic acid amplification using primers of the invention having 5' tail and 3' recognition regions as detected by dual channel detection of DNA amplification. Target-specific products are detected by a molecular beacon probe (top panel). Non-specific nucleic acid amplification is detected by SYBR-Green. As seen in both graphs, exponential amplification begins at around 6 minutes, indicating that amplification is target specific. Control reactions having no input did not produce substantial background.

Additionally, Applicants have discovered that a primer having a 5' tail region capable of self-dimerization enhances nucleic acid amplification reaction performance. Without being bound to theory, in a nucleic acid amplification reaction the primer anneals to the target nucleic acid as a primer-dimer (see e.g., FIG. 1). Surprisingly and unexpectedly, this primer-dimer configuration does not detectably interfere with polymerase activity, and reduces or prevents non-specific interaction of the 5' portion of the primer with itself or other nucleic acid molecules. The 5' tail region comprises a perfect palindrome sequence, through which monomer primers can dimerize. For example, primers have a nicking agent recognition site present at the 5' end that is unrelated to the binding specificity of the primer for the target recognition sequence. Non-specific background products from non-specific primer interactions have the potential to sequester reaction components that would otherwise have been utilized for the amplification of the specific product. In various embodiments, homodimer formation is stable (e.g., $\Delta G_{25°C.} \leq$ about −30, −35, −40, −45, −50, −55, −60 kcal/mol or more). In various embodiments, the homodimer has a melting temperature higher than the extension reaction temperature. In particular embodiments, the 5' tail region has a sequence that is a palindrome. In further embodiments, the 5' tail region is at least 20 bases (e.g., 20, 21, 22, 23, 24 bases) in length. In additional embodiments, the 5' tail region has a GC content of 80-90%. In certain embodiments, homodimer formation is more stable than formation of other less stable primer dimer conformations ($\Delta\Delta G \leq$ about$\leq$−15, −20, −25, −30, −35, −40 kcal/mol or more).

Further, Applicants have discovered that primers comprising a 2' modified nucleotide (e.g., 2'-O-methyl, 2'-Fluoro, 2'-alkyl) at the 3' end of the 3' recognition region reduce or eliminate non-specific background products. This increases the generation of specific products in nucleic acid amplification reactions without the generation of background products. In various embodiments, one or more of the nucleotides in the 3' recognition region comprises a modified nucleobase that destabilizes mismatched base pairs. In particular embodiments, a modified nucleobase is in two or more continuous nucleotides starting at position 1, 2, 3, 4, 5, or 6 from the 3' terminus, where position 1 is the nucleotide at the 3' terminus. In specific embodiments, no fewer than 8 and no more than 10 unmodified nucleotides are positioned between the first 5' nucleotide of the 3' recognition region and the nearest 3' modified nucleotide.

In specific embodiments, the primer comprises a 3' recognition region and a 5' tail dimerization region. Under reaction conditions, monomer primers dimerize to form primer-dimers by binding of their 5' tail dimerization regions. Without being bound to theory, a single-stranded 3' recognition region of the primer-dimer anneals the target nucleic acid molecule and synthesizes the complementary target strand. A monomer primer is released from the extended strand by polymerase strand displacement action from synthesis of the complementary strand. The released monomer primer dimerizes with another free monomer by 5' tail region binding. Multiple cycles result in exponential target nucleic acid amplification.

Primer Design

Conventional methods for primer design have focused on primer melting temperature, primer annealing temperature, GC (guaninine and cytosine) content, primer length, and minimizing interactions of the primer with all but the target nucleic acid (see e.g., premier biosoft primer design website). Contrary to these methods, it has been found that primers that form stable primer/dimers, expressed in terms of free energy of formation ($\Delta G$), function predictably in nucleic acid amplification reactions. While Free Energy ($\Delta G$) and Melting Temperature (Tm) share primary components Enthalpy ($\Delta H$) and Entropy ($\Delta S$), $\Delta G$ and Tm values are derived differently and have no correlative relationship, and the only way to relate a given $\Delta G$ with a given Tm value is to explicitly know the value of $\Delta H$ and $\Delta S$ from which they are derived (Manthey, "mFold, Delta G, and Melting Temperature" ©2005 and 2011 Integrated DNA Technologies). FIGS. 1-11 relate to the design of optimal primers.

The free energy of formation ($\Delta G$) for intermolecular primer structures may be calculated using formulas known in the art. A number of programs are available for determining the formation of various intramolecular and intermolecular primer structures and calculating their $\Delta G$'s, including for example mfold and UNAfold prediction algorithms (see e.g., Markham and Zuker. UNAFold: Software for Nucleic Acid Folding and Hybridization. Bioinformatics: Volume 2, Chapter 1, pp 3-31, Humana Press Inc., 2008; Zuker et al. Algorithms and Thermodynamics for RNA Secondary Structure Prediction: A Practical Guide In RNA Biochemistry and Biotechnology, 11-43, NATO $\Delta$SI Series, Kluwer Academic Publishers, 1999; M. Zuker. Prediction of RNA Secondary Structure by Energy Minimization. Methods in Molecular Biology, 267-294, 1994; Jaeger et al. Predicting Optimal and Suboptimal Secondary Structure for RNA. In Molecular Evolution: Computer Analysis of Protein and Nucleic Acid Sequences, Methods in Enzymology 183, 281-306, 1990; Zuker. On Finding All Suboptimal Foldings of an RNA Molecule. Science 244, 48-52, 1989). OligoAnalyzer 3.1 is one such implementation of mfold for primer design (see the OligoAnalyzer Tool from Integrated DNA Technologies website). For example with reference to OligoAnalyzer 3.1, $\Delta G$ calculations may be performed using the following parameters: Target Type: DNA; Oligo Concentration 0.25 µM; Na$^+$ Concentration: 60 mM; Mg$^{++}$ Concentration: 15 mM; and dNTPs Concentration: 0.3 mM.

3' Recognition Region

The invention provides a primer having a 3' recognition sequence whose primer-target formation is stable ($\Delta G \leq$ about −20 kcal/mol or more) has the potential to enhance nucleic acid amplification reaction performance. The 3' recognition region specifically binds to the a target nucleic acid, for example a complementary sequence of the target nucleic acid. In certain embodiments, the 3' recognition region has a sequence that is complementary to 12, 13, 14, 15, 16, 17, 18, 19, or 20 bases or more of a target nucleic acid sequence. In various embodiments, the primer-target melting temperature is equal to or greater than 8° or 6° C. below the reaction or extension temperature of the assay (Tm$\geq$assay temperature−8°). In particular embodiments, the 3' recognition sequence comprises 12-20, 12-17, or 12-14 nucleotides. In particular embodiments, the primer-target formation is more stable than self dimer formation (e.g., $\Delta\Delta G \leq$ about −15, −16, −17, −18, −19, −20 kcal/mol or more). Indeed, it has been found that a difference between a working and non-working assay is when the $\Delta\Delta G <$ about −15 kcal/mol (see, e.g., FIG. 11). Preferably, the 3' recognition sequence does not contain self-complementary sequences, short inverted repeats (e.g., >4 bases/repeat), or sequences that otherwise promote intramolecular interactions, which have the potential to interfere with primer-target annealing.

In particular, a primer of the invention having a 3' recognition sequence is useful in nicking amplification assays. Additionally, the target specific 3' recognition region comprises one or more 2' modified nucleotides (e.g., 2'-O-methyl, 2'-methoxyethoxy, 2'-fluoro, 2'-alkyl, 2'-allyl, 2'-O-[2-(methylamino)-2-oxoethyl], 2'-hydroxyl (RNA), 4'-thio, 4'-CH$_2$—O-2'-bridge, 4'-(CH$_2$)$_2$—O-2'-bridge, and 2'-O—(N-methylcarbamate)). Without being bound to theory, it is hypothesized that incorporating one or more 2' modified nucleotides in the recognition regions reduces or eliminates intermolecular and/or intramolecular interactions of primers (e.g., primer-dimer formation), and, thereby, reduces or eliminates the background signal in isothermal amplification. The 2' modified nucleotide preferably has a base that base pairs with the target sequence. In particular embodiments, two or more 2' modified nucleotides (e.g., 2, 3, 4, 5 or more 2' modified nucleotides) in the target specific recognition region are contiguous (e.g., a block of modified nucleotides). In some embodiments, the block of 2' modified nucleotides is positioned at the 3' end of the target specific recognition region. In other embodiments, the block of 2' modified nucleotides is positioned at the 5' end of the target specific recognition region. When the block of 2' modified nucleotides is positioned at the 5' end of the target specific recognition region, the 2' modified nucleotides may be separated from the nick site by one or more non-modified nucleotides (e.g., 2, 3, 4, 5 or more 2' unmodified nucleotides). Applicants have found that positioning of one or more 2' modified nucleotides or of a block of 2' modified nucleotides alters the kinetics of amplification. When the one or more 2' modified nucleotides or block of 2' modified nucleotides are positioned at or near the 5' end of the recognition region or proximal to the nick site, real-time amplification reactions showed decreased time to detection. Additionally, the signal curve is contracted and the slope of the curve shifted.

In a related embodiment, ratios of a primer having one or more 2' modified nucleotides can be used to alter the time-to-detection and/or the efficiency of the reaction for the 'tuning' of reactions, resulting in a predictable control over reaction kinetics. Increasing the ratio of primer having one or more 2' modified nucleotides at the 3' end of the recognition sequence to primer having one or more 2' modified nucleotides at the 5' end of the recognition sequence contracted the signal curve and shifted the slope of the curve. It is advantageous to be able to "tune" a reaction providing a means to manipulate both the time-to-detection as well as the efficiency of the reaction. Tuning the reactions can be used to match efficiencies of target nucleic acid amplification and reference nucleic amplification (e.g., internal standard) in quantitative PCR (qPCR). Additionally, amplification curves of the target nucleic acid and the internal standard may be altered so time of detection of their amplification products are separated, while providing the same efficiency for target nucleic acid amplification and internal standard amplification. Through the use of specific combinations and ratios of oligonucleotide structures within a reaction it is possible to create conditions which enable tuned reaction performance.

5' Tail Dimerization Region

The invention provides a primer having a 5' tail region capable of self-dimerization that enhances nucleic acid amplification reaction performance. Without being bound to theory, in a nucleic acid amplification reaction the primer anneals to the target nucleic acid as a primer-dimer (see e.g., FIG. 1). For example, nicking amplification primers have a nicking agent recognition site present at the 5' end that is unrelated to the binding specificity of the primer for the target recognition sequence. Non-specific background products from non-specific primer interactions have the potential to sequester reaction components that would otherwise have been utilized for the amplification of the specific product. In various embodiments, homodimer formation is stable (e.g., ΔG≤about −30, −35, −40, −45, −50, −55, −60 kcal/mol or more). In various embodiments, the homodimer has a melting temperature higher than the extension reaction temperature. In particular embodiments, the 5' tail region has a sequence that is a palindrome. In further embodiments, the 5' tail region is at least 12 bases (e.g., 12, 13, 14, 15, 16, 17, 18, 19, 20, 21, 22, 23, 24 bases) in length. In additional embodiments, the 5' tail region has a GC content of 80-90%. In certain embodiments, homodimer formation is more stable than formation of other less stable primer dimer conformations formation (e.g., ΔΔG≤about −12, −13, −14, −15, −16, −17, −18, −19, −20, −25, −30, −35, −40 kcal/mol or more).

In particular, a primer of the invention having a 5' tail sequence is useful in nicking amplification reactions. For use in nicking amplification reactions, the 5' tail region comprises one or more nicking agent recognition sites and the 5' tail region has a symmetrically inverted sequence. In some embodiments, the nick site is designed to be positioned between the nucleotide at the 3' end of the 5' tail region and the nucleotide at the 5' end of the 3' recognition region. Without being bound to theory, the nicking enzyme does not cleave at the nick site when the 3' recognition is single-stranded. However, cleavage at the nick site occurs when the 3' recognition region is double stranded (e.g., when the primer is incorporated into a double-stranded target nucleic acid molecule during the course of the nucleic acid amplification reaction).

In various embodiments, the 5' tail sequence comprises from 5' to 3' an inverted nicking enzyme recognition sequence that is operatively linked to a palindromic sequence (or self-complementary sequence) that is operatively linked to a nicking enzyme recognition sequence. In certain embodiments, the spacer region is an even number of nucleotides (e.g., 2, 4, 6, etc.).

An exemplary 5' tail based on the Nt·BstNBI nicking enzyme recognition sequence (5'-GAGTC-3') having a 2 nucleotide spacer comprises a nucleic acid sequence according to the formula below:

(SEQ ID NO: 15241)
5'-GACTCN$_1$N$_{1'}$GAGTC-3' where "N" is any nucleotide (e.g., having an adenine (A), thymine (T), cytosine (C), or guanine (G) nucleobase), and N$_1$ is complementary to N$_{1'}$.

Exemplary sequences for such 2 base spacer tail sequences comprise, for example, the nucleic acid sequences according to the formulas below:

(SEQ ID NO: 15241)
5'-GACTCN$_1$N$_{1'}$GAGTC-3';

(SEQ ID NO: 15242)
5'-GACTCN$_1$N$_{1'}$GAGTCN-3';

(SEQ ID NO: 15243)
5'-N$_2$GACTCN$_1$N$_{1'}$GAGTCN$_{2'}$-3';

(SEQ ID NO: 15244)
5'-N$_2$GACTCN$_1$N$_{1'}$GAGTCN$_{2'}$N-3';

(SEQ ID NO: 15245)
5'-N$_3$N$_2$GACTCN$_1$N$_{1'}$GAGTCN$_{2'}$N$_{3'}$-3';

(SEQ ID NO: 15246)
5'-N$_3$N$_2$GACTCN$_1$N$_{1'}$GAGTCN$_{2'}$N$_{3'}$N-3';

(SEQ ID NO: 15247)
5'-N$_4$N$_3$N$_2$GACTCN$_1$N$_{1'}$GAGTCN$_{2'}$N$_{3'}$N$_{4'}$-3';

(SEQ ID NO: 15248)
5'-N$_4$N$_3$N$_2$GACTCN$_1$N$_{1'}$GAGTCN$_{2'}$N$_{3'}$N$_{4'}$N-3';
and (SEQ ID NO: 15249)
5'-N$_5$N$_4$N$_3$N$_2$GACTCN$_1$N$_{1'}$GAGTCN$_{2'}$N$_{3'}$N$_{4'}$N$_{5'}$-3', where "N" is any nucleotide (e.g., having an adenine (A), thymine (T), cytosine (C), or guanine (G) nucleobase), and N$_1$ is complementary to N$_{1'}$, N$_2$ to N$_{2'}$, N$_3$ to N$_{3'}$, N$_4$ to N$_{4'}$, and N$_5$ to N$_{5'}$, etc.

In some embodiments, 2 base spacer tails exclude those comprising the nucleic acid sequences according to the formulas below:

```
5'-TCGACTCN₁N₁·GAGTCGA-3';                (SEQ ID NO: 15273)

5'-TCGACTCN₁N₁·GAGTCGAN-3';               (SEQ ID NO: 15274)

5'-N₂TCGACTCN₁N₁·GAGTCGAN₂·-3';           (SEQ ID NO: 15275)

5'-N₂TCGACTCN₁N₁·GAGTCGAN₂·N-3';          (SEQ ID NO: 15276)

5'-GTCGACTCN₁N₁·GAGTCGAC-3';              (SEQ ID NO: 15277)

5'-GTCGACTCN₁N₁·GAGTCGACN-3';             (SEQ ID NO: 15278)

5'-N₃N₂TCGACTCN₁N₁·GAGTCGAN₂·N₃·-3';      (SEQ ID NO: 15279)

5'-N₃GTCGACTCN₁N₁·GAGTCGACN₃·-3';         (SEQ ID NO: 15280)
and

5'-AGTCGACTCN₁N₁·GAGTCGACT-3',            (SEQ ID NO: 15281)
``` where "N" is any nucleotide (e.g., having an adenine (A), thymine (T), cytosine (C), or guanine (G) nucleobase), and $N_1$ is complementary to $N_{1'}$, $N_2$ to $N_{2'}$, $N_3$ to $N_{3'}$, etc.

An exemplary 5' tail based on the Nt·BstNBI nicking enzyme recognition sequence (5'-GAGTC-3') having a 4 nucleotide spacer comprises a nucleic acid sequence according to the formula below:

```
5'-GACTCN₂N₁N₁·N₂·GAGTC-3'                (SEQ ID NO: 15250)
``` where "N" is any nucleotide (e.g., having an adenine (A), thymine (T), cytosine (C), or guanine (G) nucleobase), and $N_1$ is complementary to $N_{1'}$, and $N_2$ is complementary to $N_{2'}$.

Exemplary sequences for such 4 base spacer tail sequences include, for example, the nucleic acid sequences according to the formulas below:

```
5'-GACTCN₂N₁N₁·NGAGTC-3';                 (SEQ ID NO: 15250)

5'-GACTCN₂N₁N₁·N₂·GAGTCN-3';              (SEQ ID NO: 15251)

5'-N₃GACTCN₂N₁N₁·N₂·GAGTCN₃·-3';          (SEQ ID NO: 15252)

5'-N₃GACTCN₂N₁N₁·N₂·GAGTCN₃·N-3';         (SEQ ID NO: 15253)

5'-N₄N₃GACTCN₂N₁N₁·N₂·GAGTCN₃·N₄·-3';     (SEQ ID NO: 15254)

5'-N₄N₃GACTCN₂N₁N₁·N₂·GAGTCN₃·N₄·N-3';    (SEQ ID NO: 15255)

5'-N₅N₄N₃GACTCN₂N₁N₁·N₂·GAGTCN₃·N₄·N₅·-3';     (SEQ ID NO: 15256)

5'-N₅N₄N₃GACTCN₂N₁N₁·N₂·GAGTCN₃·N₄·N₅·N-3';    (SEQ ID NO: 15257)
and

5'-N₆N₅N₄N₃GACTCN₂N₁N₁·N₂·GAGTCN₃·N₄·N₅·N₆·-3';    (SEQ ID NO: 15258)
``` where "N" is any nucleotide (e.g., having an adenine (A), thymine (T), cytosine (C), or guanine (G) nucleobase), and $N_1$ is complementary to $N_{1'}$, $N_2$ to $N_{2'}$, $N_3$ to $N_{3'}$, $N_4$ to $N_{4'}$, $N_5$ to $N_{5'}$, and $N_6$ to $N_{6'}$, etc.

In some embodiments, 4 base spacer tails exclude those comprising the nucleic acid sequences according to the formulas below:

```
5'-GACTCGATCGAGTC-3';                     (SEQ ID NO: 15282)

5'-GACTCGATCGAGTCN-3';                    (SEQ ID NO: 15283)

5'-N₁GACTCGATCGAGTCN₁·-3';                (SEQ ID NO: 15284)

5'-N₁GACTCGATCGAGTCN₁·N-3';               (SEQ ID NO: 15285)

5'-N₂N₁GACTCGATCGAGTCN₁·N₂·-3';           (SEQ ID NO: 15286)

5'-N₂N₁GACTCGATCGAGTCN₁·N₂·N-3';          (SEQ ID NO: 15287)

5'-TCGACTCN₂N₁N₁·N₂·GAGTCGA-3';           (SEQ ID NO: 15288)

5'-TCGACTCN₂N₁N₁·N₂·GAGTCGAN-3';          (SEQ ID NO: 15289)

5'-N₃N₂N₁GACTCGATCGAGTCN₁·N₂·N₃·-3';      (SEQ ID NO: 15290)

5'-N₃N₂N₁GACTCGATCGAGTCN₁·N₂·N₃·N-3';     (SEQ ID NO: 15291)

5'-N₃TCGACTCN₂N₁N₁·N₂·GAGTCGAN₃·-3';      (SEQ ID NO: 15292)

5'-N₃TCGACTCN₂N₁N₁·N₂·GAGTCGAN₃·N-3';     (SEQ ID NO: 15293)

5'-GTCGACTCN₂N₁N₁·N₂·GAGTCGAC-3';         (SEQ ID NO: 15294)

5'-GTCGACTCN₂N₁N₁·N₂·GAGTCGACN-3';        (SEQ ID NO: 15295)

5'-N₄N₃N₂N₁GACTCGATCGAGTCN₁·N₂·N₃·N4'-3'; (SEQ ID NO: 15296)

5'-N₄N₃TCGACTCN₂N₁N₁·N₂·GAGTCGAN₃·N4'-3'; (SEQ ID NO: 15297)

5'-N₃GTCGACTCN₂N₁N₁·N₂·GAGTCGACN₃·-3';    (SEQ ID NO: 15298)
and

5'-AGTCGACTCN₂N₁N₁·N₂·GAGTCGACT-3',       (SEQ ID NO: 15299)
``` where "N" is any nucleotide (e.g., having an adenine (A), thymine (T), cytosine (C), or guanine (G) nucleobase), and $N_1$ is complementary to $N_{1'}$, $N_2$ to $N_{2'}$, $N_3$ to $N_{3'}$, etc.

An exemplary 5' tail based on the Nt·BstNBI nicking enzyme recognition sequence (5'-GAGTC-3') having a 6 nucleotide spacer comprises a nucleic acid sequence according to the formula below:

(SEQ ID NO: 15259)
5'-GACTCN$_3$N$_2$N$_1$N$_1$'.N$_2$'.N$_3$'.GAGTC-3' where "N" is any nucleotide (e.g., having an adenine (A), thymine (T), cytosine (C), or guanine (G) nucleobase), and N$_1$ is complementary to N$_1$', N$_2$ is complementary to N$_2$', and N$_3$ is complementary to N$_3$'.

Exemplary sequences for such 6 base spacer tail sequences comprise, for example, the nucleic acid sequences according to the formulas below:

(SEQ ID NO: 15259)
5'-GACTCN$_3$N$_2$N$_1$N$_1$'.N$_2$'.N$_3$'.GAGTC-3';

(SEQ ID NO: 15260)
5'-GACTCN$_3$N$_2$N$_1$N$_1$'.N$_2$'.N$_3$'.GAGTCN-3';

(SEQ ID NO: 15261)
5'-GACTCN$_3$N$_2$N$_1$N$_1$'.N$_2$'.N$_3$'.GAGTCNN-3';

(SEQ ID NO: 15262)
5'-GACTCN$_3$N$_2$N$_1$N$_1$'.N$_2$'.N$_3$'.GAGTCNNN-3';

(SEQ ID NO: 15263)
5'-GACTCN$_3$N$_2$N$_1$N$_1$'.N$_2$'.N$_3$'.GAGTCNNNN-3';

(SEQ ID NO: 15264)
5'-N$_4$GACTCN$_3$N$_2$N$_1$N$_1$'.N$_2$'.N$_3$'.GAGTCN$_4$'.-3';

(SEQ ID NO: 15265)
5'-N$_4$GACTCN$_3$N$_2$N$_1$N$_1$'.N$_2$'.N$_3$'.GAGTCN$_4$'.N-3';

(SEQ ID NO: 15266)
5'-N$_4$GACTCN$_3$N$_2$N$_1$N$_1$'.N$_2$'.N$_3$'.GAGTCN$_4$'.NN-3';

(SEQ ID NO: 15267)
5'-N$_4$GACTCN$_3$N$_2$N$_1$N$_1$'.N$_2$'.N$_3$'.GAGTCN$_4$'.NNN-3';

(SEQ ID NO: 15268)
5'-N$_5$N$_4$GACTCN$_3$N$_2$N$_1$N$_1$'.N$_2$'.N$_3$'.GAGTCN$_4$'.N$_5$'.-3';

(SEQ ID NO: 15269)
5'-N$_5$N$_4$GACTCN$_3$N$_2$N$_1$N$_1$'.N$_2$'.N$_3$'.GAGTCN$_4$'.N$_5$'.N-3';

(SEQ ID NO: 15270)
5'-N$_6$N$_5$N$_4$GACTCN$_3$N$_2$N$_1$N$_1$'.N$_2$'.N$_3$'.GAGTCN$_4$'.N$_5$'.N$_6$'.-3';

(SEQ ID NO: 15271)
5'-N$_6$N$_5$N$_4$GACTCN$_3$N$_2$N$_1$N$_1$'.N$_2$'.N$_3$'.GAGTCN$_4$'.N$_5$'.N$_6$'.N-3';
and (SEQ ID NO: 15272)
5'-N$_7$N$_6$N$_5$N$_4$GACTCN$_3$N$_2$N$_1$N$_1$'.N$_2$'.N$_3$'.GAGTCN$_4$'.N$_5$'.N$_6$'.N$_7$'.-3', where "N" is any nucleotide (e.g., having an adenine (A), thymine (T), cytosine (C), or guanine (G) nucleobase), and N$_1$ is complementary to N$_1$', N$_2$ to N$_2$', N$_3$ to N$_3$', N$_4$ to N$_4$', N$_5$ to N$_5$', N$_6$ to N$_6$', and N$_7$ to N$_7$', etc.

In some embodiments, 6 base spacer tails exclude those having the nucleic acid sequences according to the formulas below:

(SEQ ID NO: 15300)
5'-GACTCGAN$_1$N$_1$'.TCGAGTC-3';

(SEQ ID NO: 15301)
5'-GACTCGAN$_1$N$_1$'.TCGAGTCN-3';

(SEQ ID NO: 15302)
5'-N$_2$GACTCGAN$_1$N$_1$'.TCGAGTCN$_2$'.-3';

(SEQ ID NO: 15303)
5'-N$_2$GACTCGAN$_1$N$_1$'.TCGAGTCN$_2$'.N-3';

(SEQ ID NO: 15304)
5'-N$_3$N$_2$GACTCGAN$_1$N$_1$'.TCGAGTCN$_2$'.N$_3$'.-3';

(SEQ ID NO: 15305)
5'-N$_3$N$_2$GACTCGAN$_1$N$_1$'.TCGAGTCN$_2$'.N$_3$'.N-3';

(SEQ ID NO: 15306)
5'-TCGACTCN$_3$N$_2$N$_1$N$_1$'.N$_2$'.N$_3$'.GAGTCGA-3';

(SEQ ID NO: 15307)
5'-TCGACTCN$_3$N$_2$N$_1$N$_1$'.N$_2$'.N$_3$'.GAGTCGAN-3';

(SEQ ID NO: 15308)
5'-N$_4$N$_3$N$_2$GACTCGAN$_1$N$_1$'.TCGAGTCN$_2$'.N$_3$'.N$_4$'.-3';

(SEQ ID NO: 15309)
5'-N$_4$N$_3$N$_2$GACTCGAN$_1$N$_1$'.TCGAGTCN$_2$'.N$_3$'.N$_4$'.N-3';

(SEQ ID NO: 15310)
5'-N$_4$GTCGACTCN$_3$N$_2$N$_1$N$_1$'.N$_2$'.N$_3$'.GAGTCGACN$_4$'.-3';

(SEQ ID NO: 15311)
5'-GTCGACTCN$_3$N$_2$N$_1$N$_1$'.N$_2$'.N$_3$'.GAGTCGAC-3';

(SEQ ID NO: 15312)
5'-GTCGACTCN$_3$N$_2$N$_1$N$_1$'.N$_2$'.N$_3$'.GAGTCGACN-3';

(SEQ ID NO: 15313)
5'-N$_5$N$_4$N$_3$N$_2$GACTCGAN$_1$N$_1$'.TCGAGTCN$_2$'.N$_3$'.N$_4$'.N$_5$'.-3';

(SEQ ID NO: 15314)
5'-N$_5$N$_4$TCGACTCN$_3$N$_2$N$_1$N$_1$'.N$_2$'.N$_3$'.GAGTCGAN$_4$'.N$_5$'.-3';

(SEQ ID NO: 15310)
5'-N$_4$GTCGACTCN$_3$N$_2$N$_1$N$_1$'.N$_2$'.N$_3$'.GAGTCGACN$_4$'.-3';
and (SEQ ID NO: 15315)
5'-AGTCGACTCN$_3$N$_2$N$_1$N$_1$'.N$_2$'.N$_3$'.GAGTCGACT-3', where "N" is any nucleotide (e.g., having an adenine (A), thymine (T), cytosine (C), or guanine (G) nucleobase), and N$_1$ is complementary to N$_1$', N$_2$ to N$_2$', N$_3$ to N$_3$', N$_4$ to N$_4$', N$_5$ to N$_5$', etc.

Exemplary 5' tail region sequences are provided at FIGS. 8A-8B. Exemplary 5' tail region sequences 24 nucleotides in length having a Nt·BstNBI recognition sequence can be generated based on the following template 5'-NNNNGACTCNNNNNNNGAGTCNNNN-3' (SEQ ID NO: 15272) (FIG. 8A). Based on this template, there are 537,824 5' tail sequences having the following properties: ΔG=−48 Kcal/mole to −62 kcal/mole; ΔΔG<−40 kcal/mole; and GC content 68% to 84%. Of these, 1050 selected sequences are provided, representing 0.2% of the entire sequence space (248,832). Exemplary 5' tail region sequences 22 nucleotides in length having a Nt·BstNBI recognition sequence and based on the following template 5'-NNNNGACTCNNNNGAGTCNNNN-3' (SEQ ID NO: 15258) (FIG. 8B). Based on this template, there are 248,832 5' tail sequences having the following properties: ΔG=−47 Kcal/mole to −55 kcal/mole; ΔΔG<−40 kcal/mole; and GC content 72% to 82%. Of these, 200 selected sequences are provided, representing 0.08% of the entire sequence space (248,832).

Nucleic Amplification Methods

Nucleic acid amplification technologies have provided a means of understanding complex biological processes, detection, and identification, of pathogenic and non-pathogenic organisms, forensic criminology analysis, disease association studies, and detection of events in genetically modified organisms, etc. The polymerase chain reaction (PCR) is a common thermal cycling dependent nucleic acid amplification technology used to amplify DNA consisting of cycles of repeated heating and cooling of the reaction for DNA melting and enzymatic replication of the DNA using a DNA polymerase. Real-Time quantitative PCR (qPCR) is a technique used to quantify the number of copies of a given nucleic acid sequence in a biological sample. Currently, qPCR utilizes the detection of reaction products in real-time throughout the reaction and compares the amplification profile to the amplification of controls which contain a known quantity of nucleic acids at the beginning of each reaction (or a known relative ratio of nucleic acids to the unknown tested nucleic acid). The results of the controls are used to construct standard curves, typically based on the logarithmic portion of the standard reaction amplification curves. These values are used to interpolate the quantity of the unknowns based on where their amplification curves compared to the standard control quantities.

In addition to PCR, non-thermal cycling dependent amplification systems or isothermal nucleic acid amplification technologies exist including, without limitation: Nicking Amplification Reaction, Rolling Circle Amplification (RCA), Helicase-Dependent Amplification (HDA), Loop-Mediated Amplification (LAMP), Strand Displacement Amplification (SDA), Transcription-Mediated Amplification (TMA), Self-Sustained Sequence Replication (3SR), Nucleic Acid Sequence Based Amplification (NASBA), Single Primer Isothermal Amplification (SPIA), Q-β Replicase System, and Recombinase Polymerase Amplification (RPA).

Isothermal nicking amplification reactions have similarities to PCR thermocycling. Like PCR, nicking amplification reactions employ oligonucleotide sequences which are complementary to a target sequences referred to as primers. In addition, nicking amplification reactions of target sequences results in a logarithmic increase in the target sequence, just as it does in standard PCR. Unlike standard PCR, the nicking amplification reactions progress isothermally. In standard PCR, the temperature is increased to allow the two strands of DNA to separate. In nicking amplification reactions, the target nucleic acid sequence is nicked at specific nicking sites present in a test sample. The polymerase infiltrates the nick site and begins complementary strand synthesis of the nicked target nucleotide sequence (the added exogenous DNA) along with displacement of the existing complimentary DNA strand. The strand displacement replication process obviates the need for thermal strand separation. At this point, primer molecules anneal to the displaced complementary sequence from the added exogenous DNA. The polymerase now extends from the 3' end of the primer, creating a complementary strand to the previously displaced strand. The second primer oligonucleotide then anneals to the newly synthesized complementary strand and is extended making a duplex of DNA which includes the nicking agent recognition sequence. This strand is then liable to be nicked with subsequent strand displacement extension by the polymerase, which leads to the production of an interim amplicon of duplex of DNA which has nick sites on either side of the original target DNA. Once this interim amplicon is synthesized, the molecule continues to be amplified exponentially through replication of the displaced strands with new primer molecules. In addition, amplification also proceeds linearly from each product molecule through the repeated action of the nick translation synthesis at the template introduced nick sites. The result is a very rapid increase in target signal amplification; much more rapid than as produced by PCR thermocycling, with amplification results in less than ten minutes.

Nicking Agent-Dependent Isothermal Nucleic Acid Amplification Assays

The invention provides for the detection of target nucleic acid molecules amplified in an isothermal nicking amplification assay. Polymerases useful in the methods described herein are capable of catalyzing the incorporation of nucleotides to extend a 3' hydroxyl terminus of an oligonucleotide (e.g., a primer) bound to a target nucleic acid molecule and/or a 3' hydroxyl terminus at a nick site in a double-stranded DNA molecule in conjunction with strand displacement activity. Such polymerases also lack or have substantially reduced 5'-3' exonuclease activity and may include those that are thermophilic. DNA polymerases useful in methods involving primers having 2'-modified nucleotides in the primer region comprising the six 3'-terminal nucleotides include derivatives and variants of the DNA polymerase I isolated from *Bacillus stearothermophilus*, also classified as *Geobacillus stearothermophilus*, and from closely related bacterial strains, isolates and species comprising the genus *Geobacillus*, which lack or have substantially reduced 5'-3' exonuclease activity and have strand-displacement activity. Exemplary polymerases include, but are not limited to the large fragments of Bst DNA polymerase I, Gst DNA polymerase I, Gka DNA polymerase I.

A nicking agent useful in methods described herein is a chemical entity capable of recognizing and binding to a specific structure in double stranded nucleic acid molecules and cleaving a phosphodiester bond between adjoining nucleotides on the top strand with a substantially higher rate than cleaving the phosphodiester bond between adjoining nucleotides on the bottom strand upon binding to its recognized specific structure, thereby creating a free 3'-hydroxyl group on the terminal nucleotide preceding the nick site that can be extended by a 5'-3'-exonuclease deficient strand displacement polymerase. In a preferred embodiment of the methods disclosed herein, the top strand phosphodiester bond cleavage rate of the "nicking agent" approaches 100%, while the cleavage rate of the bottom strand phosphodiester bond approaches 0%. Nicking agents useful in methods described herein, can either be enzymes, i.e. self-regenerating catalysts turning over multiple substrate molecules, or non-regenerating catalysts turning over just a single substrate molecule at an equimolar ratio.

A nicking enzyme binds double-stranded DNA and cleaves one strand of a double-stranded duplex. In the methods of the invention, the nicking enzyme cleaves the top stand (the strand comprising the 5'-3' sequence of the nicking agent recognition site). The nicking enzyme may cleave either upstream or downstream of the binding site or nicking enzyme recognition site. In a particular embodiment of the invention disclosed herein, the nicking enzyme cleaves the top strand only and 3' downstream of the recognition site. In exemplary embodiments, the reaction comprises the use of a nicking enzyme that cleaves or nicks downstream of the binding site such that the product sequence does not contain the nicking site. Using an enzyme that cleaves downstream of the binding site allows the polymerase to more easily extend without having to displace the nicking enzyme. Ideally, the nicking enzyme is functional under the same reaction conditions as the polymerase. Exemplary nicking enzymes include, but are not limited to, N·Bst9I, N·BstSEI, Nb·BbvCI(NEB), Nb·Bpu10I(Fermantas), Nb·BsmI(NEB), Nb·BsrDI(NEB), Nb·BtsI(NEB), Nt·AlwI(NEB), Nt·BbvCI(NEB), Nt·Bpu10I(Fermentas), Nt·BsmAI, Nt·BspD6I, Nt·BspQI(NEB), Nt·BstNBI(NEB), and Nt·CviPII(NEB). Sequences of nicking enzyme recognition sites are provided at Table 1.

TABLE 1

Nicking enzyme recognition sequences

```
N.Bst9I       5'-GAGTCNNNNN↓NN-3'  (SEQ ID NO: 15508)
              |||||||||| ||
              3'-CTCAGNNNNN•NN-5'  (SEQ ID NO: 15509)

N.BstSEI      5'-GAGTNCNNNN↓NN-3'  (SEQ ID NO: 15510)
              |||||||||| ||
              3'-CTCAGNNNNN•NN-5'  (SEQ ID NO: 15509)

Nb.BbvCI      5'-CCTCA•GC-3'
(NEB)         ||||| ||
              3'-GGAGT↑CG-5'

Nb.Bpu10I     5'-CCTNA•GC-3'
(Fermantas)   ||||| ||
              3'-GGANT↑CG-5'

Nb.BsmI       5'-GAATG•CN-3'
(NEB)         ||||| ||
              3'-CTTAC↑GN-5'

Nb.BsrDI      5'-GCAATG•NN-3'
(NEB)         |||||| ||
              3'-CGTTAC↑NN-5'

Nb.BtsI       5'-GCAGTG•NN-3'
(NEB)         |||||| ||
              3'-CGTCAC↑NN-5'

Nt.AlwI       5'-GGATCNNNNN↓N-3'   (SEQ ID NO: 15511)
(NEB)         |||||||||| |
              3'-CCTAGNNNNN•N-5'   (SEQ ID NO: 15512)

Nt.BbvCI      5'-CC↓TCAGC-3'
(NEB)         ||  |||||
              3'-GG•AGTCG-5'

Nt.Bpu10I     5'-CC↓TNAGC-3'
(Fermantas)   ||  |||||
              3'-GG•ANTCG-5'

Nt.BsmAI      5'-GTCTCN↓N-3'
              |||||| |
              3'-CAGAGN•N-5'

Nt.BspD6I     5'-GAGTCNNNN↓N-3'    (SEQ ID NO: 15513)
              |||||||||| |
              3'-CTCAGNNNN•N-5'    (SEQ ID NO: 15514)

Nt.BspQI      5'-GCTCTTCN↓-3'
(NEB)         ||||||||
              3'-CGAGAAGN -5'

Nt.BstNBI     5'-GAGTCNNNN↓N-3'    (SEQ ID NO: 15513)
(NEB)         |||||||||| |
              3'-CTCAGNNNN•N-5'    (SEQ ID NO: 15514)

Nt.CviPII     5'-↓CCD-3'
(NEB)         |||
              3'- GGH-5'
```

Nicking enzymes also include engineered nicking enzymes created by modifying the cleavage activity of restriction endonucleases (NEB expressions July 2006, vol 1.2). when restriction endonucleases bind to their recognition sequences in DNA, two catalytic sites within each enzyme for hydrolyzing each strand drive two independent hydrolytic reactions which proceed in parallel. Altered restriction enzymes can be engineered that hydrolyze only one strand of the duplex, to produce DNA molecules that are "nicked" (3'-hydroxyl, 5'-phosphate), rather than cleaved. Nicking enzymes may also include modified CRISPR/Cas proteins, Transcription activator-like effector nucleases (TALENs), and Zinc-finger nucleases having nickase activity.

A nicking amplification reaction typically comprises nucleotides, such as, for example, dideoxyribonucleoside triphosphates (dNTPs). The reaction may also be carried out in the presence of dNTPs that comprise a detectable moiety including but not limited to a radiolabel (e.g., $^{32}P$, $^{33}P$, $^{125}I$, $^{35}S$) an enzyme (e.g., alkaline phosphatase), a fluorescent label (e.g., fluorescein isothiocyanate (FITC)), biotin, avidin, digoxigenin, antigens, haptens, or fluorochromes. The reaction further comprises certain salts and buffers that provide for the activity of the nicking enzyme and polymerase.

Advantageously, the nicking amplification reaction is carried out under substantially isothermal conditions where the temperature of the reaction is more or less constant during the course of the amplification reaction. Because the temperature does not need to be cycled between an upper temperature and a lower temperature, the nicking amplification reaction can be carried out under conditions where it would be difficult to carry out conventional PCR. Typically, the reaction is carried out at about between 35° C. and 90° C. (e.g., about 35, 37, 42, 55, 60, 65, 70, 75, 80, or 85° C.). Advantageously, it is not essential that the temperature be maintained with a great degree of precision. Some variability in temperature is acceptable.

Sets of primers for amplification reactions are selected having ΔΔG's≤–15, –16, 17, –18, –19, –20, –25, –30 kcal/mole or more. The performance characteristics of amplification reactions may be altered by increasing the concentration of one or more oligonucleotides (e.g., one or more primers and/or probes) and/or their ratios. High concentrations of primers also favor primer-dimer formation. In various embodiments, concentration of a primers is 100, 200, 300, 400, 500, 600, 700, 800, 900, 1000 nM or more. Melt temperature (Tm) and reaction rate modifiers may also be used to lower the melting temperature of the oligonucleotides, such as (but not limited to) ethylene glycol and glycerol. In addition, DNA polymerase reaction rate modifiers (such as dNTP and magnesium concentration) may be used to alter the reaction rate. In particular embodiments, the 5' tail sequences of the forward and reverse primers have the same nucleic acid sequence.

The invention also provides a method of designing a nicking agent-dependent isothermal strand-displacement amplification assay without experimental screening of a multitude of combinations of candidate forward primers and/or candidate reverse primers. A 35 to 70 bp long region within the target sequence is identified having a 12 to 20 bp sequence in the central portion with a Tm≥the assay temperature (e.g., ~55° C.). Adjacent sequences 12 bp to 20 bp long immediately downstream and upstream of the 15 to 20 bp long central region are identified, according to the above criteria. The Tm of the chosen double stranded downstream and upstream adjacent sequences deviate from each other by less than ±3° C. A target-specific pair of forward and reverse primers are created by attaching a 5'-tail region for a stable dimer-forming primer to the 5'-terminus of the 12-20 base upstream adjacent sequence and to the 5'-terminus of the complementary strand of the 12-20 base downstream adjacent sequence. When combining the forward primer, reverse primer, and a probe, the primer driving the synthesis of the strand complementary to the probe is in excess over the other primer at a molar ratio of about 1.1:1 to 10:1. The combined concentration of a primer in the assay is no higher than 1000 nM. The assay design method can also be used to convert a pre-validated PCR assay for an amplicon≤70 bp to an nicking agent-dependent isothermal strand-displacement amplification assay.

Target Nucleic Acid Molecules

Methods and compositions of the invention are useful for the amplification and/or identification of a target nucleic acid molecule in a test sample. The target sequences is amplified from virtually any samples that comprises a target nucleic acid molecule, including but not limited to samples comprising fungi, spores, viruses, or cells (e.g., prokaryotes, eukaryotes). In specific embodiments, compositions and methods of the invention detect *Clavibacter michiganensis* subsp. *michiganensis*, *Clavibacter michiganensis* subsp. *sepedonicus*, *Pseudomonas syringae* pv Tomato, *Xanthomonas campestris* pv *Vesicatoria*, *Alternaria* spp, *Cladosporium* spp, *Fusarium oxysporum*, *Verticilium dahlia*, *Pseudomonas currugata*, *Erwina carotovora*, and *Ralstonia solanacearum*. Exemplary test samples include body fluids (e.g. blood, serum, plasma, amniotic fluid, sputum, urine, cerebrospinal fluid, lymph, tear fluid, feces, or gastric fluid), tissue extracts, culture media (e.g., a liquid in which a cell, such as a pathogen cell, has been grown), environmental samples, agricultural products or other foodstuffs, and their extracts, and DNA identification tags. If desired, the sample is purified prior to inclusion in a nicking amplification reaction using any standard method typically used for isolating a nucleic acid molecule from a biological sample.

In one embodiment, primers amplify a target nucleic acid of a pathogen to detect the presence of a pathogen in a sample. Exemplary pathogens include fungi, bacteria, viruses and yeast. Such pathogens may be detected by identifying a nucleic acid molecule encoding a pathogen protein, such as a toxin, in a test sample. Exemplary toxins include, but are not limited to aflatoxin, cholera toxin, diphtheria toxin, *Salmonella* toxin, Shiga toxin, *Clostridium botulinum* toxin, endotoxin, and mycotoxin. For environmental applications, test samples may include water, liquid extracts of air filters, soil samples, building materials (e.g., drywall, ceiling tiles, wall board, fabrics, wall paper, and floor coverings), environmental swabs, or any other sample. In one embodiment, primer oligonucleotidess amplify a target nucleic acid of a plant used as an internal control in molecular breeding experiments geared towards improving, for example, the plant's resistance to drought, the plant's resistance to herbicides, or to predation by harmful insects.

Target nucleic acid molecules include double-stranded and single-stranded nucleic acid molecules (e.g., DNA, and other nucleobase polymers known in the art capable of hybridizing with a nucleic acid molecule described herein). DNA molecules suitable for detection with a detectable oligonucleotide probe or primer of the invention include, but are not limited to, double stranded DNA (e.g., genomic DNA, plasmid DNA, mitochondrial DNA, viral DNA, and synthetic double stranded DNA). Single-stranded DNA target nucleic acid molecules include, for example, viral DNA, cDNA, and synthetic single-stranded DNA, or other types of DNA known in the art.

In general, a target sequence for detection is between 10 and 100 nucleotides in length (e.g., 10, 15, 20, 25, 30, 35, 40, 45, 50, 60, 70, 80, 90, 100 nucleotides. The GC content of the target nucleic acid molecule is selected to be less than about 45, 50, 55, or 60%. Desirably, the target sequence and nicking enzymes are selected such that the target sequence does not contain nicking sites for any nicking enzymes that will be included in the reaction mix.

Applications

Figure 10:
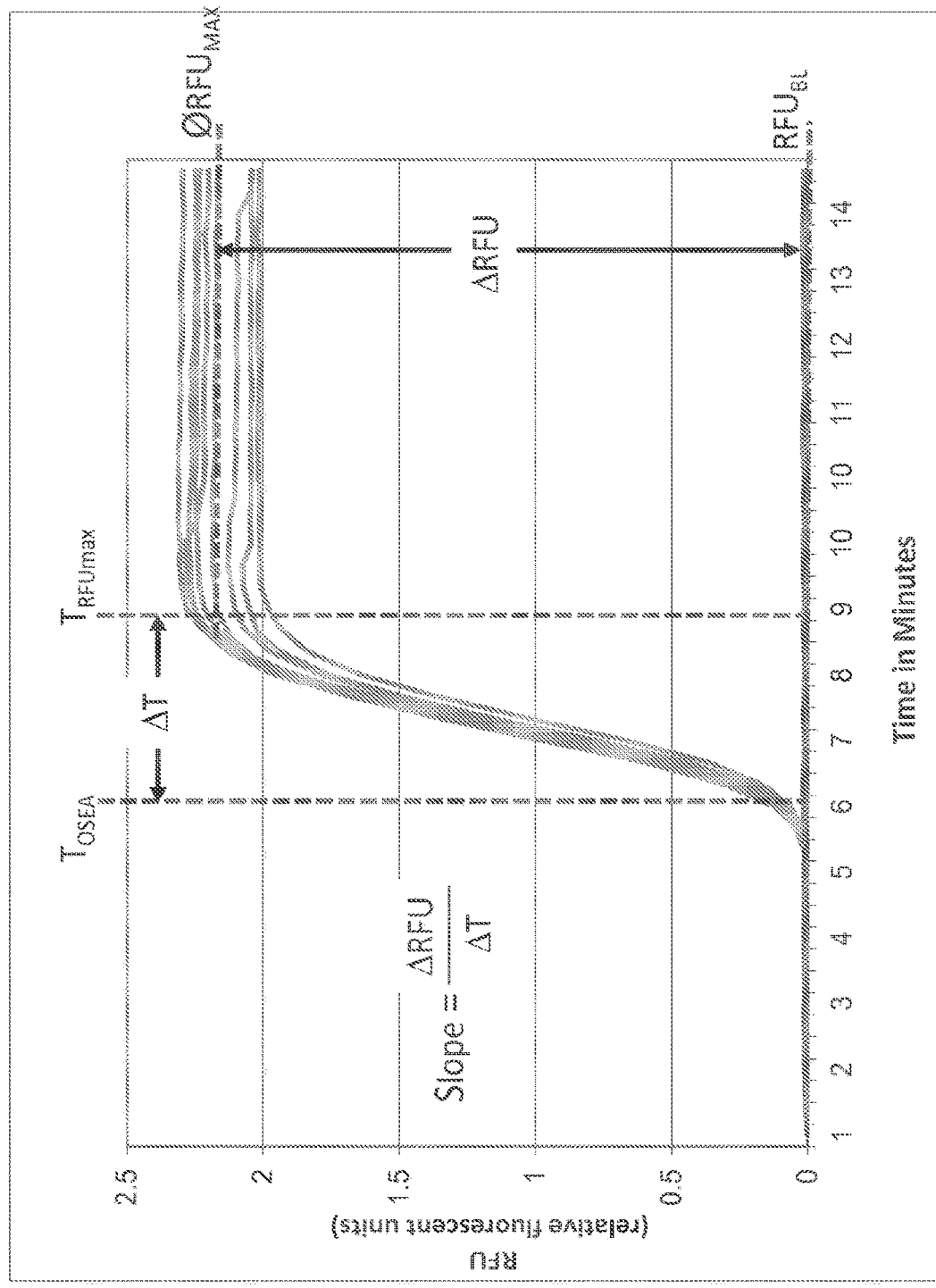
FIG. 10 is a graph showing that nucleic acid amplification using primers of the invention having 5' tail and 3' recognition regions have characteristics useful for rapid detection of target nucleic acids. Such reactions are characterized by a high signal-to-noise ratio ([$RFU_{MAX}$–$RFU_{BL}$]), steep slope (high value of [$RFU_{MAX}$–$RFU_{BL}$]/[$T_{OSEA}$–$T_{RFUmax}$]), early onset of the exponential amplification phase ($T_{OSEA}$<10 min) and low signal variance between replicated assay reactions of the same sample.

Target nucleic acid amplification using primers of the invention have characteristics useful for rapid detection of target nucleic acids (FIG. 10). Such reactions are characterized by a high signal-to-noise ratio ($[RFU_{MAX}-RFU_{BL}]$), steep slope (high value of $[RFU_{MAX}-RFU_{BL}]/[T_{OSEA}-T_{RFUmax}]$), early onset of the exponential amplification phase ($T_{OSEA}<10$ min) and low signal variance between replicated assay reactions of the same sample. In certain embodiments, $T_{OSEA}-T_{RFUmax}\approx3$ min.

The present invention provides for the real-time monitoring of the isothermic amplification reaction. Compositions and methods of the invention are useful in human diagnostics, where rapid detection is desired (e.g., detectable amplification in under 20, 15, 10, 9, 8, 7, 6, 5 min. or less). In particular embodiments, the invention provides for the use of nicking amplification reaction assays in human diagnostics in clinical settings. In other embodiments, the invention provides for the use of nicking amplification reaction assays in diagnostic field work, where access to thermocycling equipment is unavailable or would be prohibitively expensive. In still other embodiments, the invention provides for the use of nicking amplification reaction assays in an academic setting where rapid nucleic acid amplification and detection are desired.

Detectable Oligonucleotide Probes

The present invention provides for the detection of target nucleic acid molecules or amplicons thereof in a nicking amplification reaction using non-amplifiable detectable polynucleotide probes comprising at least one polymerase-arresting molecule (e.g., nucleotide modification or other moiety that renders the oligonucleotide capable of binding a target nucleic acid molecule, but incapable of supporting polymerase extension utilizing the detectable oligonucleotide probe as a target). Without wishing to be bound by theory, the presence of one or more moieties which does not allow polymerase progression likely causes polymerase arrest in non-nucleic acid backbone additions to the oligonucleotide or through stalling of a replicative polymerase (i.e. C3-spacer, damaged DNA bases, other spacer moiety, O-2-Me bases). These constructs thus prevent or reduce illegitimate amplification of the probe during the course of a nicking amplification reaction. This distinguishes them from conventional detection probes, which must be added at the end of the nicking amplification reaction to prevent their amplification.

Conventional detection probes have proven impractical for detecting a nicking amplification reaction in real time. If conventional detection probes are incorporated into the nicking amplification reaction, these conventional detection probes are amplified concurrently with the target. The amplification of these detection molecules masks the detection of legitimate target amplicons due to the number of starting molecules of the detection probe at the start of the reaction.

The invention provides non-amplifiable detectable polynucleotide probe that comprise least one polymerase-arresting molecule. A polymerase-arresting molecule of the invention includes, but is not limited to, a nucleotide modification or other moiety that blocks extension by replicative DNA polymerases, thereby preventing the amplification of detection molecules; but can allow proper hybridization or nucleotide spacing to the target molecule or amplified copies of the target molecule. In one embodiment, a detectable oligonucleotide probe of the invention comprises a 3 carbon spacer (C3-spacer) that prevents or reduces the illegitimate amplification of a detection molecule.

In one embodiment, a detectable oligonucleotide probe comprises one or more modified nucleotide bases having enhanced binding affinity to a complementary nucleotide. Examples of modified bases include, but are not limited to 2' Fluoro amidites, and 2'OMe RNA amidites (also functioning as a polymerase arresting molecule). Detectable oligonucleotide probes of the invention can be synthesized with different colored fluorophores and may be designed to hybridize with virtually any target sequence. In view of their remarkable specificity, a non-amplifiable detectable polynucleotide probe of the invention is used to detect a single target nucleic acid molecule in a sample, or is used in combination with detectable oligonucleotide probes each of which binds a different target nucleic acid molecule. Accordingly, the non-amplifiable detectable polynucleotide probes of the invention may be used to detect one or more target nucleic acid molecules in the same reaction, allowing these targets to be detected simultaneously. The present invention encompasses the use of such fluorophores in conjunction with the detectable oligonucleotide probes described herein.

Use of Non-Amplifiable Detectable Polynucleotide Probes

Non-amplifiable detectable polynucleotide probe are useful in methods for amplifying and detecting a target nucleic acid molecule in a nicking amplification reaction. The method involves contacting a target nucleic acid molecule under substantially isothermal conditions with a polymerase, two primers, each of which specifically binds to a complementary sequence on the target nucleotide molecule, a nicking enzyme, and the detectable oligonucleotide probe in the presence of a suitable buffer and dNTPs, generating amplicons comprising at least a portion of said target nucleic acid molecule; and detecting the target nucleic acid molecule present in the reaction by detecting the oligonucleotide probe that hybridizes to the target nucleic acid molecule in real time during the reaction based on fluorescent intensity from the probe molecules in the reaction. Advantageously, such methods are useful for monitoring nicking amplification reactions in real time.

In general, non-amplifiable detectable polynucleotide probes of the invention are included in a nicking amplification reaction that comprises (1) a target nucleic acid molecule; (2) two primers comprising some number of oligonucleotides that are complementary to the target nucleic acid molecule and a site that can be cleaved by a nicking enzyme; (3) dNTPs; (4) a strand displacing polymerase; and (5) a nicking enzyme. Accordingly, the invention provides a method of using these components to detect a target nucleic acid molecule.

Implementation in Hardware and/or Software

The methods described herein can be implemented on general-purpose or specially programmed hardware or software. For example, the methods can be implemented by a computer readable medium. Accordingly, the present invention also provides a software and/or a computer program product configured to perform the algorithms and/or methods according to any embodiment of the present invention. It is well-known to a skilled person in the art how to configure software which can perform the algorithms and/or methods provided in the present invention. The computer-readable medium can be non-transitory and/or tangible. For example, the computer readable medium can be volatile memory (e.g., random access memory and the like) or non-volatile memory (e.g., read-only memory, hard disks, floppy discs, magnetic tape, optical discs, paper table, punch cards, and the like). The computer executable instructions may be written in a suitable computer language or combination of several languages. Basic computational biology methods are described in, for example Setubal and Meidanis et al., Introduction to Computational Biology Methods (PWS Publishing Company, Boston, 1997); Salzberg, Searles, Kasif, (Ed.), Computational Methods in Molecular Biology, (Elsevier, Amsterdam, 1998); Rashidi and Buehler, Bioinformatics Basics: Application in Biological Science and Medicine (CRC Press, London, 2000) and Ouelette and Bzevanis Bioinformatics: A Practical Guide for Analysis of Gene and Proteins (Wiley & Sons, Inc., $2^{nd}$ ed., 2001).

The present invention may also make use of various computer program products and software for a variety of purposes, such as probe design, management of data, analysis, and instrument operation. (See, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170.) Additionally, the present invention may have preferred embodiments that include methods for providing genetic information over networks such as the Internet as shown in U.S. Ser. Nos. 10/197,621, 10/063,559 (US Pub No 20020183936), Ser. Nos. 10/065,856, 10/065,868, 10/328,818, 10/328,872, 10/423,403, and 60/482,389.

Kits

The invention also provides kits for the amplification of a target nucleic acid molecule. Such kits are useful for the amplification and detection of a target nucleic acid in a biological sample obtained from a subject. Kits of the present invention may comprise, for example, one or more polymerases, forward and reverse primers, and one or more nicking enzymes, as described herein. Where one target is to be amplified, one or two nicking enzymes may be included in the kit. Where multiple target sequences are to be amplified, and the primers designed for those target sequences comprise the nicking enzyme sites for the same nicking enzyme, then one or two nicking enzymes may be included. Where the primers are recognized by different nicking enzymes, more nicking enzymes may be included in the kit, such as, for example, 3 or more.

In one aspect, the invention provides a kit for nucleic acid amplification comprising a DNA polymerase; a primary primer, a secondary primer, a nicking enzyme with specificity to a nicking enzyme binding site within the primers, and deoxynucleotide triphosphates (dNTP's) (e.g., in a buffered solution containing components sufficient for amplification. In various embodiments, the primary primer and secondary primer, each have a 3'-end specific recognition region sequence complementary or substantially complementary to the target sequence, where the end specific recognition region comprises one or more 2' modified nucleotides; a 5'-end tail region containing a nicking enzyme binding site upstream of the 3'-end specific recognition region sequences that is able to dimerize with itself (e.g., self-complementary). In particular embodiments, one or more primers are in a primer-dimer configuration (e.g., produced by heating about Tm and slow cooling).

The kits of the present invention may also comprise one or more of the components in any number of separate containers, packets, tubes (e.g., <0.2 ml, 0.2 ml, 0.6 ml, 1.5 ml, 5.0 ml, >5.0 ml), vials, microtiter plates (e.g., <96-well, 96-well, 384-well, 1536-well, >1536-well), ArrayTape, and the like, or the components may be combined in various combinations in such containers. In various embodiments, the kit further comprises a pair of primers capable of binding to and amplifying a reference sequence. In particular embodiments, the kit comprises one or more primers in a primer-dimer configuration (e.g., produced by heating about Tm and slow cooling). In yet other embodiments, the kit comprises a sterile container which contains the primers;

such containers can be boxes, ampules, bottles, vials, tubes, bags, pouches, blister-packs, or other suitable container form known in the art. Such containers can be made of plastic, glass, laminated paper, metal foil, or other materials suitable for holding nucleic acids.

The components of the kit may, for example, be present in one or more containers, for example, all of the components may be in one container, or, for example, the enzymes may be in a separate container from the primers. The components may, for example, be dried (e.g., powder) or in a stable buffer (e.g., chemically stabilized, thermally stabilized). Dry components may, for example, be prepared by lyophilization, vacuum and centrifugal assisted drying and/or ambient drying. In various embodiments, the polymerase and nicking enzymes are in lyophilized form in a single container, and the primers are either lyophilized, freeze dried, or in buffer, in a different container. In some embodiments, the polymerase, nicking enzymes, and the primers are, in lyophilized form, in a single container. In other embodiments, the polymerase and the nicking enzyme may be separated into different containers.

Kits may further comprise, for example, dNTPs used in the reaction, or modified nucleotides, cuvettes or other containers used for the reaction, or a vial of water or buffer for re-hydrating lyophilized components. The buffer used may, for example, be appropriate for both polymerase and nicking enzyme activity.

The kits of the present invention may also comprise instructions for performing one or more methods described herein and/or a description of one or more compositions or reagents described herein. Instructions and/or descriptions may be in printed form and may be included in a kit insert. A kit also may include a written description of an Internet location that provides such instructions or descriptions.

Kits may further comprise reagents used for detection methods (e.g., real-time or endpoint), such as, for example, hybridization probes or DNA binding dyes. Kits may further comprise reagents used for detection methods, such as, for example, reagents used for FRET, lateral flow devices, dipsticks, fluorescent dye, colloidal gold particles, latex particles, a molecular beacon, or polystyrene beads. Detection components may be incorporated into a lateral flow device. The lateral flow device may be used at a point of care.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

EXAMPLES

Example 1. Design of a System for Isothermal DNA Amplification of Soy Lectin by Determining Stability of Primer Target Binding A successful working isothermal DNA amplification assay for detection of Soy Lectin was created using no more than the design principles in accordance with the invention and without the aid of experimental testing of the primers (FIG. 12).

An assay target sequence in the Soy Lectin gene was selected based on the absence of single nucleotide polymorphisms (SNP's) in a 30 to 60 bp sequence window:

(SEQ ID NO: 15316)
5'-ccaaggttctcattacctatgatgcctccaccagcctcttggttgct tctttggtctaccttcacagagaa-3'

Shown in bold are the sequence regions selected for design of the forward and reverse primers, respectively.

For selecting the target binding sequence of the Forward primer (5'-ATTACCTATGATGCC-3' (SEQ ID NO: 15317)), the stability of Forward primer binding to target was compared to the stability of Forward primer self-dimerization, as follows:

$\Delta G_{25°\,C.}$ of Forward Primer-Target Hybrid (PrTH)=−25.99 kcal/mole;

$\Delta G_{25°\,C.}$ of Primer-Target binding region self dimer (PrTBRHD)=−3.14 kcal/mole;

$\Delta\Delta G_{25°\,C.}=\Delta G_{PTH}-\Delta G_{PTBRHD}$=−22.85 kcal/mole.

A low $\Delta\Delta G$ (≤about −16 kcal/mole) indicates that the Forward primer is capable of annealing to and initiating synthesis of the complementary strand of the target nucleic acid molecule.

For selecting the target binding sequence of the Reverse primer (5'-ACCAAAGAAGCAAC-3' (SEQ ID NO: 15318)), the stability of Reverse primer binding to target was compared to the stability of Reverse primer self-dimerization, as follows:

The stability ($\Delta G$) and relative stability to nearest ($\Delta\Delta G$) of the target binding region of the Reverse primer 5'-ACCAAAGAAGCAAC-3' (SEQ ID NO: 15318) was determined as follows:

$\Delta G_{25°\,C.}$ of rev Primer-Target Hybrid (PrTH)=−25.35 kcal/mole;

$\Delta G_{25°\,C.}$ of Primer-Target binding region self dimer (PrTBRHD)=−3.14 kcal/mole;

$\Delta\Delta G_{25°\,C.}=\Delta G_{PTH}-\Delta G_{PTBRHD}$=−22.21 kcal/mole.

A low $\Delta\Delta G$ (≤about −16 kcal/mole) indicates that the Reverse primer is capable of annealing to and initiating synthesis of the complementary strand of the target nucleic acid molecule.

Nicking amplification reactions (50 μl) contained 0.3 mM dNTPs, 0.38 U/ml Bst 2.0 WarmStart DNA Polymerase (New England Biolabs), 0.15 units Nt·BstNBI (New England Biolabs), 250 nM forward primer, 250 nM reverse primer, 200 nM molecular beacon probe labeled at the 5'-terminus with CalRed (BioSearch) and at the 3'-terminus with BHQ2 (BioSearch), and *Glycine max* genomic DNA (10,000 copies). Primer and probe sequences (synthesized by BioSearch Inc., Novato, Calif.) were as follows:

```
Forward primer ("m" = 2'-methoxy nucleotide)
                                        (SEQ ID NO: 15319)
5'-ACGCGACTCGTCGACGAGTCGCGTATTACCTATGAmUmGmCmC-3'

Reverse primer ("m" = 2'-methoxy nucleotide)
                                        (SEQ DI No: 15320)
5'-ACGCGACTCGTCGACGAGTCGCGTACCAAAGAAmGmCmAmAmC-3'

Molecular beacon probe ("I" stands for universal
inosine nucleotide)
                                        (SEQ ID NO: 15321)
5'-CalRed6io-CGCGCTCCACCAICCTCTTGCGCG-BHQ2-3'
```

Figure 13:
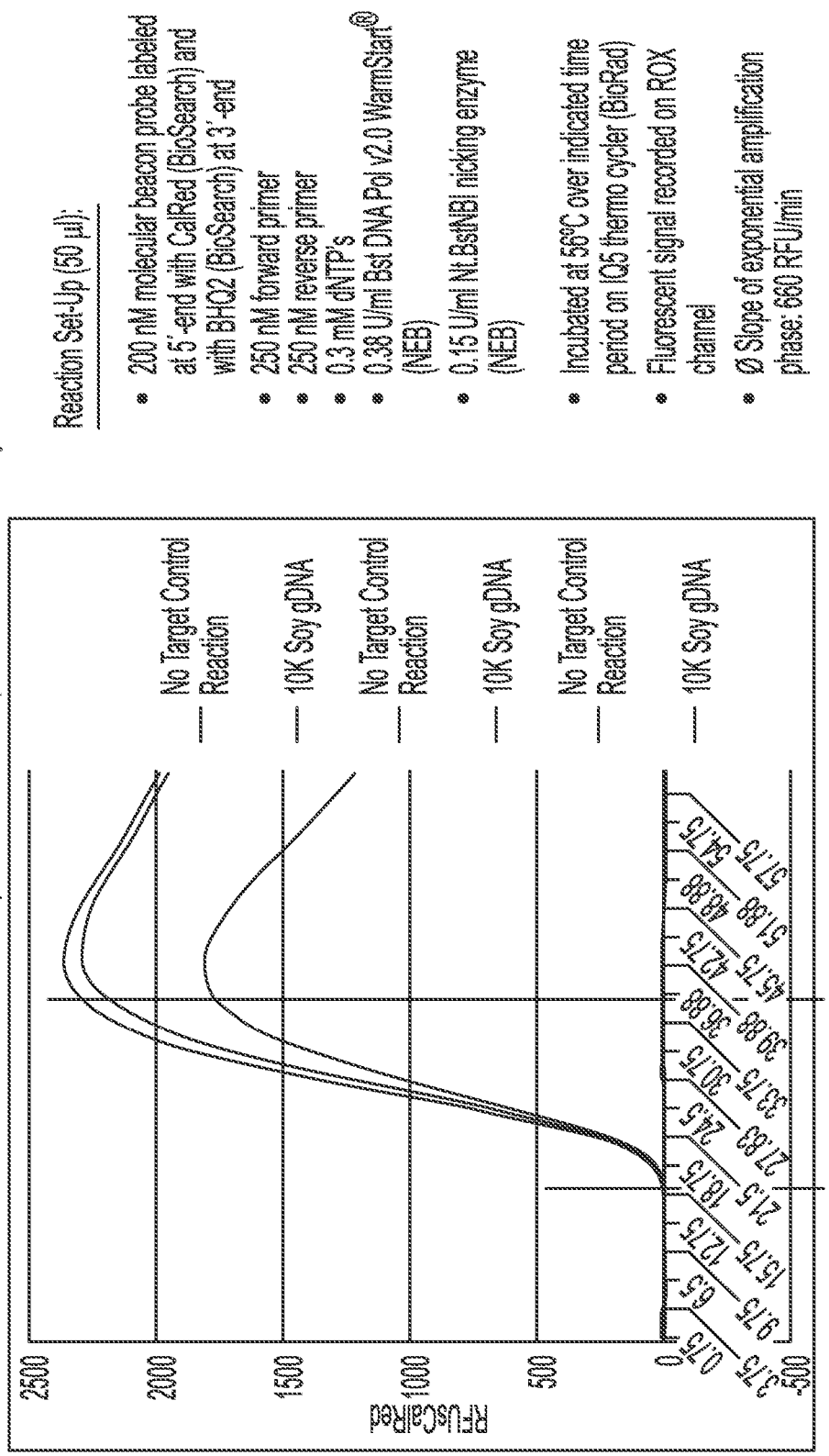
FIG. 13 is a graph depicting results of the first experimental trial of the isothermal DNA amplification assay for Soy Lectin, which empirically confirm assay performance prediction. Target specific amplification was observed in reactions containing soy genomic DNA. No amplification was observed in no target control reactions.

Reactions were incubated at 56° C. for approximately 10 minutes on an IQ5 thermo cycler (BioRad). Fluorescent signal was recorded on ROX channel (excitation: 575 nm; emission: 602 nm). Reactions containing soy gDNA (n=3) generated sigmoid-shaped curves (FIG. 13). In contrast control reactions containing no target DNA (n=3) generated no signal. Time to onset of exponential amplification was about 3 minutes and time to onset of maximum relative fluorescence units was about 6 minutes. The Ø slope of the exponential amplification phase of the reactions was determined to be 660 RFU/min.

Example 2. Design of a System for Isothermal DNA Amplification of *Salmonella enterica* invA by Determining Stability of Primer Target Binding A readily, operational isothermal DNA amplification assay for detection of *Salmonella enterica* invA was created using no more than the design principles in accordance with the invention and without the aid of further experimental testing of the primers.

An assay target sequence in the *Salmonella enterica* invA gene was selected based on the absence of single nucleotide polymorphisms (SNP's) in a 30 to 60 bp sequence window:

```
                                        (SEQ ID NO: 15322)
5'-ATACTCATCTGTTTACCGGGCATACCATCCAGAGAAAA-3'
```

Shown in bold are the sequence regions selected for design of the forward and reverse primers, respectively.

For selecting the target binding sequence of the Forward primers (5'-ATACTCATCTGTTTACC-3' (SEQ ID NO: 15323)), the stability of Forward primer binding to target was compared to the stability of Forward primer self-dimerization, as follows:

- $\Delta G_{25°C.}$ of fwd Primer-Target Hybrid (PTH)=−26.11 kcal/mole;
- $\Delta G_{25°C.}$ of Primer-Target binding region self dimer (PT-BRHD)=−1.95 kcal/mole;
- $\Delta\Delta G_{25°C.} = \Delta G_{PTH} - \Delta G_{PTBRHD} = -24.16$ kcal/mole A low $\Delta\Delta G$ (≤about −16 kcal/mole) indicates that the Forward primers are capable of annealing to and initiating synthesis of the complementary strand of the target nucleic acid molecule.

For selecting the target binding sequence of the Reverse primer (5'-TTTTCTCTGGATGG-3' (SEQ ID NO: 15324)), the stability of Reverse primer binding to target was compared to the stability of Reverse primer self-dimerization, as follows:

- $\Delta G_{25°C.}$ of rev Primer-Target Hybrid (PTH)=−25.28 kcal/mole;
- $\Delta G_{25°C.}$ of Primer-Target binding region self dimer (PT-BRHD)=−1.57 kcal/mole;
- $\Delta\Delta G_{25°C.} = \Delta G_{PTH} - \Delta G_{PTBRHD} = -23.71$ kcal/mole.

A low $\Delta\Delta G$ (≤about −16 kcal/mole) indicates that the Reverse primer is capable of annealing to and initiating synthesis of the complementary strand of the target nucleic acid molecule.

Nucleic Acid Amplification Reactions (25 µl) contained 0.3 mM dNTPs, 0.38 U/ml Bst 2.0 WarmStart DNA Polymerase (New England Biolabs), 0.15 units Nt·BstNBI (New England Biolabs), 200 nM forward primer, 800 nM reverse primer, 300 nM molecular beacon probe labeled at the 5'-terminus with CalRed (BioSearch) and at the 3'-terminus with BHQ2 (BioSearch), and *Salmonella* genomic DNA (10,000 copies). Primer and probe sequences (synthesized by BioSearch Inc., Novato, Calif.) are as follows:

```
Forward primer 1 ("m" = 2'-methoxy nucleotide)
                                        (SEQ ID NO: 15325)
5'-GGCTGACTCCTGCAGGAGTCAGCCATACTCATCTGmUmUmUmAm
CmC-3'

Forward primer 2 ("m" = 2'-methoxy nucleotide)
                                        (SEQ ID NO: 15326)
5'-GGCTGACTCCTGCAGGAGTCAGCCATACTCATCTGTmUmUmAmC
mC-3'

Reverse primer ("m" = 2'-methoxy nucleotide)
                                        (SEQ ID NO: 15327)
5'-GGCTGACTCCTGCAGGAGTCAGCCTTTTCTCTGmGmAmUmGmG-3'

Molecular beacon probe
                                        (SEQ ID NO: 15328)
5'-CalRed₆₁₀-ACCTGTTTACCGGGCATACAAACAGGT-BHQ2-3'
```

Reactions were incubated at 56° C. for approximately 10 minutes on an IQ5 thermo cycler (BioRad). Fluorescent signal was recorded on ROX channel (excitation: 575 nm; emission: 602 nm). Reactions containing soy gDNA (n=3) generated sigmoid-shaped curves (FIG. 15). In contrast control reactions containing no target DNA (n=3) generated no signal. Time to onset of exponential amplification was about 3 minutes and time to onset of maximum relative fluorescence units was about 6 minutes. The Ø slope of the exponential amplification phase of the reactions was determined to be 660 RFU/min.

Figure 16:
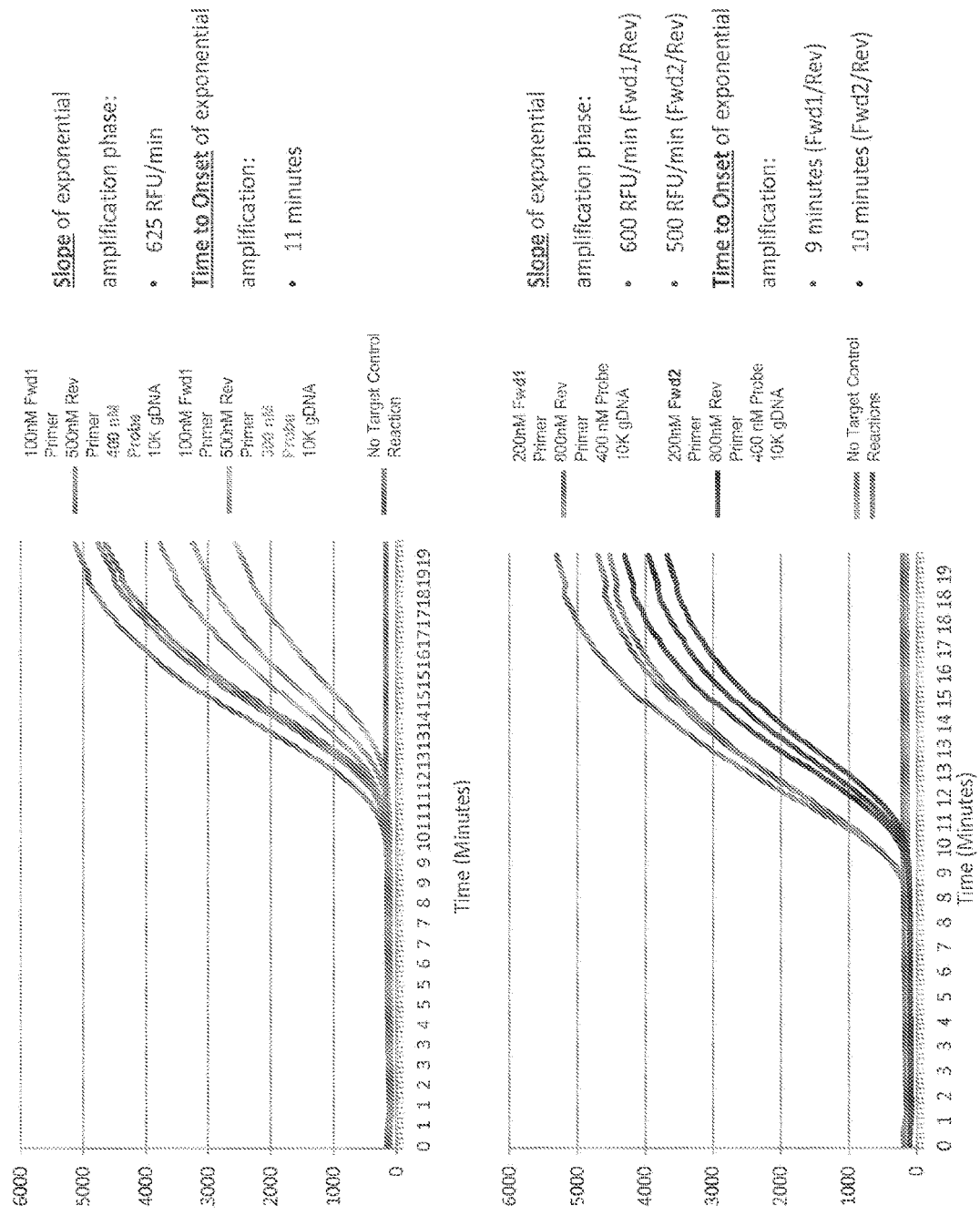
FIG. 16 includes two graphs showing that the isothermal DNA amplification assay for *Salmonella enterica* invA gene is readily optimized.

The results of assay optimization are shown in FIG. 16.

Example 3. Identification of ΔΔG as a Relative Thermodynamic Parameter Correlating with Performance of Candidate Primer/Probe Sets Designed for Isothermal Amplification Assays. Determination of a Threshold Values Predicting Success or Failure of a Primer Oligonucleotide in a Primer/Probe Set Designed in Silico A set of 34 oligonucleotide primers comprising in 5'-3' direction a self-complementary first region (5'-tail with the nicking enzyme recognition sequence) and a target sequence complementary second region were analyzed for a multitude of parameters commonly used in primer design algorithms, such as melting temperature ($T_M$) of the hybrid duplex, % GC content, sequence length and ΔG. All parameters were determined separately for the first and second primer regions, respectively. A subset of 25 primers belonged to verified functional isothermal DNAble® assays. A subset of 9 primers belonged to candidate primer/probe sets that failed to produce a probe-detectable amplification product in assay screening experiments.

A number of two-dimensional matrix plots (FIGS. 17A-17H) were generated using different combinations of design parameters for the X- and Y-axis, respectively, with the intent to identify parameter combinations at which the data points of failing assay primers would cluster separately from the data points of functional assay primers. As demonstrated by the plots at FIGS. 17B-17H, no combination of standard design parameters used in prior art for primer design ($T_M$, $\Delta G$, % GC, sequence length in bases) produced a discernable separation of functional from non-functional primers in a two dimensional plot matrix. The data points of both primer populations widely overlap in these plots, as was expected due to the wide overlapping ranges of standard parameter values among functional and non-functional oligonucleotide primers.

Figure 17B:
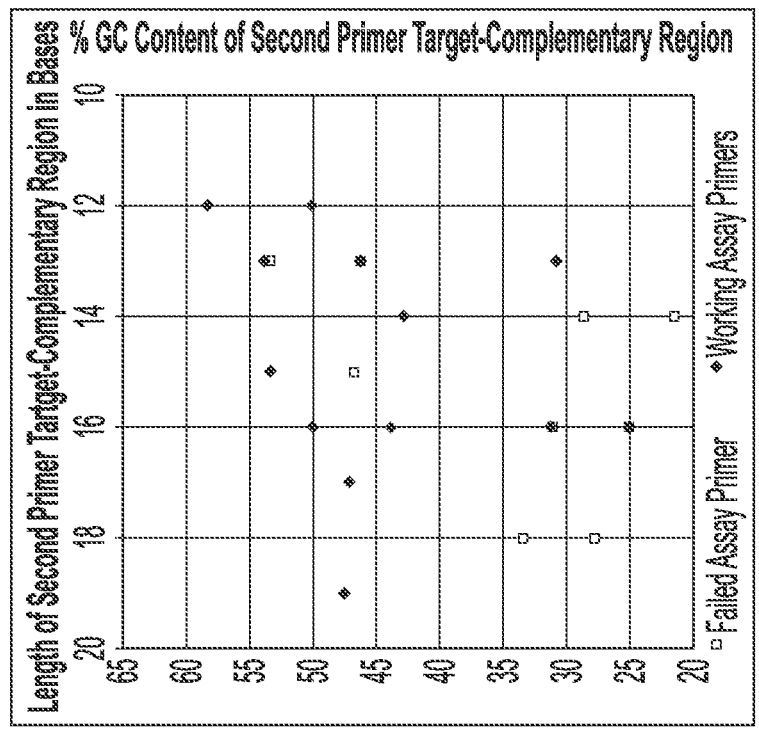
FIGS. 17A-17I shows Primer Structure Parameter ($T_M$, % GC, bp Length, $\Delta G_{25° C.}$, $\Delta\Delta G_{25° C.}$) Cluster Analysis.
Figure 17A:
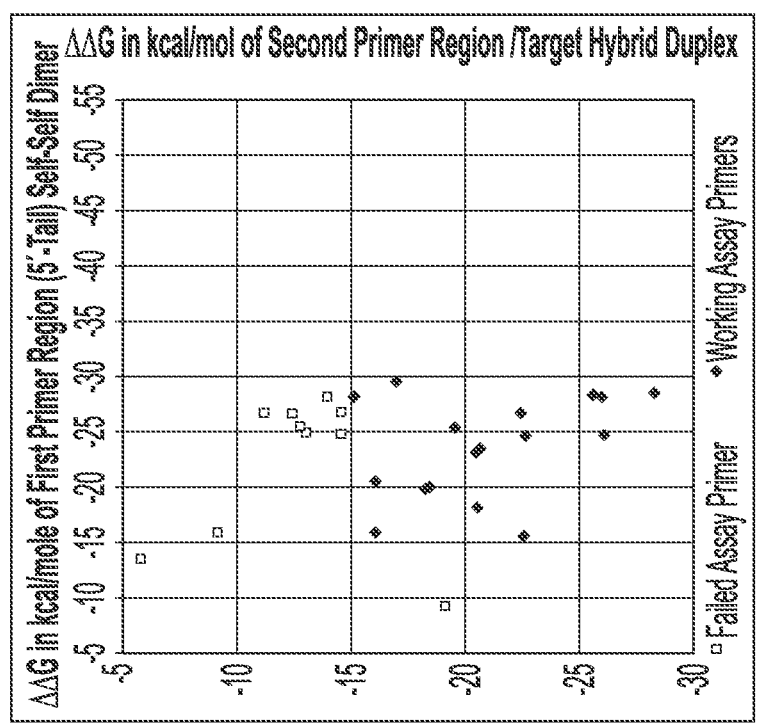
Figure 17D:
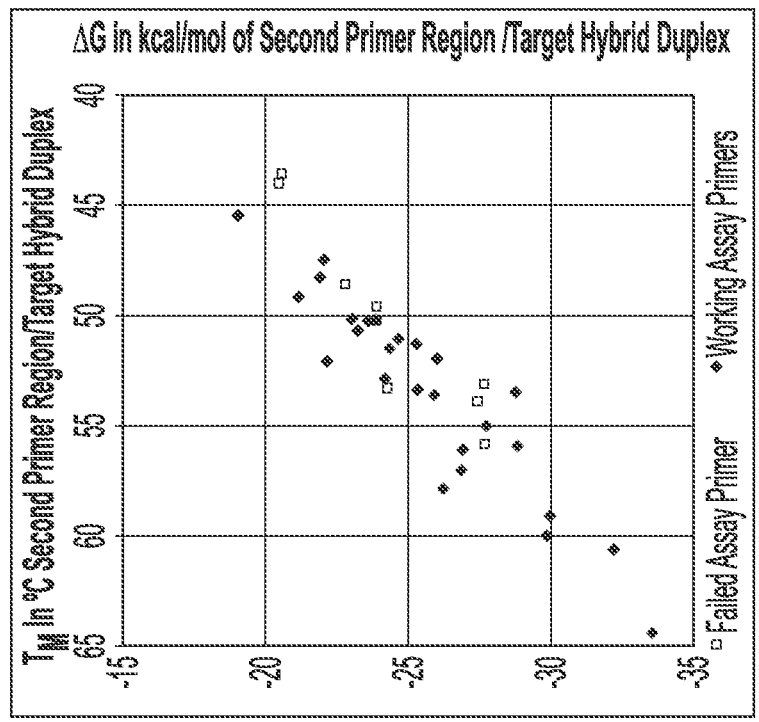
Figure 17C:
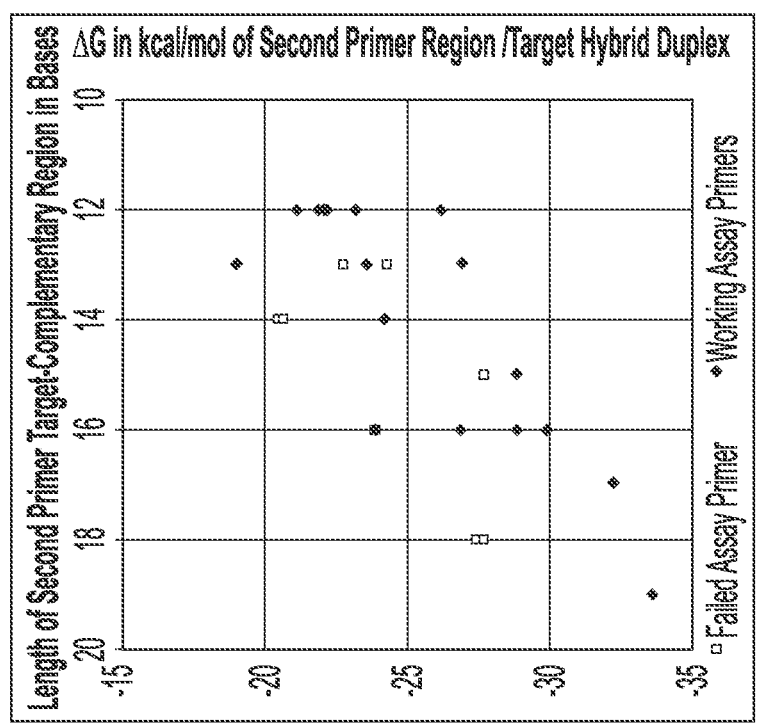
Figure 17F:
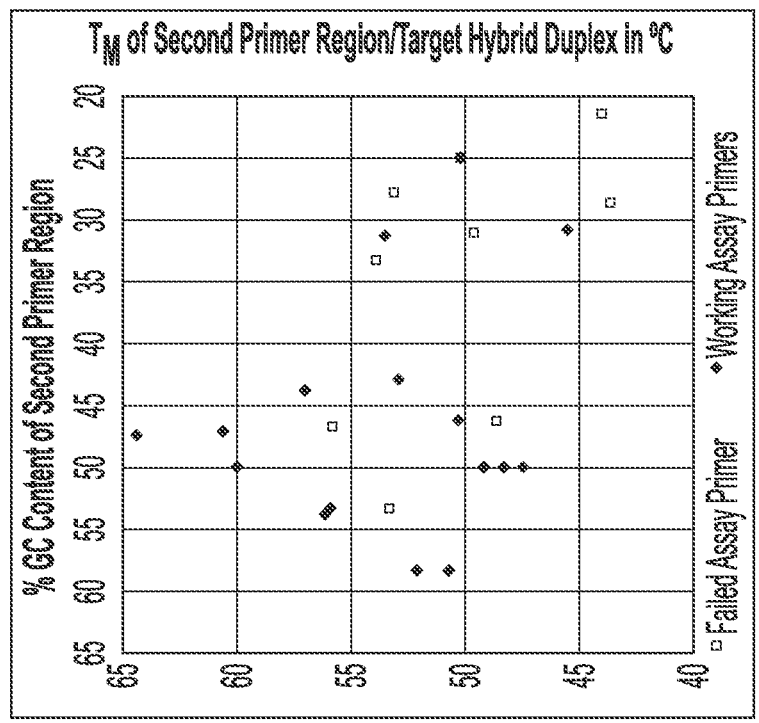
Figure 17E:
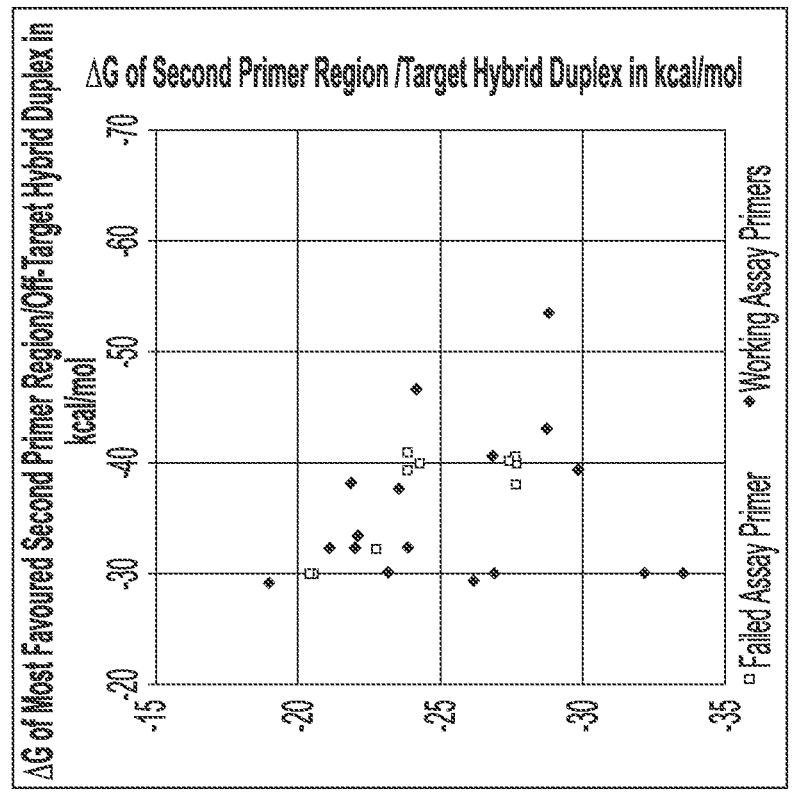
Figure 17H:
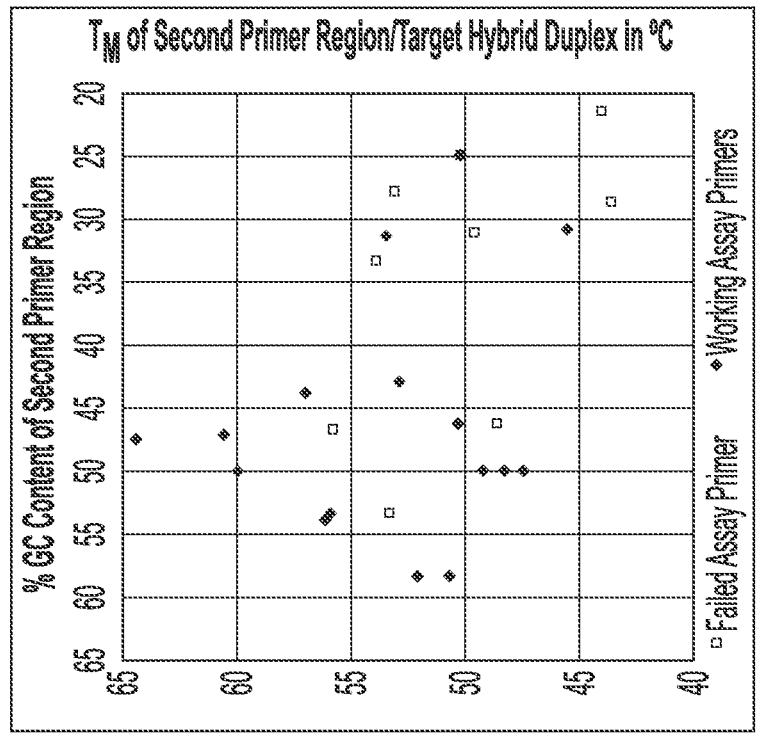
Figure 17G:
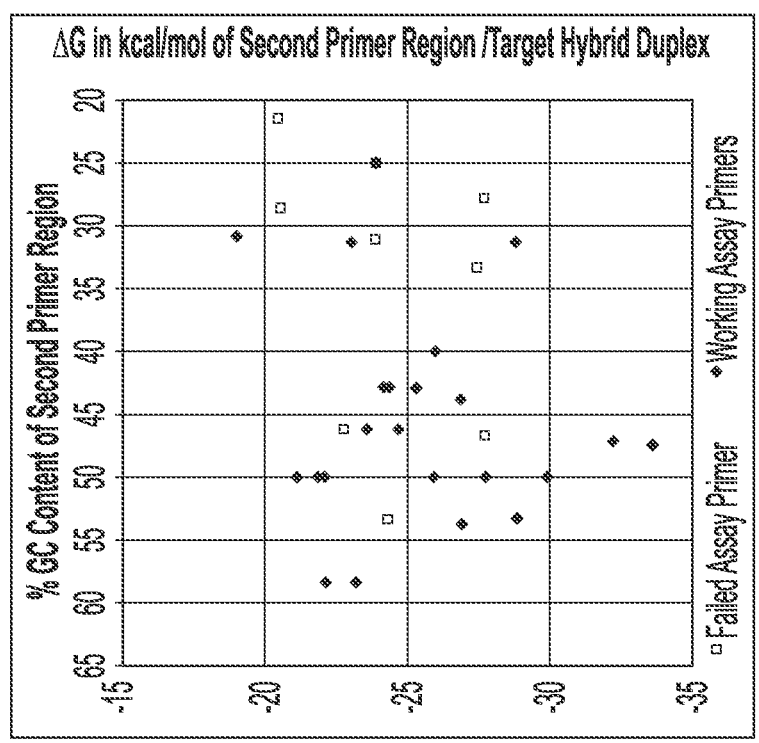
Figure 17I:
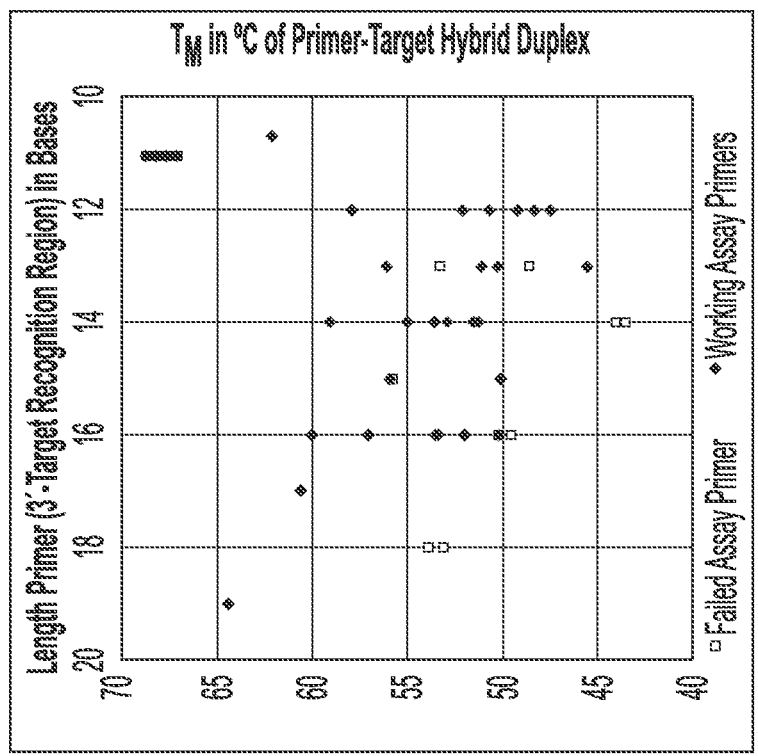

Surprisingly, only the novel relative thermodynamic parameter of $\Delta\Delta G$ as defined by the inventors of this application produced a matrix in which the data points of functional and non-functional primers clustered separately in correlation with the experimental outcome of primer set screening tests. The plot at FIG. 17A shows a matrix in which the X-axis provides the scale for plotting the $\Delta\Delta G$ values of the self-complementary first primer region and the Y-axis provides the scale for plotting the $\Delta\Delta G$ values of the target-complementary second primer region, respectively. All failing assay primers possessed $\Delta\Delta G$ values for either the second region/target duplex (in most cases), or the first region self-complementary duplex (in 1 case) that were less than −15 kcal/mol. Therefore, the $\Delta\Delta G$ value of about −15 kcal/mol turned to be the experimental threshold for this oligonucleotide primer data set that separates functional from non-functional primers.

$\Delta\Delta G$ is a relative parameter that measures the difference, i.e. relative advantage, of thermodynamic favorability of formation of the desired oligonucleotide structure (specific primer/target hybrid and first region self dimer) over the favorability of the formation of a multitude of predicted alternative structures at room temperature and atmospheric pressure in a dynamic equilibrium. Surprisingly, this $\Delta G$ advantage ($\Delta\Delta G$) turned out to be the predictive parameter for assay success when candidate primer oligonucleotides are designed in silico. The use of calculated $\Delta\Delta G$ values as a ranking score and predictor for functional isothermal assays was reduced to praxis in the following examples describing the design and test of isothermal DNAble® assays for the detection of the soy lectin gene and the *Salmonella enterica* invA gene. For the very first time, the screening of candidate primers and probes was performed exclusively in silico using calculated $\Delta\Delta G$ values. In each case, only a single primer/probe set was selected and tested experimentally. Two functional assays were established at first trial without time-consuming and costly screening of a multitude of candidate primer/probe sets.

Other Embodiments

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

This application may be related to International Patent Application No. PCT/US2013/035750, filed Apr. 9, 2013, which claims priority to and benefit of U.S. Provisional Application No. 61/621,975, filed Apr. 9, 2012, the entire contents of which are incorporated herein by reference.

This application may be related to International Patent Application No. PCT/US2011/047049, filed Aug. 9, 2011, which claims priority to and benefit of U.S. Provisional Application No. 61/373,695, filed Aug. 13, 2010, the entire contents of which are incorporated herein by reference.

All patents and publications mentioned in this specification are herein incorporated by reference to the same extent as if each independent patent and publication was specifically and individually indicated to be incorporated by reference.

SEQUENCE LISTING (15570 sequences)

SEQ ID NO: 1 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactccgatcggagtcnnnn

SEQ ID NO: 2 - DNA, 24 bp, synthetic construct
  misc_feature 1..24: note = Description of Artificial Sequence: Syntheticoligonucleotide
  source 1..24: mol_type = other DNA
ggcggactccgatcggagtccgcc

SEQ ID NO: 3 - DNA, 24 bp, synthetic construct
  misc_feature 1..24: note = Description of Artificial Sequence: Syntheticoligonucleotide
  source 1..24: mol_type = other DNA
agcggactccgatcggagtccgct

SEQ ID NO: 4 - DNA, 24 bp, synthetic construct
  misc_feature 1..24: note = Description of Artificial Sequence: Syntheticoligonucleotide
  source 1..24: mol_type = other DNA
gacggactccgatcggagtccgtc

SEQ ID NO: 5 - DNA, 24 bp, synthetic construct
  misc_feature 1..24: note = Description of Artificial Sequence: Syntheticoligonucleotide
  source 1..24: mol_type = other DNA
ggaggactccgatcggagtcctcc

SEQ ID NO: 6 - DNA, 24 bp, synthetic construct
  misc_feature 1..24: note = Description of Artificial Sequence: Syntheticoligonucleotide
  source 1..24: mol_type = other DNA
ggcagactccgatcggagtctgcc

SEQ ID NO: 7 - DNA, 24 bp, synthetic construct
  misc_feature 1..24: note = Description of Artificial Sequence: Syntheticoligonucleotide
  source 1..24: mol_type = other DNA
tgcggactccgatcggagtccgca

SEQ ID NO: 8 - DNA, 24 bp, synthetic construct
  misc_feature 1..24: note = Description of Artificial Sequence: Syntheticoligonucleotide
  source 1..24: mol_type = other DNA
gtcggactccgatcggagtccgac

SEQ ID NO: 9 - DNA, 24 bp, synthetic construct
  misc_feature 1..24: note = Description of Artificial Sequence: Syntheticoligonucleotide
  source 1..24: mol_type = other DNA
ggtggactccgatcggagtccacc

SEQ ID NO: 10 - DNA, 24 bp, synthetic construct
  misc_feature 1..24: note = Description of Artificial Sequence: Syntheticoligonucleotide
  source 1..24: mol_type = other DNA
ggctgactccgatcggagtcagcc

SEQ ID NO: 11 - DNA, 24 bp, synthetic construct
  misc_feature 1..24: note = Description of Artificial Sequence: Syntheticoligonucleotide
  source 1..24: mol_type = other DNA
gcccgactccgatcggagtcgggc

SEQ ID NO: 12 - DNA, 24 bp, synthetic construct
  misc_feature 1..24: note = Description of Artificial Sequence: Syntheticoligonucleotide
  source 1..24: mol_type = other DNA
acccgactccgatcggagtcgggt

SEQ ID NO: 13 - DNA, 24 bp, synthetic construct
  misc_feature 1..24: note = Description of Artificial Sequence: Syntheticoligonucleotide
  source 1..24: mol_type = other DNA
gaccgactccgatcggagtcggtc

SEQ ID NO: 14 - DNA, 24 bp, synthetic construct
  misc_feature 1..24: note = Description of Artificial Sequence: Syntheticoligonucleotide
  source 1..24: mol_type = other DNA
gcacgactccgatcggagtcgtgc

SEQ ID NO: 15 - DNA, 24 bp, synthetic construct
  misc_feature 1..24: note = Description of Artificial Sequence: Syntheticoligonucleotide
  source 1..24: mol_type = other DNA
gccagactccgatcggagtctggc

SEQ ID NO: 16 - DNA, 24 bp, synthetic construct
  misc_feature 1..24: note = Description of Artificial Sequence: Syntheticoligonucleotide
  source 1..24: mol_type = other DNA
tcccgactccgatcggagtcggga

SEQ ID NO: 17 - DNA, 24 bp, synthetic construct
  misc_feature 1..24: note = Description of Artificial Sequence: Syntheticoligonucleotide
  source 1..24: mol_type = other DNA
gtccgactccgatcggagtcggac

SEQ ID NO: 18 - DNA, 24 bp, synthetic construct
  misc_feature 1..24: note = Description of Artificial Sequence: Syntheticoligonucleotide
  source 1..24: mol_type = other DNA
gcctgactccgatcggagtcaggc

SEQ ID NO: 19 - DNA, 24 bp, synthetic construct
  misc_feature 1..24: note = Description of Artificial Sequence: Syntheticoligonucleotide
  source 1..24: mol_type = other DNA
gggcgactccgatcggagtcgccc

SEQ ID NO: 20 - DNA, 24 bp, synthetic construct
  misc_feature 1..24: note = Description of Artificial Sequence: Syntheticoligonucleotide
  source 1..24: mol_type = other DNA
aggcgactccgatcggagtcgcct

SEQ ID NO: 21 - DNA, 24 bp, synthetic construct
  misc_feature 1..24: note = Description of Artificial Sequence: Syntheticoligonucleotide
  source 1..24: mol_type = other DNA
gagcgactccgatcggagtcgctc

SEQ ID NO: 22 - DNA, 24 bp, synthetic construct
  misc_feature 1..24: note = Description of Artificial Sequence: Syntheticoligonucleotide
  source 1..24: mol_type = other DNA
ggacgactccgatcggagtcgtcc

SEQ ID NO: 23 - DNA, 24 bp, synthetic construct
  misc_feature 1..24: note = Description of Artificial Sequence: Syntheticoligonucleotide
  source 1..24: mol_type = other DNA
gggagactccgatcggagtctccc

SEQ ID NO: 24 - DNA, 24 bp, synthetic construct
  misc_feature 1..24: note = Description of Artificial Sequence: Syntheticoligonucleotide
  source 1..24: mol_type = other DNA
tggcgactccgatcggagtcgcca

SEQ ID NO: 25 - DNA, 24 bp, synthetic construct
  misc_feature 1..24: note = Description of Artificial Sequence: Syntheticoligonucleotide
  source 1..24: mol_type = other DNA
gtgcgactccgatcggagtcgcac

SEQ ID NO: 26 - DNA, 24 bp, synthetic construct
  misc_feature 1..24: note = Description of Artificial Sequence: Syntheticoligonucleotide
  source 1..24: mol_type = other DNA
gggtgactccgatcggagtcaccc

SEQ ID NO: 27 - DNA, 24 bp, synthetic construct
  misc_feature 1..24: note = Description of Artificial Sequence: Syntheticoligonucleotide
  source 1..24: mol_type = other DNA
acgggactccgatcggagtcccgt

SEQ ID NO: 28 - DNA, 24 bp, synthetic construct
  misc_feature 1..24: note = Description of Artificial Sequence: Syntheticoligonucleotide
  source 1..24: mol_type = other DNA
cagggactccgatcggagtccctg

SEQ ID NO: 29 - DNA, 24 bp, synthetic construct
  misc_feature 1..24: note = Description of Artificial Sequence: Syntheticoligonucleotide
  source 1..24: mol_type = other DNA
ccaggactccgatcggagtcctgg

SEQ ID NO: 30 - DNA, 24 bp, synthetic construct
  misc_feature 1..24: note = Description of Artificial Sequence: Syntheticoligonucleotide
  source 1..24: mol_type = other DNA
ccgagactccgatcggagtctcgg

SEQ ID NO: 31 - DNA, 24 bp, synthetic construct
  misc_feature 1..24: note = Description of Artificial Sequence: Syntheticoligonucleotide
  source 1..24: mol_type = other DNA
tcgggactccgatcggagtcccga

SEQ ID NO: 32 - DNA, 24 bp, synthetic construct
  misc_feature 1..24: note = Description of Artificial Sequence: Syntheticoligonucleotide
  source 1..24: mol_type = other DNA
ctgggactccgatcggagtcccag

SEQ ID NO: 33 - DNA, 24 bp, synthetic construct
  misc_feature 1..24: note = Description of Artificial Sequence: Syntheticoligonucleotide
  source 1..24: mol_type = other DNA
cctggactccgatcggagtccagg

SEQ ID NO: 34 - DNA, 24 bp, synthetic construct
  misc_feature 1..24: note = Description of Artificial Sequence: Syntheticoligonucleotide
  source 1..24: mol_type = other DNA
ccgtgactccgatcggagtcacgg

SEQ ID NO: 35 - DNA, 24 bp, synthetic construct
  misc_feature 1..24: note = Description of Artificial Sequence: Syntheticoligonucleotide
  source 1..24: mol_type = other DNA
cggcgactccgatcggagtcgccg

SEQ ID NO: 36 - DNA, 24 bp, synthetic construct
  misc_feature 1..24: note = Description of Artificial Sequence: Syntheticoligonucleotide
  source 1..24: mol_type = other DNA
cagcgactccgatcggagtcgctg

SEQ ID NO: 37 - DNA, 24 bp, synthetic construct
  misc_feature 1..24: note = Description of Artificial Sequence: Syntheticoligonucleotide
  source 1..24: mol_type = other DNA
cgacgactccgatcggagtcgtcg

SEQ ID NO: 38 - DNA, 24 bp, synthetic construct
  misc_feature 1..24: note = Description of Artificial Sequence: Syntheticoligonucleotide
  source 1..24: mol_type = other DNA
cggagactccgatcggagtctccg

SEQ ID NO: 39 - DNA, 24 bp, synthetic construct
  misc_feature 1..24: note = Description of Artificial Sequence: Syntheticoligonucleotide
  source 1..24: mol_type = other DNA
ctgcgactccgatcggagtcgcag

SEQ ID NO: 40 - DNA, 24 bp, synthetic construct
  misc_feature 1..24: note = Description of Artificial Sequence: Syntheticoligonucleotide
  source 1..24: mol_type = other DNA
cggtgactccgatcggagtcaccg

SEQ ID NO: 41 - DNA, 24 bp, synthetic construct
  misc_feature 1..24: note = Description of Artificial Sequence: Syntheticoligonucleotide
  source 1..24: mol_type = other DNA
cacggactccgatcggagtccgtg

SEQ ID NO: 42 - DNA, 24 bp, synthetic construct
  misc_feature 1..24: note = Description of Artificial Sequence: Syntheticoligonucleotide
  source 1..24: mol_type = other DNA
cccagactccgatcggagtctggg

SEQ ID NO: 43 - DNA, 24 bp, synthetic construct
  misc_feature 1..24: note = Description of Artificial Sequence: Syntheticoligonucleotide
  source 1..24: mol_type = other DNA
ctcggactccgatcggagtccgag

SEQ ID NO: 44 - DNA, 24 bp, synthetic construct
  misc_feature 1..24: note = Description of Artificial Sequence: Syntheticoligonucleotide
  source 1..24: mol_type = other DNA
ccctgactccgatcggagtcaggg

SEQ ID NO: 45 - DNA, 24 bp, synthetic construct
  misc_feature 1..24: note = Description of Artificial Sequence: Syntheticoligonucleotide
  source 1..24: mol_type = other DNA
ccacgactccgatcggagtcgtgg

SEQ ID NO: 46 - DNA, 24 bp, synthetic construct
  misc_feature 1..24: note = Description of Artificial Sequence: Syntheticoligonucleotide
  source 1..24: mol_type = other DNA
agccgactccgatcggagtcggct

SEQ ID NO: 47 - DNA, 24 bp, synthetic construct
  misc_feature 1..24: note = Description of Artificial Sequence: Syntheticoligonucleotide
  source 1..24: mol_type = other DNA
tgccgactccgatcggagtcggca

SEQ ID NO: 48 - DNA, 24 bp, synthetic construct
  misc_feature 1..24: note = Description of Artificial Sequence: Syntheticoligonucleotide
  source 1..24: mol_type = other DNA
gcgagactccgatcggagtctcgc

SEQ ID NO: 49 - DNA, 24 bp, synthetic construct
  misc_feature 1..24: note = Description of Artificial Sequence: Syntheticoligonucleotide
  source 1..24: mol_type = other DNA
gcgtgactccgatcggagtcacgc

SEQ ID NO: 50 - DNA, 24 bp, synthetic construct
  misc_feature 1..24: note = Description of Artificial Sequence: Syntheticoligonucleotide
  source 1..24: mol_type = other DNA
gcaggactccgatcggagtcctgc

SEQ ID NO: 51 - DNA, 24 bp, synthetic construct
  misc_feature 1..24: note = Description of Artificial Sequence: Syntheticoligonucleotide
  source 1..24: mol_type = other DNA
gctggactccgatcggagtccagc

SEQ ID NO: 52 - DNA, 24 bp, synthetic construct
  misc_feature 1..24: note = Description of Artificial Sequence: Syntheticoligonucleotide
  source 1..24: mol_type = other DNA
cgaggactccgatcggagtcctcg

SEQ ID NO: 53 - DNA, 24 bp, synthetic construct
  misc_feature 1..24: note = Description of Artificial Sequence: Syntheticoligonucleotide
  source 1..24: mol_type = other DNA
cgtggactccgatcggagtccacg

SEQ ID NO: 54 - DNA, 24 bp, synthetic construct
  misc_feature 1..24: note = Description of Artificial Sequence: Syntheticoligonucleotide
  source 1..24: mol_type = other DNA
caccgactccgatcggagtcggtg

SEQ ID NO: 55 - DNA, 24 bp, synthetic construct
  misc_feature 1..24: note = Description of Artificial Sequence: Syntheticoligonucleotide
  source 1..24: mol_type = other DNA
ctccgactccgatcggagtcggag

SEQ ID NO: 56 - DNA, 24 bp, synthetic construct
  misc_feature 1..24: note = Description of Artificial Sequence: Syntheticoligonucleotide
  source 1..24: mol_type = other DNA
gcgggactccgatcggagtcccgc

SEQ ID NO: 57 - DNA, 24 bp, synthetic construct
  misc_feature 1..24: note = Description of Artificial Sequence: Syntheticoligonucleotide
  source 1..24: mol_type = other DNA
gagggactccgatcggagtccctc

SEQ ID NO: 58 - DNA, 24 bp, synthetic construct
  misc_feature 1..24: note = Description of Artificial Sequence: Syntheticoligonucleotide
  source 1..24: mol_type = other DNA
gtgggactccgatcggagtcccac

SEQ ID NO: 59 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactccgtacggagtcnnnn

SEQ ID NO: 60 - DNA, 24 bp, synthetic construct
  misc_feature 1..24: note = Description of Artificial Sequence: Syntheticoligonucleotide
  source 1..24: mol_type = other DNA
ggcggactccgtacggagtccgcc

SEQ ID NO: 61 - DNA, 24 bp, synthetic construct
  misc_feature 1..24: note = Description of Artificial Sequence: Syntheticoligonucleotide
  source 1..24: mol_type = other DNA
agcggactccgtacggagtccgct

SEQ ID NO: 62 - DNA, 24 bp, synthetic construct
  misc_feature 1..24: note = Description of Artificial Sequence: Syntheticoligonucleotide
  source 1..24: mol_type = other DNA
gacggactccgtacggagtccgtc

SEQ ID NO: 63 - DNA, 24 bp, synthetic construct
  misc_feature 1..24: note = Description of Artificial Sequence: Syntheticoligonucleotide
  source 1..24: mol_type = other DNA
ggaggactccgtacggagtcctcc

SEQ ID NO: 64 - DNA, 24 bp, synthetic construct
  misc_feature 1..24: note = Description of Artificial Sequence: Syntheticoligonucleotide
  source 1..24: mol_type = other DNA
ggcagactccgtacggagtctgcc

SEQ ID NO: 65 - DNA, 24 bp, synthetic construct
  misc_feature 1..24: note = Description of Artificial Sequence: Syntheticoligonucleotide
  source 1..24: mol_type = other DNA
tgcggactccgtacggagtccgca

SEQ ID NO: 66 - DNA, 24 bp, synthetic construct
  misc_feature 1..24: note = Description of Artificial Sequence: Syntheticoligonucleotide
  source 1..24: mol_type = other DNA
gtcggactccgtacggagtccgac

SEQ ID NO: 67 - DNA, 24 bp, synthetic construct
  misc_feature 1..24: note = Description of Artificial Sequence: Syntheticoligonucleotide
  source 1..24: mol_type = other DNA
ggtggactccgtacggagtccacc

SEQ ID NO: 68 - DNA, 24 bp, synthetic construct
  misc_feature 1..24: note = Description of Artificial Sequence: Syntheticoligonucleotide
  source 1..24: mol_type = other DNA
ggctgactccgtacggagtcagcc

SEQ ID NO: 69 - DNA, 24 bp, synthetic construct
  misc_feature 1..24: note = Description of Artificial Sequence: Syntheticoligonucleotide
  source 1..24: mol_type = other DNA
gcccgactccgtacggagtcgggc

SEQ ID NO: 70 - DNA, 24 bp, synthetic construct
  misc_feature 1..24: note = Description of Artificial Sequence: Syntheticoligonucleotide
  source 1..24: mol_type = other DNA
acccgactccgtacggagtcgggt

SEQ ID NO: 71 - DNA, 24 bp, synthetic construct
  misc_feature 1..24: note = Description of Artificial Sequence: Syntheticoligonucleotide
  source 1..24: mol_type = other DNA
gaccgactccgtacggagtcggtc

SEQ ID NO: 72 - DNA, 24 bp, synthetic construct
  misc_feature 1..24: note = Description of Artificial Sequence: Syntheticoligonucleotide
  source 1..24: mol_type = other DNA
gcacgactccgtacggagtcgtgc

SEQ ID NO: 73 - DNA, 24 bp, synthetic construct
  misc_feature 1..24: note = Description of Artificial Sequence: Syntheticoligonucleotide
  source 1..24: mol_type = other DNA
gccagactccgtacggagtctggc

SEQ ID NO: 74 - DNA, 24 bp, synthetic construct
  misc_feature 1..24: note = Description of Artificial Sequence: Syntheticoligonucleotide
  source 1..24: mol_type = other DNA
tcccgactccgtacggagtcggga

SEQ ID NO: 75 - DNA, 24 bp, synthetic construct
  misc_feature 1..24: note = Description of Artificial Sequence: Syntheticoligonucleotide
  source 1..24: mol_type = other DNA
gtccgactccgtacggagtcggac

SEQ ID NO: 76 - DNA, 24 bp, synthetic construct
  misc_feature 1..24: note = Description of Artificial Sequence: Syntheticoligonucleotide
  source 1..24: mol_type = other DNA
gcctgactccgtacggagtcaggc

SEQ ID NO: 77 - DNA, 24 bp, synthetic construct
  misc_feature 1..24: note = Description of Artificial Sequence: Syntheticoligonucleotide
  source 1..24: mol_type = other DNA
gggcgactccgtacggagtcgccc

SEQ ID NO: 78 - DNA, 24 bp, synthetic construct
  misc_feature 1..24: note = Description of Artificial Sequence: Syntheticoligonucleotide
  source 1..24: mol_type = other DNA
aggcgactccgtacggagtcgcct

SEQ ID NO: 79 - DNA, 24 bp, synthetic construct
  misc_feature 1..24: note = Description of Artificial Sequence: Syntheticoligonucleotide
  source 1..24: mol_type = other DNA
gagcgactccgtacggagtcgctc

SEQ ID NO: 80 - DNA, 24 bp, synthetic construct
  misc_feature 1..24: note = Description of Artificial Sequence: Syntheticoligonucleotide
  source 1..24: mol_type = other DNA
ggacgactccgtacggagtcgtcc

SEQ ID NO: 81 - DNA, 24 bp, synthetic construct
  misc_feature 1..24: note = Description of Artificial Sequence: Syntheticoligonucleotide
  source 1..24: mol_type = other DNA
gggagactccgtacggagtctccc

SEQ ID NO: 82 - DNA, 24 bp, synthetic construct
  misc_feature 1..24: note = Description of Artificial Sequence: Syntheticoligonucleotide
  source 1..24: mol_type = other DNA
tggcgactccgtacggagtcgcca

SEQ ID NO: 83 - DNA, 24 bp, synthetic construct
  misc_feature 1..24: note = Description of Artificial Sequence: Syntheticoligonucleotide
  source 1..24: mol_type = other DNA
gtgcgactccgtacggagtcgcac

SEQ ID NO: 84 - DNA, 24 bp, synthetic construct
  misc_feature 1..24: note = Description of Artificial Sequence: Syntheticoligonucleotide
  source 1..24: mol_type = other DNA
gggtgactccgtacggagtcaccc

SEQ ID NO: 85 - DNA, 24 bp, synthetic construct
  misc_feature 1..24: note = Description of Artificial Sequence: Syntheticoligonucleotide
  source 1..24: mol_type = other DNA
acgggactccgtacggagtcccgt

SEQ ID NO: 86 - DNA, 24 bp, synthetic construct
  misc_feature 1..24: note = Description of Artificial Sequence: Syntheticoligonucleotide
  source 1..24: mol_type = other DNA
cagggactccgtacggagtccctg

SEQ ID NO: 87 - DNA, 24 bp, synthetic construct
  misc_feature 1..24: note = Description of Artificial Sequence: Syntheticoligonucleotide
  source 1..24: mol_type = other DNA
ccaggactccgtacggagtcctgg

SEQ ID NO: 88 - DNA, 24 bp, synthetic construct
  misc_feature 1..24: note = Description of Artificial Sequence: Syntheticoligonucleotide
  source 1..24: mol_type = other DNA
ccgagactccgtacggagtctcgg

SEQ ID NO: 89 - DNA, 24 bp, synthetic construct
  misc_feature 1..24: note = Description of Artificial Sequence: Syntheticoligonucleotide
  source 1..24: mol_type = other DNA
tcgggactccgtacggagtcccga

SEQ ID NO: 90 - DNA, 24 bp, synthetic construct
  misc_feature 1..24: note = Description of Artificial Sequence: Syntheticoligonucleotide
  source 1..24: mol_type = other DNA
ctgggactccgtacggagtcccag

SEQ ID NO: 91 - DNA, 24 bp, synthetic construct
  misc_feature 1..24: note = Description of Artificial Sequence: Syntheticoligonucleotide
  source 1..24: mol_type = other DNA
cctggactccgtacggagtccagg

SEQ ID NO: 92 - DNA, 24 bp, synthetic construct
  misc_feature 1..24: note = Description of Artificial Sequence: Syntheticoligonucleotide
  source 1..24: mol_type = other DNA
ccgtgactccgtacggagtcacgg

SEQ ID NO: 93 - DNA, 24 bp, synthetic construct
  misc_feature 1..24: note = Description of Artificial Sequence: Syntheticoligonucleotide
  source 1..24: mol_type = other DNA
cggcgactccgtacggagtcgccg

SEQ ID NO: 94 - DNA, 24 bp, synthetic construct
  misc_feature 1..24: note = Description of Artificial Sequence: Syntheticoligonucleotide
  source 1..24: mol_type = other DNA
cagcgactccgtacggagtcgctg

SEQ ID NO: 95 - DNA, 24 bp, synthetic construct
  misc_feature 1..24: note = Description of Artificial Sequence: Syntheticoligonucleotide
  source 1..24: mol_type = other DNA
cgacgactccgtacggagtcgtcg

SEQ ID NO: 96 - DNA, 24 bp, synthetic construct
  misc_feature 1..24: note = Description of Artificial Sequence: Syntheticoligonucleotide
  source 1..24: mol_type = other DNA
cggagactccgtacggagtctccg

SEQ ID NO: 97 - DNA, 24 bp, synthetic construct
  misc_feature 1..24: note = Description of Artificial Sequence: Syntheticoligonucleotide
  source 1..24: mol_type = other DNA
ctgcgactccgtacggagtcgcag

SEQ ID NO: 98 - DNA, 24 bp, synthetic construct
  misc_feature 1..24: note = Description of Artificial Sequence: Syntheticoligonucleotide
  source 1..24: mol_type = other DNA
cggtgactccgtacggagtcaccg

SEQ ID NO: 99 - DNA, 24 bp, synthetic construct
  misc_feature 1..24: note = Description of Artificial Sequence: Syntheticoligonucleotide
  source 1..24: mol_type = other DNA
cacggactccgtacggagtccgtg

SEQ ID NO: 100 - DNA, 24 bp, synthetic construct
  misc_feature 1..24: note = Description of Artificial Sequence: Syntheticoligonucleotide
  source 1..24: mol_type = other DNA
cccagactccgtacggagtctggg

SEQ ID NO: 101 - DNA, 24 bp, synthetic construct
  misc_feature 1..24: note = Description of Artificial Sequence: Syntheticoligonucleotide
  source 1..24: mol_type = other DNA
ctcggactccgtacggagtccgag

SEQ ID NO: 102 - DNA, 24 bp, synthetic construct
  misc_feature 1..24: note = Description of Artificial Sequence: Syntheticoligonucleotide
  source 1..24: mol_type = other DNA
ccctgactccgtacggagtcaggg

SEQ ID NO: 103 - DNA, 24 bp, synthetic construct
  misc_feature 1..24: note = Description of Artificial Sequence: Syntheticoligonucleotide
  source 1..24: mol_type = other DNA
ccacgactccgtacggagtcgtgg

SEQ ID NO: 104 - DNA, 24 bp, synthetic construct
  misc_feature 1..24: note = Description of Artificial Sequence: Syntheticoligonucleotide
  source 1..24: mol_type = other DNA
agccgactccgtacggagtcggct

SEQ ID NO: 105 - DNA, 24 bp, synthetic construct
  misc_feature 1..24: note = Description of Artificial Sequence: Syntheticoligonucleotide
  source 1..24: mol_type = other DNA
tgccgactccgtacggagtcggca

SEQ ID NO: 106 - DNA, 24 bp, synthetic construct
  misc_feature 1..24: note = Description of Artificial Sequence: Syntheticoligonucleotide
  source 1..24: mol_type = other DNA
gcgagactccgtacggagtctcgc

SEQ ID NO: 107 - DNA, 24 bp, synthetic construct
  misc_feature 1..24: note = Description of Artificial Sequence: Syntheticoligonucleotide
  source 1..24: mol_type = other DNA
gcgtgactccgtacggagtcacgc

SEQ ID NO: 108 - DNA, 24 bp, synthetic construct
  misc_feature 1..24: note = Description of Artificial Sequence: Syntheticoligonucleotide
  source 1..24: mol_type = other DNA
gcaggactccgtacggagtcctgc

SEQ ID NO: 109 - DNA, 24 bp, synthetic construct
  misc_feature 1..24: note = Description of Artificial Sequence: Syntheticoligonucleotide
  source 1..24: mol_type = other DNA
gctggactccgtacggagtccagc

SEQ ID NO: 110 - DNA, 24 bp, synthetic construct
  misc_feature 1..24: note = Description of Artificial Sequence: Syntheticoligonucleotide
  source 1..24: mol_type = other DNA
cgaggactccgtacggagtcctcg

SEQ ID NO: 111 - DNA, 24 bp, synthetic construct
  misc_feature 1..24: note = Description of Artificial Sequence: Syntheticoligonucleotide
  source 1..24: mol_type = other DNA
cgtggactccgtacggagtccacg

SEQ ID NO: 112 - DNA, 24 bp, synthetic construct
  misc_feature 1..24: note = Description of Artificial Sequence: Syntheticoligonucleotide
  source 1..24: mol_type = other DNA
caccgactccgtacggagtcggtg

SEQ ID NO: 113 - DNA, 24 bp, synthetic construct
  misc_feature 1..24: note = Description of Artificial Sequence: Syntheticoligonucleotide
  source 1..24: mol_type = other DNA
ctccgactccgtacggagtcggag

SEQ ID NO: 114 - DNA, 24 bp, synthetic construct
  misc_feature 1..24: note = Description of Artificial Sequence: Syntheticoligonucleotide
  source 1..24: mol_type = other DNA
gcgggactccgtacggagtcccgc

SEQ ID NO: 115 - DNA, 24 bp, synthetic construct
  misc_feature 1..24: note = Description of Artificial Sequence: Syntheticoligonucleotide
  source 1..24: mol_type = other DNA
gagggactccgtacggagtccctc

SEQ ID NO: 116 - DNA, 24 bp, synthetic construct
  misc_feature 1..24: note = Description of Artificial Sequence: Syntheticoligonucleotide
  source 1..24: mol_type = other DNA
gtgggactccgtacggagtcccac

SEQ ID NO: 117 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactccggccggagtcnnnn

SEQ ID NO: 118 - DNA, 24 bp, synthetic construct
  misc_feature 1..24: note = Description of Artificial Sequence: Syntheticoligonucleotide
  source 1..24: mol_type = other DNA
ggcggactccggccggagtccgcc

SEQ ID NO: 119 - DNA, 24 bp, synthetic construct
  misc_feature 1..24: note = Description of Artificial Sequence: Syntheticoligonucleotide
  source 1..24: mol_type = other DNA
agcggactccggccggagtccgct

SEQ ID NO: 120 - DNA, 24 bp, synthetic construct
  misc_feature 1..24: note = Description of Artificial Sequence: Syntheticoligonucleotide
  source 1..24: mol_type = other DNA
gacggactccggccggagtccgtc

SEQ ID NO: 121 - DNA, 24 bp, synthetic construct
  misc_feature 1..24: note = Description of Artificial Sequence: Syntheticoligonucleotide
  source 1..24: mol_type = other DNA
ggaggactccggccggagtcctcc

SEQ ID NO: 122 - DNA, 24 bp, synthetic construct
  misc_feature 1..24: note = Description of Artificial Sequence: Syntheticoligonucleotide
  source 1..24: mol_type = other DNA
ggcagactccggccggagtctgcc

SEQ ID NO: 123 - DNA, 24 bp, synthetic construct
  misc_feature 1..24: note = Description of Artificial Sequence: Syntheticoligonucleotide
  source 1..24: mol_type = other DNA
tgcggactccggccggagtccgca

SEQ ID NO: 124 - DNA, 24 bp, synthetic construct
  misc_feature 1..24: note = Description of Artificial Sequence: Syntheticoligonucleotide
  source 1..24: mol_type = other DNA
gtcggactccggccggagtccgac

SEQ ID NO: 125 - DNA, 24 bp, synthetic construct
  misc_feature 1..24: note = Description of Artificial Sequence: Syntheticoligonucleotide
  source 1..24: mol_type = other DNA
ggtggactccggccggagtccacc

SEQ ID NO: 126 - DNA, 24 bp, synthetic construct
  misc_feature 1..24: note = Description of Artificial Sequence: Syntheticoligonucleotide
  source 1..24: mol_type = other DNA
ggctgactccggccggagtcagcc

SEQ ID NO: 127 - DNA, 24 bp, synthetic construct
  misc_feature 1..24: note = Description of Artificial Sequence: Syntheticoligonucleotide
  source 1..24: mol_type = other DNA
gcccgactccggccggagtcgggc

SEQ ID NO: 128 - DNA, 24 bp, synthetic construct
  misc_feature 1..24: note = Description of Artificial Sequence: Syntheticoligonucleotide
  source 1..24: mol_type = other DNA
acccgactccggccggagtcgggt

SEQ ID NO: 129 - DNA, 24 bp, synthetic construct
  misc_feature 1..24: note = Description of Artificial Sequence: Syntheticoligonucleotide
  source 1..24: mol_type = other DNA
gaccgactccggccggagtcggtc

SEQ ID NO: 130 - DNA, 24 bp, synthetic construct
  misc_feature 1..24: note = Description of Artificial Sequence: Syntheticoligonucleotide
  source 1..24: mol_type = other DNA
gcacgactccggccggagtcgtgc

SEQ ID NO: 131 - DNA, 24 bp, synthetic construct
  misc_feature 1..24: note = Description of Artificial Sequence: Syntheticoligonucleotide
  source 1..24: mol_type = other DNA
gccagactccggccggagtctggc

SEQ ID NO: 132 - DNA, 24 bp, synthetic construct
  misc_feature 1..24: note = Description of Artificial Sequence: Syntheticoligonucleotide
  source 1..24: mol_type = other DNA
tcccgactccggccggagtcggga

SEQ ID NO: 133 - DNA, 24 bp, synthetic construct
  misc_feature 1..24: note = Description of Artificial Sequence: Syntheticoligonucleotide
  source 1..24: mol_type = other DNA
gtccgactccggccggagtcggac

SEQ ID NO: 134 - DNA, 24 bp, synthetic construct
  misc_feature 1..24: note = Description of Artificial Sequence: Syntheticoligonucleotide
  source 1..24: mol_type = other DNA
gcctgactccggccggagtcaggc

SEQ ID NO: 135 - DNA, 24 bp, synthetic construct
  misc_feature 1..24: note = Description of Artificial Sequence: Syntheticoligonucleotide
  source 1..24: mol_type = other DNA
gggcgactccggccggagtcgccc

SEQ ID NO: 136 - DNA, 24 bp, synthetic construct
  misc_feature 1..24: note = Description of Artificial Sequence: Syntheticoligonucleotide
  source 1..24: mol_type = other DNA
aggcgactccggccggagtcgcct

SEQ ID NO: 137 - DNA, 24 bp, synthetic construct
  misc_feature 1..24: note = Description of Artificial Sequence: Syntheticoligonucleotide
  source 1..24: mol_type = other DNA
gagcgactccggccggagtcgctc

SEQ ID NO: 138 - DNA, 24 bp, synthetic construct
  misc_feature 1..24: note = Description of Artificial Sequence: Syntheticoligonucleotide
  source 1..24: mol_type = other DNA
ggacgactccggccggagtcgtcc

SEQ ID NO: 139 - DNA, 24 bp, synthetic construct
  misc_feature 1..24: note = Description of Artificial Sequence: Syntheticoligonucleotide
  source 1..24: mol_type = other DNA
gggagactccggccggagtctccc

SEQ ID NO: 140 - DNA, 24 bp, synthetic construct
  misc_feature 1..24: note = Description of Artificial Sequence: Syntheticoligonucleotide
  source 1..24: mol_type = other DNA
tggcgactccggccggagtcgcca

SEQ ID NO: 141 - DNA, 24 bp, synthetic construct
  misc_feature 1..24: note = Description of Artificial Sequence: Syntheticoligonucleotide
  source 1..24: mol_type = other DNA
gtgcgactccggccggagtcgcac

SEQ ID NO: 142 - DNA, 24 bp, synthetic construct
  misc_feature 1..24: note = Description of Artificial Sequence: Syntheticoligonucleotide
  source 1..24: mol_type = other DNA
gggtgactccggccggagtcaccc

SEQ ID NO: 143 - DNA, 24 bp, synthetic construct
  misc_feature 1..24: note = Description of Artificial Sequence: Syntheticoligonucleotide
  source 1..24: mol_type = other DNA
acgggactccggccggagtcccgt

SEQ ID NO: 144 - DNA, 24 bp, synthetic construct
  misc_feature 1..24: note = Description of Artificial Sequence: Syntheticoligonucleotide
  source 1..24: mol_type = other DNA
cagggactccggccggagtccctg

SEQ ID NO: 145 - DNA, 24 bp, synthetic construct
  misc_feature 1..24: note = Description of Artificial Sequence: Syntheticoligonucleotide
  source 1..24: mol_type = other DNA
ccaggactccggccggagtcctgg

SEQ ID NO: 146 - DNA, 24 bp, synthetic construct
  misc_feature 1..24: note = Description of Artificial Sequence: Syntheticoligonucleotide
  source 1..24: mol_type = other DNA
ccgagactccggccggagtctcgg

SEQ ID NO: 147 - DNA, 24 bp, synthetic construct
  misc_feature 1..24: note = Description of Artificial Sequence: Syntheticoligonucleotide
  source 1..24: mol_type = other DNA
tcgggactccggccggagtcccga

SEQ ID NO: 148 - DNA, 24 bp, synthetic construct
  misc_feature 1..24: note = Description of Artificial Sequence: Syntheticoligonucleotide
  source 1..24: mol_type = other DNA
ctgggactccggccggagtcccag

SEQ ID NO: 149 - DNA, 24 bp, synthetic construct
  misc_feature 1..24: note = Description of Artificial Sequence: Syntheticoligonucleotide
  source 1..24: mol_type = other DNA
cctggactccggccggagtccagg

SEQ ID NO: 150 - DNA, 24 bp, synthetic construct
  misc_feature 1..24: note = Description of Artificial Sequence: Syntheticoligonucleotide
  source 1..24: mol_type = other DNA
ccgtgactccggccggagtcacgg

SEQ ID NO: 151 - DNA, 24 bp, synthetic construct
  misc_feature 1..24: note = Description of Artificial Sequence: Syntheticoligonucleotide
  source 1..24: mol_type = other DNA
cggcgactccggccggagtcgccg

SEQ ID NO: 152 - DNA, 24 bp, synthetic construct
  misc_feature 1..24: note = Description of Artificial Sequence: Syntheticoligonucleotide
  source 1..24: mol_type = other DNA
cagcgactccggccggagtcgctg

SEQ ID NO: 153 - DNA, 24 bp, synthetic construct
  misc_feature 1..24: note = Description of Artificial Sequence: Syntheticoligonucleotide
  source 1..24: mol_type = other DNA
cgacgactccggccggagtcgtcg

SEQ ID NO: 154 - DNA, 24 bp, synthetic construct
  misc_feature 1..24: note = Description of Artificial Sequence: Syntheticoligonucleotide
  source 1..24: mol_type = other DNA
cggagactccggccggagtctccg

SEQ ID NO: 155 - DNA, 24 bp, synthetic construct
  misc_feature 1..24: note = Description of Artificial Sequence: Syntheticoligonucleotide
  source 1..24: mol_type = other DNA
ctgcgactccggccggagtcgcag

SEQ ID NO: 156 - DNA, 24 bp, synthetic construct
  misc_feature 1..24: note = Description of Artificial Sequence: Syntheticoligonucleotide
  source 1..24: mol_type = other DNA
cggtgactccggccggagtcaccg

SEQ ID NO: 157 - DNA, 24 bp, synthetic construct
  misc_feature 1..24: note = Description of Artificial Sequence: Syntheticoligonucleotide
  source 1..24: mol_type = other DNA
cacggactccggccggagtccgtg

SEQ ID NO: 158 - DNA, 24 bp, synthetic construct
  misc_feature 1..24: note = Description of Artificial Sequence: Syntheticoligonucleotide
  source 1..24: mol_type = other DNA
cccagactccggccggagtctggg

SEQ ID NO: 159 - DNA, 24 bp, synthetic construct
  misc_feature 1..24: note = Description of Artificial Sequence: Syntheticoligonucleotide
  source 1..24: mol_type = other DNA
ctcggactccggccggagtccgag

SEQ ID NO: 160 - DNA, 24 bp, synthetic construct
  misc_feature 1..24: note = Description of Artificial Sequence: Syntheticoligonucleotide
  source 1..24: mol_type = other DNA
ccctgactccggccggagtcaggg

SEQ ID NO: 161 - DNA, 24 bp, synthetic construct
  misc_feature 1..24: note = Description of Artificial Sequence: Syntheticoligonucleotide
  source 1..24: mol_type = other DNA
ccacgactccggccggagtcgtgg

SEQ ID NO: 162 - DNA, 24 bp, synthetic construct
  misc_feature 1..24: note = Description of Artificial Sequence: Syntheticoligonucleotide
  source 1..24: mol_type = other DNA
agccgactccggccggagtcggct

SEQ ID NO: 163 - DNA, 24 bp, synthetic construct
  misc_feature 1..24: note = Description of Artificial Sequence: Syntheticoligonucleotide
  source 1..24: mol_type = other DNA
tgccgactccggccggagtcggca

SEQ ID NO: 164 - DNA, 24 bp, synthetic construct
  misc_feature 1..24: note = Description of Artificial Sequence: Syntheticoligonucleotide
  source 1..24: mol_type = other DNA
gcgagactccggccggagtctcgc

SEQ ID NO: 165 - DNA, 24 bp, synthetic construct
  misc_feature 1..24: note = Description of Artificial Sequence: Syntheticoligonucleotide
  source 1..24: mol_type = other DNA
gcgtgactccggccggagtcacgc

SEQ ID NO: 166 - DNA, 24 bp, synthetic construct
  misc_feature 1..24: note = Description of Artificial Sequence: Syntheticoligonucleotide
  source 1..24: mol_type = other DNA
gcaggactccggccggagtcctgc

SEQ ID NO: 167 - DNA, 24 bp, synthetic construct
  misc_feature 1..24: note = Description of Artificial Sequence: Syntheticoligonucleotide
  source 1..24: mol_type = other DNA
gctggactccggccggagtccagc

SEQ ID NO: 168 - DNA, 24 bp, synthetic construct
  misc_feature 1..24: note = Description of Artificial Sequence: Syntheticoligonucleotide
  source 1..24: mol_type = other DNA
cgaggactccggccggagtcctcg

SEQ ID NO: 169 - DNA, 24 bp, synthetic construct
  misc_feature 1..24: note = Description of Artificial Sequence: Syntheticoligonucleotide
  source 1..24: mol_type = other DNA
cgtggactccggccggagtccacg

SEQ ID NO: 170 - DNA, 24 bp, synthetic construct
  misc_feature 1..24: note = Description of Artificial Sequence: Syntheticoligonucleotide
  source 1..24: mol_type = other DNA
caccgactccggccggagtcggtg

SEQ ID NO: 171 - DNA, 24 bp, synthetic construct
  misc_feature 1..24: note = Description of Artificial Sequence: Syntheticoligonucleotide
  source 1..24: mol_type = other DNA
ctccgactccggccggagtcggag

SEQ ID NO: 172 - DNA, 24 bp, synthetic construct
  misc_feature 1..24: note = Description of Artificial Sequence: Syntheticoligonucleotide
  source 1..24: mol_type = other DNA
gcgggactccggccggagtcccgc

SEQ ID NO: 173 - DNA, 24 bp, synthetic construct
  misc_feature 1..24: note = Description of Artificial Sequence: Syntheticoligonucleotide
  source 1..24: mol_type = other DNA
gagggactccggccggagtccctc

SEQ ID NO: 174 - DNA, 24 bp, synthetic construct
  misc_feature 1..24: note = Description of Artificial Sequence: Syntheticoligonucleotide
  source 1..24: mol_type = other DNA
gtgggactccggccggagtcccac

SEQ ID NO: 175 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactccgcgcggagtcnnnn

SEQ ID NO: 176 - DNA, 24 bp, synthetic construct
  misc_feature 1..24: note = Description of Artificial Sequence: Syntheticoligonucleotide
  source 1..24: mol_type = other DNA
ggcggactccgcgcggagtccgcc

SEQ ID NO: 177 - DNA, 24 bp, synthetic construct
  misc_feature 1..24: note = Description of Artificial Sequence: Syntheticoligonucleotide
  source 1..24: mol_type = other DNA
agcggactccgcgcggagtccgct

SEQ ID NO: 178 - DNA, 24 bp, synthetic construct
  misc_feature 1..24: note = Description of Artificial Sequence: Syntheticoligonucleotide
  source 1..24: mol_type = other DNA
gacggactccgcgcggagtccgtc

SEQ ID NO: 179 - DNA, 24 bp, synthetic construct
  misc_feature 1..24: note = Description of Artificial Sequence: Syntheticoligonucleotide
  source 1..24: mol_type = other DNA
ggaggactccgcgcggagtcctcc

SEQ ID NO: 180 - DNA, 24 bp, synthetic construct
  misc_feature 1..24: note = Description of Artificial Sequence: Syntheticoligonucleotide
  source 1..24: mol_type = other DNA
ggcagactccgcgcggagtctgcc

SEQ ID NO: 181 - DNA, 24 bp, synthetic construct
  misc_feature 1..24: note = Description of Artificial Sequence: Syntheticoligonucleotide
  source 1..24: mol_type = other DNA
tgcggactccgcgcggagtccgca

SEQ ID NO: 182 - DNA, 24 bp, synthetic construct
  misc_feature 1..24: note = Description of Artificial Sequence: Syntheticoligonucleotide
  source 1..24: mol_type = other DNA
gtcggactccgcgcggagtccgac

SEQ ID NO: 183 - DNA, 24 bp, synthetic construct
  misc_feature 1..24: note = Description of Artificial Sequence: Syntheticoligonucleotide
  source 1..24: mol_type = other DNA
ggtggactccgcgcggagtccacc

SEQ ID NO: 184 - DNA, 24 bp, synthetic construct
  misc_feature 1..24: note = Description of Artificial Sequence: Syntheticoligonucleotide
  source 1..24: mol_type = other DNA
ggctgactccgcgcggagtcagcc

SEQ ID NO: 185 - DNA, 24 bp, synthetic construct
  misc_feature 1..24: note = Description of Artificial Sequence: Syntheticoligonucleotide
  source 1..24: mol_type = other DNA
gcccgactccgcgcggagtcgggc

SEQ ID NO: 186 - DNA, 24 bp, synthetic construct
  misc_feature 1..24: note = Description of Artificial Sequence: Syntheticoligonucleotide
  source 1..24: mol_type = other DNA
acccgactccgcgcggagtcgggt

SEQ ID NO: 187 - DNA, 24 bp, synthetic construct
  misc_feature 1..24: note = Description of Artificial Sequence: Syntheticoligonucleotide
  source 1..24: mol_type = other DNA
gaccgactccgcgcggagtcggtc

SEQ ID NO: 188 - DNA, 24 bp, synthetic construct
  misc_feature 1..24: note = Description of Artificial Sequence: Syntheticoligonucleotide
  source 1..24: mol_type = other DNA
gcacgactccgcgcggagtcgtgc

SEQ ID NO: 189 - DNA, 24 bp, synthetic construct
  misc_feature 1..24: note = Description of Artificial Sequence: Syntheticoligonucleotide
  source 1..24: mol_type = other DNA
gccagactccgcgcggagtctggc

SEQ ID NO: 190 - DNA, 24 bp, synthetic construct
  misc_feature 1..24: note = Description of Artificial Sequence: Syntheticoligonucleotide
  source 1..24: mol_type = other DNA
tcccgactccgcgcggagtcggga

SEQ ID NO: 191 - DNA, 24 bp, synthetic construct
  misc_feature 1..24: note = Description of Artificial Sequence: Syntheticoligonucleotide
  source 1..24: mol_type = other DNA
gtccgactccgcgcggagtcggac

SEQ ID NO: 192 - DNA, 24 bp, synthetic construct
  misc_feature 1..24: note = Description of Artificial Sequence: Syntheticoligonucleotide
  source 1..24: mol_type = other DNA
gcctgactccgcgcggagtcaggc

SEQ ID NO: 193 - DNA, 24 bp, synthetic construct
  misc_feature 1..24: note = Description of Artificial Sequence: Syntheticoligonucleotide
  source 1..24: mol_type = other DNA
gggcgactccgcgcggagtcgccc

SEQ ID NO: 194 - DNA, 24 bp, synthetic construct
  misc_feature 1..24: note = Description of Artificial Sequence: Syntheticoligonucleotide
  source 1..24: mol_type = other DNA
aggcgactccgcgcggagtcgcct

SEQ ID NO: 195 - DNA, 24 bp, synthetic construct
  misc_feature 1..24: note = Description of Artificial Sequence: Syntheticoligonucleotide
  source 1..24: mol_type = other DNA
gagcgactccgcgcggagtcgctc

SEQ ID NO: 196 - DNA, 24 bp, synthetic construct
  misc_feature 1..24: note = Description of Artificial Sequence: Syntheticoligonucleotide
  source 1..24: mol_type = other DNA
ggacgactccgcgcggagtcgtcc

SEQ ID NO: 197 - DNA, 24 bp, synthetic construct
  misc_feature 1..24: note = Description of Artificial Sequence: Syntheticoligonucleotide
  source 1..24: mol_type = other DNA
gggagactccgcgcggagtctccc

SEQ ID NO: 198 - DNA, 24 bp, synthetic construct
  misc_feature 1..24: note = Description of Artificial Sequence: Syntheticoligonucleotide
  source 1..24: mol_type = other DNA
tggcgactccgcgcggagtcgcca

SEQ ID NO: 199 - DNA, 24 bp, synthetic construct
  misc_feature 1..24: note = Description of Artificial Sequence: Syntheticoligonucleotide
  source 1..24: mol_type = other DNA
gtgcgactccgcgcggagtcgcac

SEQ ID NO: 200 - DNA, 24 bp, synthetic construct
  misc_feature 1..24: note = Description of Artificial Sequence: Syntheticoligonucleotide
  source 1..24: mol_type = other DNA
gggtgactccgcgcggagtcaccc

SEQ ID NO: 201 - DNA, 24 bp, synthetic construct
  misc_feature 1..24: note = Description of Artificial Sequence: Syntheticoligonucleotide
  source 1..24: mol_type = other DNA
acgggactccgcgcggagtcccgt

SEQ ID NO: 202 - DNA, 24 bp, synthetic construct
  misc_feature 1..24: note = Description of Artificial Sequence: Syntheticoligonucleotide
  source 1..24: mol_type = other DNA
cagggactccgcgcggagtccctg

SEQ ID NO: 203 - DNA, 24 bp, synthetic construct
  misc_feature 1..24: note = Description of Artificial Sequence: Syntheticoligonucleotide
  source 1..24: mol_type = other DNA
ccaggactccgcgcggagtcctgg

SEQ ID NO: 204 - DNA, 24 bp, synthetic construct
  misc_feature 1..24: note = Description of Artificial Sequence: Syntheticoligonucleotide
  source 1..24: mol_type = other DNA
ccgagactccgcgcggagtctcgg

SEQ ID NO: 205 - DNA, 24 bp, synthetic construct
  misc_feature 1..24: note = Description of Artificial Sequence: Syntheticoligonucleotide
  source 1..24: mol_type = other DNA
tcgggactccgcgcggagtcccga

SEQ ID NO: 206 - DNA, 24 bp, synthetic construct
  misc_feature 1..24: note = Description of Artificial Sequence: Syntheticoligonucleotide
  source 1..24: mol_type = other DNA
ctgggactccgcgcggagtcccag

SEQ ID NO: 207 - DNA, 24 bp, synthetic construct
  misc_feature 1..24: note = Description of Artificial Sequence: Syntheticoligonucleotide
  source 1..24: mol_type = other DNA
cctggactccgcgcggagtccagg

SEQ ID NO: 208 - DNA, 24 bp, synthetic construct
  misc_feature 1..24: note = Description of Artificial Sequence: Syntheticoligonucleotide
  source 1..24: mol_type = other DNA
ccgtgactccgcgcggagtcacgg

SEQ ID NO: 209 - DNA, 24 bp, synthetic construct
  misc_feature 1..24: note = Description of Artificial Sequence: Syntheticoligonucleotide
  source 1..24: mol_type = other DNA
cggcgactccgcgcggagtcgccg

SEQ ID NO: 210 - DNA, 24 bp, synthetic construct
  misc_feature 1..24: note = Description of Artificial Sequence: Syntheticoligonucleotide
  source 1..24: mol_type = other DNA
cagcgactccgcgcggagtcgctg

SEQ ID NO: 211 - DNA, 24 bp, synthetic construct
  misc_feature 1..24: note = Description of Artificial Sequence: Syntheticoligonucleotide
  source 1..24: mol_type = other DNA
cgacgactccgcgcggagtcgtcg

SEQ ID NO: 212 - DNA, 24 bp, synthetic construct
  misc_feature 1..24: note = Description of Artificial Sequence: Syntheticoligonucleotide
  source 1..24: mol_type = other DNA
cggagactccgcgcggagtctccg

SEQ ID NO: 213 - DNA, 24 bp, synthetic construct
  misc_feature 1..24: note = Description of Artificial Sequence: Syntheticoligonucleotide
  source 1..24: mol_type = other DNA
ctgcgactccgcgcggagtcgcag

SEQ ID NO: 214 - DNA, 24 bp, synthetic construct
  misc_feature 1..24: note = Description of Artificial Sequence: Syntheticoligonucleotide
  source 1..24: mol_type = other DNA
cggtgactccgcgcggagtcaccg

SEQ ID NO: 215 - DNA, 24 bp, synthetic construct
  misc_feature 1..24: note = Description of Artificial Sequence: Syntheticoligonucleotide
  source 1..24: mol_type = other DNA
cacggactccgcgcggagtccgtg

SEQ ID NO: 216 - DNA, 24 bp, synthetic construct
  misc_feature 1..24: note = Description of Artificial Sequence: Syntheticoligonucleotide
  source 1..24: mol_type = other DNA
cccagactccgcgcggagtctggg

SEQ ID NO: 217 - DNA, 24 bp, synthetic construct
  misc_feature 1..24: note = Description of Artificial Sequence: Syntheticoligonucleotide
  source 1..24: mol_type = other DNA
ctcggactccgcgcggagtccgag

SEQ ID NO: 218 - DNA, 24 bp, synthetic construct
  misc_feature 1..24: note = Description of Artificial Sequence: Syntheticoligonucleotide
  source 1..24: mol_type = other DNA
ccctgactccgcgcggagtcaggg

SEQ ID NO: 219 - DNA, 24 bp, synthetic construct
  misc_feature 1..24: note = Description of Artificial Sequence: Syntheticoligonucleotide
  source 1..24: mol_type = other DNA
ccacgactccgcgcggagtcgtgg

SEQ ID NO: 220 - DNA, 24 bp, synthetic construct
  misc_feature 1..24: note = Description of Artificial Sequence: Syntheticoligonucleotide
  source 1..24: mol_type = other DNA
agccgactccgcgcggagtcggct

SEQ ID NO: 221 - DNA, 24 bp, synthetic construct
  misc_feature 1..24: note = Description of Artificial Sequence: Syntheticoligonucleotide
  source 1..24: mol_type = other DNA
tgccgactccgcgcggagtcggca

SEQ ID NO: 222 - DNA, 24 bp, synthetic construct
  misc_feature 1..24: note = Description of Artificial Sequence: Syntheticoligonucleotide
  source 1..24: mol_type = other DNA
gcgagactccgcgcggagtctcgc

SEQ ID NO: 223 - DNA, 24 bp, synthetic construct
  misc_feature 1..24: note = Description of Artificial Sequence: Syntheticoligonucleotide
  source 1..24: mol_type = other DNA
gcgtgactccgcgcggagtcacgc

SEQ ID NO: 224 - DNA, 24 bp, synthetic construct
  misc_feature 1..24: note = Description of Artificial Sequence: Syntheticoligonucleotide
  source 1..24: mol_type = other DNA
gcaggactccgcgcggagtcctgc

SEQ ID NO: 225 - DNA, 24 bp, synthetic construct
  misc_feature 1..24: note = Description of Artificial Sequence: Syntheticoligonucleotide
  source 1..24: mol_type = other DNA
gctggactccgcgcggagtccagc

SEQ ID NO: 226 - DNA, 24 bp, synthetic construct
  misc_feature 1..24: note = Description of Artificial Sequence: Syntheticoligonucleotide
  source 1..24: mol_type = other DNA
cgaggactccgcgcggagtcctcg

SEQ ID NO: 227 - DNA, 24 bp, synthetic construct
  misc_feature 1..24: note = Description of Artificial Sequence: Syntheticoligonucleotide
  source 1..24: mol_type = other DNA
cgtggactccgcgcggagtccacg

SEQ ID NO: 228 - DNA, 24 bp, synthetic construct
  misc_feature 1..24: note = Description of Artificial Sequence: Syntheticoligonucleotide
  source 1..24: mol_type = other DNA
caccgactccgcgcggagtcggtg

SEQ ID NO: 229 - DNA, 24 bp, synthetic construct
  misc_feature 1..24: note = Description of Artificial Sequence: Syntheticoligonucleotide
  source 1..24: mol_type = other DNA
ctccgactccgcgcggagtcggag

SEQ ID NO: 230 - DNA, 24 bp, synthetic construct
  misc_feature 1..24: note = Description of Artificial Sequence: Syntheticoligonucleotide
  source 1..24: mol_type = other DNA
gcgggactccgcgcggagtcccgc

SEQ ID NO: 231 - DNA, 24 bp, synthetic construct
  misc_feature 1..24: note = Description of Artificial Sequence: Syntheticoligonucleotide
  source 1..24: mol_type = other DNA
gagggactccgcgcggagtccctc

SEQ ID NO: 232 - DNA, 24 bp, synthetic construct
  misc_feature 1..24: note = Description of Artificial Sequence: Syntheticoligonucleotide
  source 1..24: mol_type = other DNA
gtgggactccgcgcggagtcccac

SEQ ID NO: 233 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactctgatcagagtcnnnn

SEQ ID NO: 234 - DNA, 24 bp, synthetic construct
  misc_feature 1..24: note = Description of Artificial Sequence: Syntheticoligonucleotide
  source 1..24: mol_type = other DNA
ggcggactctgatcagagtccgcc

SEQ ID NO: 235 - DNA, 24 bp, synthetic construct
  misc_feature 1..24: note = Description of Artificial Sequence: Syntheticoligonucleotide
  source 1..24: mol_type = other DNA
agcggactctgatcagagtccgct

SEQ ID NO: 236 - DNA, 24 bp, synthetic construct
  misc_feature 1..24: note = Description of Artificial Sequence: Syntheticoligonucleotide
  source 1..24: mol_type = other DNA
gacggactctgatcagagtccgtc

SEQ ID NO: 237 - DNA, 24 bp, synthetic construct
  misc_feature 1..24: note = Description of Artificial Sequence: Syntheticoligonucleotide
  source 1..24: mol_type = other DNA
ggaggactctgatcagagtcctcc

SEQ ID NO: 238 - DNA, 24 bp, synthetic construct
  misc_feature 1..24: note = Description of Artificial Sequence: Syntheticoligonucleotide
  source 1..24: mol_type = other DNA
ggcagactctgatcagagtctgcc

SEQ ID NO: 239 - DNA, 24 bp, synthetic construct
  misc_feature 1..24: note = Description of Artificial Sequence: Syntheticoligonucleotide
  source 1..24: mol_type = other DNA
tgcggactctgatcagagtccgca

SEQ ID NO: 240 - DNA, 24 bp, synthetic construct
  misc_feature 1..24: note = Description of Artificial Sequence: Syntheticoligonucleotide
  source 1..24: mol_type = other DNA
gtcggactctgatcagagtccgac

SEQ ID NO: 241 - DNA, 24 bp, synthetic construct
  misc_feature 1..24: note = Description of Artificial Sequence: Syntheticoligonucleotide
  source 1..24: mol_type = other DNA
ggtggactctgatcagagtccacc

SEQ ID NO: 242 - DNA, 24 bp, synthetic construct
  misc_feature 1..24: note = Description of Artificial Sequence: Syntheticoligonucleotide
  source 1..24: mol_type = other DNA
ggctgactctgatcagagtcagcc

SEQ ID NO: 243 - DNA, 24 bp, synthetic construct
  misc_feature 1..24: note = Description of Artificial Sequence: Syntheticoligonucleotide
  source 1..24: mol_type = other DNA
gcccgactctgatcagagtcgggc

SEQ ID NO: 244 - DNA, 24 bp, synthetic construct
  misc_feature 1..24: note = Description of Artificial Sequence: Syntheticoligonucleotide
  source 1..24: mol_type = other DNA
acccgactctgatcagagtcgggt

SEQ ID NO: 245 - DNA, 24 bp, synthetic construct
  misc_feature 1..24: note = Description of Artificial Sequence: Syntheticoligonucleotide
  source 1..24: mol_type = other DNA
gaccgactctgatcagagtcggtc

SEQ ID NO: 246 - DNA, 24 bp, synthetic construct
  misc_feature 1..24: note = Description of Artificial Sequence: Syntheticoligonucleotide
  source 1..24: mol_type = other DNA
gcacgactctgatcagagtcgtgc

SEQ ID NO: 247 - DNA, 24 bp, synthetic construct
  misc_feature 1..24: note = Description of Artificial Sequence: Syntheticoligonucleotide
  source 1..24: mol_type = other DNA
gccagactctgatcagagtctggc

SEQ ID NO: 248 - DNA, 24 bp, synthetic construct
  misc_feature 1..24: note = Description of Artificial Sequence: Syntheticoligonucleotide
  source 1..24: mol_type = other DNA
tcccgactctgatcagagtcggga

SEQ ID NO: 249 - DNA, 24 bp, synthetic construct
  misc_feature 1..24: note = Description of Artificial Sequence: Syntheticoligonucleotide
  source 1..24: mol_type = other DNA
gtccgactctgatcagagtcggac

SEQ ID NO: 250 - DNA, 24 bp, synthetic construct
  misc_feature 1..24: note = Description of Artificial Sequence: Syntheticoligonucleotide
  source 1..24: mol_type = other DNA
gcctgactctgatcagagtcaggc

SEQ ID NO: 251 - DNA, 24 bp, synthetic construct
  misc_feature 1..24: note = Description of Artificial Sequence: Syntheticoligonucleotide
  source 1..24: mol_type = other DNA
gggcgactctgatcagagtcgccc

SEQ ID NO: 252 - DNA, 24 bp, synthetic construct
  misc_feature 1..24: note = Description of Artificial Sequence: Syntheticoligonucleotide
  source 1..24: mol_type = other DNA
aggcgactctgatcagagtcgcct

SEQ ID NO: 253 - DNA, 24 bp, synthetic construct
  misc_feature 1..24: note = Description of Artificial Sequence: Syntheticoligonucleotide
  source 1..24: mol_type = other DNA
gagcgactctgatcagagtcgctc

SEQ ID NO: 254 - DNA, 24 bp, synthetic construct
  misc_feature 1..24: note = Description of Artificial Sequence: Syntheticoligonucleotide
  source 1..24: mol_type = other DNA
ggacgactctgatcagagtcgtcc

SEQ ID NO: 255 - DNA, 24 bp, synthetic construct
  misc_feature 1..24: note = Description of Artificial Sequence: Syntheticoligonucleotide
  source 1..24: mol_type = other DNA
gggagactctgatcagagtctccc

SEQ ID NO: 256 - DNA, 24 bp, synthetic construct
  misc_feature 1..24: note = Description of Artificial Sequence: Syntheticoligonucleotide
  source 1..24: mol_type = other DNA
tggcgactctgatcagagtcgcca

SEQ ID NO: 257 - DNA, 24 bp, synthetic construct
  misc_feature 1..24: note = Description of Artificial Sequence: Syntheticoligonucleotide
  source 1..24: mol_type = other DNA
gtgcgactctgatcagagtcgcac

SEQ ID NO: 258 - DNA, 24 bp, synthetic construct
  misc_feature 1..24: note = Description of Artificial Sequence: Syntheticoligonucleotide
  source 1..24: mol_type = other DNA
gggtgactctgatcagagtcaccc

SEQ ID NO: 259 - DNA, 24 bp, synthetic construct
  misc_feature 1..24: note = Description of Artificial Sequence: Syntheticoligonucleotide
  source 1..24: mol_type = other DNA
acgggactctgatcagagtcccgt

SEQ ID NO: 260 - DNA, 24 bp, synthetic construct
  misc_feature 1..24: note = Description of Artificial Sequence: Syntheticoligonucleotide
  source 1..24: mol_type = other DNA
cagggactctgatcagagtccctg

SEQ ID NO: 261 - DNA, 24 bp, synthetic construct
  misc_feature 1..24: note = Description of Artificial Sequence: Syntheticoligonucleotide
  source 1..24: mol_type = other DNA
ccaggactctgatcagagtcctgg

SEQ ID NO: 262 - DNA, 24 bp, synthetic construct
  misc_feature 1..24: note = Description of Artificial Sequence: Syntheticoligonucleotide
  source 1..24: mol_type = other DNA
ccgagactctgatcagagtctcgg

SEQ ID NO: 263 - DNA, 24 bp, synthetic construct
  misc_feature 1..24: note = Description of Artificial Sequence: Syntheticoligonucleotide
  source 1..24: mol_type = other DNA
tcgggactctgatcagagtcccga

SEQ ID NO: 264 - DNA, 24 bp, synthetic construct
  misc_feature 1..24: note = Description of Artificial Sequence: Syntheticoligonucleotide
  source 1..24: mol_type = other DNA
ctgggactctgatcagagtcccag

SEQ ID NO: 265 - DNA, 24 bp, synthetic construct
  misc_feature 1..24: note = Description of Artificial Sequence: Syntheticoligonucleotide
  source 1..24: mol_type = other DNA
cctggactctgatcagagtccagg

SEQ ID NO: 266 - DNA, 24 bp, synthetic construct
  misc_feature 1..24: note = Description of Artificial Sequence: Syntheticoligonucleotide
  source 1..24: mol_type = other DNA
ccgtgactctgatcagagtcacgg

SEQ ID NO: 267 - DNA, 24 bp, synthetic construct
  misc_feature 1..24: note = Description of Artificial Sequence: Syntheticoligonucleotide
  source 1..24: mol_type = other DNA
cggcgactctgatcagagtcgccg

SEQ ID NO: 268 - DNA, 24 bp, synthetic construct
  misc_feature 1..24: note = Description of Artificial Sequence: Syntheticoligonucleotide
  source 1..24: mol_type = other DNA
cagcgactctgatcagagtcgctg

SEQ ID NO: 269 - DNA, 24 bp, synthetic construct
  misc_feature 1..24: note = Description of Artificial Sequence: Syntheticoligonucleotide
  source 1..24: mol_type = other DNA
cgacgactctgatcagagtcgtcg

SEQ ID NO: 270 - DNA, 24 bp, synthetic construct
  misc_feature 1..24: note = Description of Artificial Sequence: Syntheticoligonucleotide
  source 1..24: mol_type = other DNA
cggagactctgatcagagtctccg

SEQ ID NO: 271 - DNA, 24 bp, synthetic construct
  misc_feature 1..24: note = Description of Artificial Sequence: Syntheticoligonucleotide
  source 1..24: mol_type = other DNA
ctgcgactctgatcagagtcgcag

SEQ ID NO: 272 - DNA, 24 bp, synthetic construct
  misc_feature 1..24: note = Description of Artificial Sequence: Syntheticoligonucleotide
  source 1..24: mol_type = other DNA
cggtgactctgatcagagtcaccg

SEQ ID NO: 273 - DNA, 24 bp, synthetic construct
  misc_feature 1..24: note = Description of Artificial Sequence: Syntheticoligonucleotide
  source 1..24: mol_type = other DNA
cacggactctgatcagagtccgtg

SEQ ID NO: 274 - DNA, 24 bp, synthetic construct
  misc_feature 1..24: note = Description of Artificial Sequence: Syntheticoligonucleotide
  source 1..24: mol_type = other DNA
cccagactctgatcagagtctggg

SEQ ID NO: 275 - DNA, 24 bp, synthetic construct
  misc_feature 1..24: note = Description of Artificial Sequence: Syntheticoligonucleotide
  source 1..24: mol_type = other DNA
ctcggactctgatcagagtccgag

SEQ ID NO: 276 - DNA, 24 bp, synthetic construct
  misc_feature 1..24: note = Description of Artificial Sequence: Syntheticoligonucleotide
  source 1..24: mol_type = other DNA
ccctgactctgatcagagtcaggg

SEQ ID NO: 277 - DNA, 24 bp, synthetic construct
  misc_feature 1..24: note = Description of Artificial Sequence: Syntheticoligonucleotide
  source 1..24: mol_type = other DNA
ccacgactctgatcagagtcgtgg

SEQ ID NO: 278 - DNA, 24 bp, synthetic construct
  misc_feature 1..24: note = Description of Artificial Sequence: Syntheticoligonucleotide
  source 1..24: mol_type = other DNA
agccgactctgatcagagtcggct

SEQ ID NO: 279 - DNA, 24 bp, synthetic construct
  misc_feature 1..24: note = Description of Artificial Sequence: Syntheticoligonucleotide
  source 1..24: mol_type = other DNA
tgccgactctgatcagagtcggca

SEQ ID NO: 280 - DNA, 24 bp, synthetic construct
  misc_feature 1..24: note = Description of Artificial Sequence: Syntheticoligonucleotide
  source 1..24: mol_type = other DNA
gcgagactctgatcagagtctcgc

SEQ ID NO: 281 - DNA, 24 bp, synthetic construct
  misc_feature 1..24: note = Description of Artificial Sequence: Syntheticoligonucleotide
  source 1..24: mol_type = other DNA
gcgtgactctgatcagagtcacgc

SEQ ID NO: 282 - DNA, 24 bp, synthetic construct
  misc_feature 1..24: note = Description of Artificial Sequence: Syntheticoligonucleotide
  source 1..24: mol_type = other DNA
gcaggactctgatcagagtcctgc

SEQ ID NO: 283 - DNA, 24 bp, synthetic construct
  misc_feature 1..24: note = Description of Artificial Sequence: Syntheticoligonucleotide
  source 1..24: mol_type = other DNA
gctggactctgatcagagtccagc

SEQ ID NO: 284 - DNA, 24 bp, synthetic construct
  misc_feature 1..24: note = Description of Artificial Sequence: Syntheticoligonucleotide
  source 1..24: mol_type = other DNA
cgaggactctgatcagagtcctcg

SEQ ID NO: 285 - DNA, 24 bp, synthetic construct
  misc_feature 1..24: note = Description of Artificial Sequence: Syntheticoligonucleotide
  source 1..24: mol_type = other DNA
cgtggactctgatcagagtccacg

SEQ ID NO: 286 - DNA, 24 bp, synthetic construct
  misc_feature 1..24: note = Description of Artificial Sequence: Syntheticoligonucleotide
  source 1..24: mol_type = other DNA
caccgactctgatcagagtcggtg

SEQ ID NO: 287 - DNA, 24 bp, synthetic construct
  misc_feature 1..24: note = Description of Artificial Sequence: Syntheticoligonucleotide
  source 1..24: mol_type = other DNA
ctccgactctgatcagagtcggag

SEQ ID NO: 288 - DNA, 24 bp, synthetic construct
  misc_feature 1..24: note = Description of Artificial Sequence: Syntheticoligonucleotide
  source 1..24: mol_type = other DNA
gcgggactctgatcagagtcccgc

SEQ ID NO: 289 - DNA, 24 bp, synthetic construct
  misc_feature 1..24: note = Description of Artificial Sequence: Syntheticoligonucleotide
  source 1..24: mol_type = other DNA
gagggactctgatcagagtccctc

SEQ ID NO: 290 - DNA, 24 bp, synthetic construct
  misc_feature 1..24: note = Description of Artificial Sequence: Syntheticoligonucleotide
  source 1..24: mol_type = other DNA
gtgggactctgatcagagtcccac

SEQ ID NO: 291 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactctgtacagagtcnnnn

SEQ ID NO: 292 - DNA, 24 bp, synthetic construct
  misc_feature 1..24: note = Description of Artificial Sequence: Syntheticoligonucleotide
  source 1..24: mol_type = other DNA
ggcggactctgtacagagtccgcc

SEQ ID NO: 293 - DNA, 24 bp, synthetic construct
  misc_feature 1..24: note = Description of Artificial Sequence: Syntheticoligonucleotide
  source 1..24: mol_type = other DNA
agcggactctgtacagagtccgct

SEQ ID NO: 294 - DNA, 24 bp, synthetic construct
  misc_feature 1..24: note = Description of Artificial Sequence: Syntheticoligonucleotide
  source 1..24: mol_type = other DNA
gacggactctgtacagagtccgtc

SEQ ID NO: 295 - DNA, 24 bp, synthetic construct
  misc_feature 1..24: note = Description of Artificial Sequence: Syntheticoligonucleotide
  source 1..24: mol_type = other DNA
ggaggactctgtacagagtcctcc

SEQ ID NO: 296 - DNA, 24 bp, synthetic construct
  misc_feature 1..24: note = Description of Artificial Sequence: Syntheticoligonucleotide
  source 1..24: mol_type = other DNA
ggcagactctgtacagagtctgcc

SEQ ID NO: 297 - DNA, 24 bp, synthetic construct
  misc_feature 1..24: note = Description of Artificial Sequence: Syntheticoligonucleotide
  source 1..24: mol_type = other DNA
tgcggactctgtacagagtccgca

SEQ ID NO: 298 - DNA, 24 bp, synthetic construct
  misc_feature 1..24: note = Description of Artificial Sequence: Syntheticoligonucleotide
  source 1..24: mol_type = other DNA
gtcggactctgtacagagtccgac

SEQ ID NO: 299 - DNA, 24 bp, synthetic construct
  misc_feature 1..24: note = Description of Artificial Sequence: Syntheticoligonucleotide
  source 1..24: mol_type = other DNA
ggtggactctgtacagagtccacc

SEQ ID NO: 300 - DNA, 24 bp, synthetic construct
  misc_feature 1..24: note = Description of Artificial Sequence: Syntheticoligonucleotide
  source 1..24: mol_type = other DNA
ggctgactctgtacagagtcagcc

SEQ ID NO: 301 - DNA, 24 bp, synthetic construct
  misc_feature 1..24: note = Description of Artificial Sequence: Syntheticoligonucleotide
  source 1..24: mol_type = other DNA
gcccgactctgtacagagtcgggc

SEQ ID NO: 302 - DNA, 24 bp, synthetic construct
  misc_feature 1..24: note = Description of Artificial Sequence: Syntheticoligonucleotide
  source 1..24: mol_type = other DNA
acccgactctgtacagagtcgggt

SEQ ID NO: 303 - DNA, 24 bp, synthetic construct
  misc_feature 1..24: note = Description of Artificial Sequence: Syntheticoligonucleotide
  source 1..24: mol_type = other DNA
gaccgactctgtacagagtcggtc

SEQ ID NO: 304 - DNA, 24 bp, synthetic construct
  misc_feature 1..24: note = Description of Artificial Sequence: Syntheticoligonucleotide
  source 1..24: mol_type = other DNA
gcacgactctgtacagagtcgtgc

SEQ ID NO: 305 - DNA, 24 bp, synthetic construct
  misc_feature 1..24: note = Description of Artificial Sequence: Syntheticoligonucleotide
  source 1..24: mol_type = other DNA
gccagactctgtacagagtctggc

SEQ ID NO: 306 - DNA, 24 bp, synthetic construct
  misc_feature 1..24: note = Description of Artificial Sequence: Syntheticoligonucleotide
  source 1..24: mol_type = other DNA
tcccgactctgtacagagtcggga

SEQ ID NO: 307 - DNA, 24 bp, synthetic construct
  misc_feature 1..24: note = Description of Artificial Sequence: Syntheticoligonucleotide
  source 1..24: mol_type = other DNA
gtccgactctgtacagagtcggac

SEQ ID NO: 308 - DNA, 24 bp, synthetic construct
  misc_feature 1..24: note = Description of Artificial Sequence: Syntheticoligonucleotide
  source 1..24: mol_type = other DNA
gcctgactctgtacagagtcaggc

SEQ ID NO: 309 - DNA, 24 bp, synthetic construct
  misc_feature 1..24: note = Description of Artificial Sequence: Syntheticoligonucleotide
  source 1..24: mol_type = other DNA
gggcgactctgtacagagtcgccc

SEQ ID NO: 310 - DNA, 24 bp, synthetic construct
  misc_feature 1..24: note = Description of Artificial Sequence: Syntheticoligonucleotide
  source 1..24: mol_type = other DNA
aggcgactctgtacagagtcgcct

SEQ ID NO: 311 - DNA, 24 bp, synthetic construct
  misc_feature 1..24: note = Description of Artificial Sequence: Syntheticoligonucleotide
  source 1..24: mol_type = other DNA
gagcgactctgtacagagtcgctc

SEQ ID NO: 312 - DNA, 24 bp, synthetic construct
  misc_feature 1..24: note = Description of Artificial Sequence: Syntheticoligonucleotide
  source 1..24: mol_type = other DNA
ggacgactctgtacagagtcgtcc

SEQ ID NO: 313 - DNA, 24 bp, synthetic construct
  misc_feature 1..24: note = Description of Artificial Sequence: Syntheticoligonucleotide
  source 1..24: mol_type = other DNA
gggagactctgtacagagtctccc

SEQ ID NO: 314 - DNA, 24 bp, synthetic construct
  misc_feature 1..24: note = Description of Artificial Sequence: Syntheticoligonucleotide
  source 1..24: mol_type = other DNA
tggcgactctgtacagagtcgcca

SEQ ID NO: 315 - DNA, 24 bp, synthetic construct
  misc_feature 1..24: note = Description of Artificial Sequence: Syntheticoligonucleotide
  source 1..24: mol_type = other DNA
gtgcgactctgtacagagtcgcac

SEQ ID NO: 316 - DNA, 24 bp, synthetic construct
  misc_feature 1..24: note = Description of Artificial Sequence: Syntheticoligonucleotide
  source 1..24: mol_type = other DNA
gggtgactctgtacagagtcaccc

SEQ ID NO: 317 - DNA, 24 bp, synthetic construct
  misc_feature 1..24: note = Description of Artificial Sequence: Syntheticoligonucleotide
  source 1..24: mol_type = other DNA
acgggactctgtacagagtcccgt

SEQ ID NO: 318 - DNA, 24 bp, synthetic construct
  misc_feature 1..24: note = Description of Artificial Sequence: Syntheticoligonucleotide
  source 1..24: mol_type = other DNA
cagggactctgtacagagtccctg

SEQ ID NO: 319 - DNA, 24 bp, synthetic construct
  misc_feature 1..24: note = Description of Artificial Sequence: Syntheticoligonucleotide
  source 1..24: mol_type = other DNA
ccaggactctgtacagagtcctgg

SEQ ID NO: 320 - DNA, 24 bp, synthetic construct
  misc_feature 1..24: note = Description of Artificial Sequence: Syntheticoligonucleotide
  source 1..24: mol_type = other DNA
ccgagactctgtacagagtctcgg

SEQ ID NO: 321 - DNA, 24 bp, synthetic construct
  misc_feature 1..24: note = Description of Artificial Sequence: Syntheticoligonucleotide
  source 1..24: mol_type = other DNA
tcgggactctgtacagagtcccga

SEQ ID NO: 322 - DNA, 24 bp, synthetic construct
  misc_feature 1..24: note = Description of Artificial Sequence: Syntheticoligonucleotide
  source 1..24: mol_type = other DNA
ctgggactctgtacagagtcccag

SEQ ID NO: 323 - DNA, 24 bp, synthetic construct
  misc_feature 1..24: note = Description of Artificial Sequence: Syntheticoligonucleotide
  source 1..24: mol_type = other DNA
cctggactctgtacagagtccagg

SEQ ID NO: 324 - DNA, 24 bp, synthetic construct
  misc_feature 1..24: note = Description of Artificial Sequence: Syntheticoligonucleotide
  source 1..24: mol_type = other DNA
ccgtgactctgtacagagtcacgg

SEQ ID NO: 325 - DNA, 24 bp, synthetic construct
  misc_feature 1..24: note = Description of Artificial Sequence: Syntheticoligonucleotide
  source 1..24: mol_type = other DNA
cggcgactctgtacagagtcgccg

SEQ ID NO: 326 - DNA, 24 bp, synthetic construct
  misc_feature 1..24: note = Description of Artificial Sequence: Syntheticoligonucleotide
  source 1..24: mol_type = other DNA
cagcgactctgtacagagtcgctg

SEQ ID NO: 327 - DNA, 24 bp, synthetic construct
  misc_feature 1..24: note = Description of Artificial Sequence: Syntheticoligonucleotide
  source 1..24: mol_type = other DNA
cgacgactctgtacagagtcgtcg

SEQ ID NO: 328 - DNA, 24 bp, synthetic construct
  misc_feature 1..24: note = Description of Artificial Sequence: Syntheticoligonucleotide
  source 1..24: mol_type = other DNA
cggagactctgtacagagtctccg

SEQ ID NO: 329 - DNA, 24 bp, synthetic construct
  misc_feature 1..24: note = Description of Artificial Sequence: Syntheticoligonucleotide
  source 1..24: mol_type = other DNA
ctgcgactctgtacagagtcgcag

SEQ ID NO: 330 - DNA, 24 bp, synthetic construct
  misc_feature 1..24: note = Description of Artificial Sequence: Syntheticoligonucleotide
  source 1..24: mol_type = other DNA
cggtgactctgtacagagtcaccg

SEQ ID NO: 331 - DNA, 24 bp, synthetic construct
  misc_feature 1..24: note = Description of Artificial Sequence: Syntheticoligonucleotide
  source 1..24: mol_type = other DNA
cacggactctgtacagagtccgtg

SEQ ID NO: 332 - DNA, 24 bp, synthetic construct
  misc_feature 1..24: note = Description of Artificial Sequence: Syntheticoligonucleotide
  source 1..24: mol_type = other DNA
cccagactctgtacagagtctggg

SEQ ID NO: 333 - DNA, 24 bp, synthetic construct
  misc_feature 1..24: note = Description of Artificial Sequence: Syntheticoligonucleotide
  source 1..24: mol_type = other DNA
ctcggactctgtacagagtccgag

SEQ ID NO: 334 - DNA, 24 bp, synthetic construct
  misc_feature 1..24: note = Description of Artificial Sequence: Syntheticoligonucleotide
  source 1..24: mol_type = other DNA
ccctgactctgtacagagtcaggg

SEQ ID NO: 335 - DNA, 24 bp, synthetic construct
  misc_feature 1..24: note = Description of Artificial Sequence: Syntheticoligonucleotide
  source 1..24: mol_type = other DNA
ccacgactctgtacagagtcgtgg

SEQ ID NO: 336 - DNA, 24 bp, synthetic construct
  misc_feature 1..24: note = Description of Artificial Sequence: Syntheticoligonucleotide
  source 1..24: mol_type = other DNA
agccgactctgtacagagtcggct

SEQ ID NO: 337 - DNA, 24 bp, synthetic construct
  misc_feature 1..24: note = Description of Artificial Sequence: Syntheticoligonucleotide
  source 1..24: mol_type = other DNA
tgccgactctgtacagagtcggca

SEQ ID NO: 338 - DNA, 24 bp, synthetic construct
  misc_feature 1..24: note = Description of Artificial Sequence: Syntheticoligonucleotide
  source 1..24: mol_type = other DNA
gcgagactctgtacagagtctcgc

SEQ ID NO: 339 - DNA, 24 bp, synthetic construct
  misc_feature 1..24: note = Description of Artificial Sequence: Syntheticoligonucleotide
  source 1..24: mol_type = other DNA
gcgtgactctgtacagagtcacgc

SEQ ID NO: 340 - DNA, 24 bp, synthetic construct
  misc_feature 1..24: note = Description of Artificial Sequence: Syntheticoligonucleotide
  source 1..24: mol_type = other DNA
gcaggactctgtacagagtcctgc

SEQ ID NO: 341 - DNA, 24 bp, synthetic construct
  misc_feature 1..24: note = Description of Artificial Sequence: Syntheticoligonucleotide
  source 1..24: mol_type = other DNA
gctggactctgtacagagtccagc

SEQ ID NO: 342 - DNA, 24 bp, synthetic construct
  misc_feature 1..24: note = Description of Artificial Sequence: Syntheticoligonucleotide
  source 1..24: mol_type = other DNA
cgaggactctgtacagagtcctcg

SEQ ID NO: 343 - DNA, 24 bp, synthetic construct
  misc_feature 1..24: note = Description of Artificial Sequence: Syntheticoligonucleotide
  source 1..24: mol_type = other DNA
cgtggactctgtacagagtccacg

SEQ ID NO: 344 - DNA, 24 bp, synthetic construct
  misc_feature 1..24: note = Description of Artificial Sequence: Syntheticoligonucleotide
  source 1..24: mol_type = other DNA
caccgactctgtacagagtcggtg

SEQ ID NO: 345 - DNA, 24 bp, synthetic construct
  misc_feature 1..24: note = Description of Artificial Sequence: Syntheticoligonucleotide
  source 1..24: mol_type = other DNA
ctccgactctgtacagagtcggag

SEQ ID NO: 346 - DNA, 24 bp, synthetic construct
  misc_feature 1..24: note = Description of Artificial Sequence: Syntheticoligonucleotide
  source 1..24: mol_type = other DNA
gcgggactctgtacagagtcccgc

SEQ ID NO: 347 - DNA, 24 bp, synthetic construct
  misc_feature 1..24: note = Description of Artificial Sequence: Syntheticoligonucleotide
  source 1..24: mol_type = other DNA
gagggactctgtacagagtccctc

SEQ ID NO: 348 - DNA, 24 bp, synthetic construct
  misc_feature 1..24: note = Description of Artificial Sequence: Syntheticoligonucleotide
  source 1..24: mol_type = other DNA
gtgggactctgtacagagtcccac

SEQ ID NO: 349 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactctggccagagtcnnnn

SEQ ID NO: 350 - DNA, 24 bp, synthetic construct
  misc_feature 1..24: note = Description of Artificial Sequence: Syntheticoligonucleotide
  source 1..24: mol_type = other DNA
ggcggactctggccagagtccgcc

SEQ ID NO: 351 - DNA, 24 bp, synthetic construct
  misc_feature 1..24: note = Description of Artificial Sequence: Syntheticoligonucleotide
  source 1..24: mol_type = other DNA
agcggactctggccagagtccgct

SEQ ID NO: 352 - DNA, 24 bp, synthetic construct
  misc_feature 1..24: note = Description of Artificial Sequence: Syntheticoligonucleotide
  source 1..24: mol_type = other DNA
gacggactctggccagagtccgtc

SEQ ID NO: 353 - DNA, 24 bp, synthetic construct
  misc_feature 1..24: note = Description of Artificial Sequence: Syntheticoligonucleotide
  source 1..24: mol_type = other DNA
ggaggactctggccagagtcctcc

SEQ ID NO: 354 - DNA, 24 bp, synthetic construct
  misc_feature 1..24: note = Description of Artificial Sequence: Syntheticoligonucleotide
  source 1..24: mol_type = other DNA
ggcagactctggccagagtctgcc

SEQ ID NO: 355 - DNA, 24 bp, synthetic construct
  misc_feature 1..24: note = Description of Artificial Sequence: Syntheticoligonucleotide
  source 1..24: mol_type = other DNA
tgcggactctggccagagtccgca

SEQ ID NO: 356 - DNA, 24 bp, synthetic construct
  misc_feature 1..24: note = Description of Artificial Sequence: Syntheticoligonucleotide
  source 1..24: mol_type = other DNA
gtcggactctggccagagtccgac

SEQ ID NO: 357 - DNA, 24 bp, synthetic construct
  misc_feature 1..24: note = Description of Artificial Sequence: Syntheticoligonucleotide
  source 1..24: mol_type = other DNA
ggtggactctggccagagtccacc

SEQ ID NO: 358 - DNA, 24 bp, synthetic construct
  misc_feature 1..24: note = Description of Artificial Sequence: Syntheticoligonucleotide
  source 1..24: mol_type = other DNA
ggctgactctggccagagtcagcc

SEQ ID NO: 359 - DNA, 24 bp, synthetic construct
  misc_feature 1..24: note = Description of Artificial Sequence: Syntheticoligonucleotide
  source 1..24: mol_type = other DNA
gcccgactctggccagagtcgggc

SEQ ID NO: 360 - DNA, 24 bp, synthetic construct
  misc_feature 1..24: note = Description of Artificial Sequence: Syntheticoligonucleotide
  source 1..24: mol_type = other DNA
acccgactctggccagagtcgggt

SEQ ID NO: 361 - DNA, 24 bp, synthetic construct
  misc_feature 1..24: note = Description of Artificial Sequence: Syntheticoligonucleotide
  source 1..24: mol_type = other DNA
gaccgactctggccagagtcggtc

SEQ ID NO: 362 - DNA, 24 bp, synthetic construct
  misc_feature 1..24: note = Description of Artificial Sequence: Syntheticoligonucleotide
  source 1..24: mol_type = other DNA
gcacgactctggccagagtcgtgc

SEQ ID NO: 363 - DNA, 24 bp, synthetic construct
  misc_feature 1..24: note = Description of Artificial Sequence: Syntheticoligonucleotide
  source 1..24: mol_type = other DNA
gccagactctggccagagtctggc

SEQ ID NO: 364 - DNA, 24 bp, synthetic construct
  misc_feature 1..24: note = Description of Artificial Sequence: Syntheticoligonucleotide
  source 1..24: mol_type = other DNA
tcccgactctggccagagtcggga

SEQ ID NO: 365 - DNA, 24 bp, synthetic construct
  misc_feature 1..24: note = Description of Artificial Sequence: Syntheticoligonucleotide
  source 1..24: mol_type = other DNA
gtccgactctggccagagtcggac

SEQ ID NO: 366 - DNA, 24 bp, synthetic construct
  misc_feature 1..24: note = Description of Artificial Sequence: Syntheticoligonucleotide
  source 1..24: mol_type = other DNA
gcctgactctggccagagtcaggc

SEQ ID NO: 367 - DNA, 24 bp, synthetic construct
  misc_feature 1..24: note = Description of Artificial Sequence: Syntheticoligonucleotide
  source 1..24: mol_type = other DNA
gggcgactctggccagagtcgccc

SEQ ID NO: 368 - DNA, 24 bp, synthetic construct
  misc_feature 1..24: note = Description of Artificial Sequence: Syntheticoligonucleotide
  source 1..24: mol_type = other DNA
aggcgactctggccagagtcgcct

SEQ ID NO: 369 - DNA, 24 bp, synthetic construct
  misc_feature 1..24: note = Description of Artificial Sequence: Syntheticoligonucleotide
  source 1..24: mol_type = other DNA
gagcgactctggccagagtcgctc

SEQ ID NO: 370 - DNA, 24 bp, synthetic construct
  misc_feature 1..24: note = Description of Artificial Sequence: Syntheticoligonucleotide
  source 1..24: mol_type = other DNA
ggacgactctggccagagtcgtcc

SEQ ID NO: 371 - DNA, 24 bp, synthetic construct
  misc_feature 1..24: note = Description of Artificial Sequence: Syntheticoligonucleotide
  source 1..24: mol_type = other DNA
gggagactctggccagagtctccc

SEQ ID NO: 372 - DNA, 24 bp, synthetic construct
  misc_feature 1..24: note = Description of Artificial Sequence: Syntheticoligonucleotide
  source 1..24: mol_type = other DNA
tggcgactctggccagagtcgcca

SEQ ID NO: 373 - DNA, 24 bp, synthetic construct
  misc_feature 1..24: note = Description of Artificial Sequence: Syntheticoligonucleotide
  source 1..24: mol_type = other DNA
gtgcgactctggccagagtcgcac

SEQ ID NO: 374 - DNA, 24 bp, synthetic construct
  misc_feature 1..24: note = Description of Artificial Sequence: Syntheticoligonucleotide
  source 1..24: mol_type = other DNA
gggtgactctggccagagtcaccc

SEQ ID NO: 375 - DNA, 24 bp, synthetic construct
  misc_feature 1..24: note = Description of Artificial Sequence: Syntheticoligonucleotide
  source 1..24: mol_type = other DNA
acgggactctggccagagtcccgt

SEQ ID NO: 376 - DNA, 24 bp, synthetic construct
  misc_feature 1..24: note = Description of Artificial Sequence: Syntheticoligonucleotide
  source 1..24: mol_type = other DNA
cagggactctggccagagtccctg

SEQ ID NO: 377 - DNA, 24 bp, synthetic construct
  misc_feature 1..24: note = Description of Artificial Sequence: Syntheticoligonucleotide
  source 1..24: mol_type = other DNA
ccaggactctggccagagtcctgg

SEQ ID NO: 378 - DNA, 24 bp, synthetic construct
  misc_feature 1..24: note = Description of Artificial Sequence: Syntheticoligonucleotide
  source 1..24: mol_type = other DNA
ccgagactctggccagagtctcgg

SEQ ID NO: 379 - DNA, 24 bp, synthetic construct
  misc_feature 1..24: note = Description of Artificial Sequence: Syntheticoligonucleotide
  source 1..24: mol_type = other DNA
tcgggactctggccagagtcccga

SEQ ID NO: 380 - DNA, 24 bp, synthetic construct
  misc_feature 1..24: note = Description of Artificial Sequence: Syntheticoligonucleotide
  source 1..24: mol_type = other DNA
ctgggactctggccagagtcccag

SEQ ID NO: 381 - DNA, 24 bp, synthetic construct
  misc_feature 1..24: note = Description of Artificial Sequence: Syntheticoligonucleotide
  source 1..24: mol_type = other DNA
cctggactctggccagagtccagg

SEQ ID NO: 382 - DNA, 24 bp, synthetic construct
  misc_feature 1..24: note = Description of Artificial Sequence: Syntheticoligonucleotide
  source 1..24: mol_type = other DNA
ccgtgactctggccagagtcacgg

SEQ ID NO: 383 - DNA, 24 bp, synthetic construct
  misc_feature 1..24: note = Description of Artificial Sequence: Syntheticoligonucleotide
  source 1..24: mol_type = other DNA
cggcgactctggccagagtcgccg

SEQ ID NO: 384 - DNA, 24 bp, synthetic construct
  misc_feature 1..24: note = Description of Artificial Sequence: Syntheticoligonucleotide
  source 1..24: mol_type = other DNA
cagcgactctggccagagtcgctg

SEQ ID NO: 385 - DNA, 24 bp, synthetic construct
  misc_feature 1..24: note = Description of Artificial Sequence: Syntheticoligonucleotide
  source 1..24: mol_type = other DNA
cgacgactctggccagagtcgtcg

SEQ ID NO: 386 - DNA, 24 bp, synthetic construct
  misc_feature 1..24: note = Description of Artificial Sequence: Syntheticoligonucleotide
  source 1..24: mol_type = other DNA
cggagactctggccagagtctccg

SEQ ID NO: 387 - DNA, 24 bp, synthetic construct
  misc_feature 1..24: note = Description of Artificial Sequence: Syntheticoligonucleotide
  source 1..24: mol_type = other DNA
ctgcgactctggccagagtcgcag

SEQ ID NO: 388 - DNA, 24 bp, synthetic construct
  misc_feature 1..24: note = Description of Artificial Sequence: Syntheticoligonucleotide
  source 1..24: mol_type = other DNA
cggtgactctggccagagtcaccg

SEQ ID NO: 389 - DNA, 24 bp, synthetic construct
  misc_feature 1..24: note = Description of Artificial Sequence: Syntheticoligonucleotide
  source 1..24: mol_type = other DNA
cacggactctggccagagtccgtg

SEQ ID NO: 390 - DNA, 24 bp, synthetic construct
  misc_feature 1..24: note = Description of Artificial Sequence: Syntheticoligonucleotide
  source 1..24: mol_type = other DNA
cccagactctggccagagtctggg

SEQ ID NO: 391 - DNA, 24 bp, synthetic construct
  misc_feature 1..24: note = Description of Artificial Sequence: Syntheticoligonucleotide
  source 1..24: mol_type = other DNA
ctcggactctggccagagtccgag

SEQ ID NO: 392 - DNA, 24 bp, synthetic construct
  misc_feature 1..24: note = Description of Artificial Sequence: Syntheticoligonucleotide
  source 1..24: mol_type = other DNA
ccctgactctggccagagtcaggg

SEQ ID NO: 393 - DNA, 24 bp, synthetic construct
  misc_feature 1..24: note = Description of Artificial Sequence: Syntheticoligonucleotide
  source 1..24: mol_type = other DNA
ccacgactctggccagagtcgtgg

SEQ ID NO: 394 - DNA, 24 bp, synthetic construct
  misc_feature 1..24: note = Description of Artificial Sequence: Syntheticoligonucleotide
  source 1..24: mol_type = other DNA
agccgactctggccagagtcggct

SEQ ID NO: 395 - DNA, 24 bp, synthetic construct
  misc_feature 1..24: note = Description of Artificial Sequence: Syntheticoligonucleotide
  source 1..24: mol_type = other DNA
tgccgactctggccagagtcggca

SEQ ID NO: 396 - DNA, 24 bp, synthetic construct
  misc_feature 1..24: note = Description of Artificial Sequence: Syntheticoligonucleotide
  source 1..24: mol_type = other DNA
gcgagactctggccagagtctcgc

SEQ ID NO: 397 - DNA, 24 bp, synthetic construct
  misc_feature 1..24: note = Description of Artificial Sequence: Syntheticoligonucleotide
  source 1..24: mol_type = other DNA
gcgtgactctggccagagtcacgc

SEQ ID NO: 398 - DNA, 24 bp, synthetic construct
  misc_feature 1..24: note = Description of Artificial Sequence: Syntheticoligonucleotide
  source 1..24: mol_type = other DNA
gcaggactctggccagagtcctgc

SEQ ID NO: 399 - DNA, 24 bp, synthetic construct
  misc_feature 1..24: note = Description of Artificial Sequence: Syntheticoligonucleotide
  source 1..24: mol_type = other DNA
gctggactctggccagagtccagc

SEQ ID NO: 400 - DNA, 24 bp, synthetic construct
  misc_feature 1..24: note = Description of Artificial Sequence: Syntheticoligonucleotide
  source 1..24: mol_type = other DNA
cgaggactctggccagagtcctcg

SEQ ID NO: 401 - DNA, 24 bp, synthetic construct
  misc_feature 1..24: note = Description of Artificial Sequence: Syntheticoligonucleotide
  source 1..24: mol_type = other DNA
cgtggactctggccagagtccacg

SEQ ID NO: 402 - DNA, 24 bp, synthetic construct
  misc_feature 1..24: note = Description of Artificial Sequence: Syntheticoligonucleotide
  source 1..24: mol_type = other DNA
caccgactctggccagagtcggtg

SEQ ID NO: 403 - DNA, 24 bp, synthetic construct
  misc_feature 1..24: note = Description of Artificial Sequence: Syntheticoligonucleotide
  source 1..24: mol_type = other DNA
ctccgactctggccagagtcggag

SEQ ID NO: 404 - DNA, 24 bp, synthetic construct
  misc_feature 1..24: note = Description of Artificial Sequence: Syntheticoligonucleotide
  source 1..24: mol_type = other DNA
gcgggactctggccagagtcccgc

SEQ ID NO: 405 - DNA, 24 bp, synthetic construct
  misc_feature 1..24: note = Description of Artificial Sequence: Syntheticoligonucleotide
  source 1..24: mol_type = other DNA
gagggactctggccagagtccctc

SEQ ID NO: 406 - DNA, 24 bp, synthetic construct
  misc_feature 1..24: note = Description of Artificial Sequence: Syntheticoligonucleotide
  source 1..24: mol_type = other DNA
gtgggactctggccagagtcccac

SEQ ID NO: 407 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactctgcgcagagtcnnnn

SEQ ID NO: 408 - DNA, 24 bp, synthetic construct
  misc_feature 1..24: note = Description of Artificial Sequence: Syntheticoligonucleotide
  source 1..24: mol_type = other DNA
ggcggactctgcgcagagtccgcc

SEQ ID NO: 409 - DNA, 24 bp, synthetic construct
  misc_feature 1..24: note = Description of Artificial Sequence: Syntheticoligonucleotide
  source 1..24: mol_type = other DNA
agcggactctgcgcagagtccgct

SEQ ID NO: 410 - DNA, 24 bp, synthetic construct
  misc_feature 1..24: note = Description of Artificial Sequence: Syntheticoligonucleotide
  source 1..24: mol_type = other DNA
gacggactctgcgcagagtccgtc

SEQ ID NO: 411 - DNA, 24 bp, synthetic construct
  misc_feature 1..24: note = Description of Artificial Sequence: Syntheticoligonucleotide
  source 1..24: mol_type = other DNA
ggaggactctgcgcagagtcctcc

SEQ ID NO: 412 - DNA, 24 bp, synthetic construct
  misc_feature 1..24: note = Description of Artificial Sequence: Syntheticoligonucleotide
  source 1..24: mol_type = other DNA
ggcagactctgcgcagagtctgcc

SEQ ID NO: 413 - DNA, 24 bp, synthetic construct
  misc_feature 1..24: note = Description of Artificial Sequence: Syntheticoligonucleotide
  source 1..24: mol_type = other DNA
tgcggactctgcgcagagtccgca

SEQ ID NO: 414 - DNA, 24 bp, synthetic construct
  misc_feature 1..24: note = Description of Artificial Sequence: Syntheticoligonucleotide
  source 1..24: mol_type = other DNA
gtcggactctgcgcagagtccgac

SEQ ID NO: 415 - DNA, 24 bp, synthetic construct
  misc_feature 1..24: note = Description of Artificial Sequence: Syntheticoligonucleotide
  source 1..24: mol_type = other DNA
ggtggactctgcgcagagtccacc

SEQ ID NO: 416 - DNA, 24 bp, synthetic construct
  misc_feature 1..24: note = Description of Artificial Sequence: Syntheticoligonucleotide
  source 1..24: mol_type = other DNA
ggctgactctgcgcagagtcagcc

SEQ ID NO: 417 - DNA, 24 bp, synthetic construct
  misc_feature 1..24: note = Description of Artificial Sequence: Syntheticoligonucleotide
  source 1..24: mol_type = other DNA
gcccgactctgcgcagagtcgggc

SEQ ID NO: 418 - DNA, 24 bp, synthetic construct
  misc_feature 1..24: note = Description of Artificial Sequence: Syntheticoligonucleotide
  source 1..24: mol_type = other DNA
acccgactctgcgcagagtcgggt

SEQ ID NO: 419 - DNA, 24 bp, synthetic construct
  misc_feature 1..24: note = Description of Artificial Sequence: Syntheticoligonucleotide
  source 1..24: mol_type = other DNA
gaccgactctgcgcagagtcggtc

SEQ ID NO: 420 - DNA, 24 bp, synthetic construct
  misc_feature 1..24: note = Description of Artificial Sequence: Syntheticoligonucleotide
  source 1..24: mol_type = other DNA
gcacgactctgcgcagagtcgtgc

SEQ ID NO: 421 - DNA, 24 bp, synthetic construct
  misc_feature 1..24: note = Description of Artificial Sequence: Syntheticoligonucleotide
  source 1..24: mol_type = other DNA
gccagactctgcgcagagtctggc

SEQ ID NO: 422 - DNA, 24 bp, synthetic construct
  misc_feature 1..24: note = Description of Artificial Sequence: Syntheticoligonucleotide
  source 1..24: mol_type = other DNA
tcccgactctgcgcagagtcggga

SEQ ID NO: 423 - DNA, 24 bp, synthetic construct
  misc_feature 1..24: note = Description of Artificial Sequence: Syntheticoligonucleotide
  source 1..24: mol_type = other DNA
gtccgactctgcgcagagtcggac

SEQ ID NO: 424 - DNA, 24 bp, synthetic construct
  misc_feature 1..24: note = Description of Artificial Sequence: Syntheticoligonucleotide
  source 1..24: mol_type = other DNA
gcctgactctgcgcagagtcaggc

SEQ ID NO: 425 - DNA, 24 bp, synthetic construct
  misc_feature 1..24: note = Description of Artificial Sequence: Syntheticoligonucleotide
  source 1..24: mol_type = other DNA
gggcgactctgcgcagagtcgccc

SEQ ID NO: 426 - DNA, 24 bp, synthetic construct
  misc_feature 1..24: note = Description of Artificial Sequence: Syntheticoligonucleotide
  source 1..24: mol_type = other DNA
aggcgactctgcgcagagtcgcct

SEQ ID NO: 427 - DNA, 24 bp, synthetic construct
  misc_feature 1..24: note = Description of Artificial Sequence: Syntheticoligonucleotide
  source 1..24: mol_type = other DNA
gagcgactctgcgcagagtcgctc

SEQ ID NO: 428 - DNA, 24 bp, synthetic construct
  misc_feature 1..24: note = Description of Artificial Sequence: Syntheticoligonucleotide
  source 1..24: mol_type = other DNA
ggacgactctgcgcagagtcgtcc

SEQ ID NO: 429 - DNA, 24 bp, synthetic construct
  misc_feature 1..24: note = Description of Artificial Sequence: Syntheticoligonucleotide
  source 1..24: mol_type = other DNA
gggagactctgcgcagagtctccc

SEQ ID NO: 430 - DNA, 24 bp, synthetic construct
  misc_feature 1..24: note = Description of Artificial Sequence: Syntheticoligonucleotide
  source 1..24: mol_type = other DNA
tggcgactctgcgcagagtcgcca

SEQ ID NO: 431 - DNA, 24 bp, synthetic construct
  misc_feature 1..24: note = Description of Artificial Sequence: Syntheticoligonucleotide
  source 1..24: mol_type = other DNA
gtgcgactctgcgcagagtcgcac

SEQ ID NO: 432 - DNA, 24 bp, synthetic construct
  misc_feature 1..24: note = Description of Artificial Sequence: Syntheticoligonucleotide
  source 1..24: mol_type = other DNA
gggtgactctgcgcagagtcaccc

SEQ ID NO: 433 - DNA, 24 bp, synthetic construct
  misc_feature 1..24: note = Description of Artificial Sequence: Syntheticoligonucleotide
  source 1..24: mol_type = other DNA
acgggactctgcgcagagtcccgt

SEQ ID NO: 434 - DNA, 24 bp, synthetic construct
  misc_feature 1..24: note = Description of Artificial Sequence: Syntheticoligonucleotide
  source 1..24: mol_type = other DNA
cagggactctgcgcagagtccctg

SEQ ID NO: 435 - DNA, 24 bp, synthetic construct
  misc_feature 1..24: note = Description of Artificial Sequence: Syntheticoligonucleotide
  source 1..24: mol_type = other DNA
ccaggactctgcgcagagtcctgg

SEQ ID NO: 436 - DNA, 24 bp, synthetic construct
  misc_feature 1..24: note = Description of Artificial Sequence: Syntheticoligonucleotide
  source 1..24: mol_type = other DNA
ccgagactctgcgcagagtctcgg

SEQ ID NO: 437 - DNA, 24 bp, synthetic construct
  misc_feature 1..24: note = Description of Artificial Sequence: Syntheticoligonucleotide
  source 1..24: mol_type = other DNA
tcgggactctgcgcagagtcccga

SEQ ID NO: 438 - DNA, 24 bp, synthetic construct
  misc_feature 1..24: note = Description of Artificial Sequence: Syntheticoligonucleotide
  source 1..24: mol_type = other DNA
ctgggactctgcgcagagtcccag

SEQ ID NO: 439 - DNA, 24 bp, synthetic construct
  misc_feature 1..24: note = Description of Artificial Sequence: Syntheticoligonucleotide
  source 1..24: mol_type = other DNA
cctggactctgcgcagagtccagg

SEQ ID NO: 440 - DNA, 24 bp, synthetic construct
  misc_feature 1..24: note = Description of Artificial Sequence: Syntheticoligonucleotide
  source 1..24: mol_type = other DNA
ccgtgactctgcgcagagtcacgg

SEQ ID NO: 441 - DNA, 24 bp, synthetic construct
  misc_feature 1..24: note = Description of Artificial Sequence: Syntheticoligonucleotide
  source 1..24: mol_type = other DNA
cggcgactctgcgcagagtcgccg

SEQ ID NO: 442 - DNA, 24 bp, synthetic construct
  misc_feature 1..24: note = Description of Artificial Sequence: Syntheticoligonucleotide
  source 1..24: mol_type = other DNA
cagcgactctgcgcagagtcgctg

SEQ ID NO: 443 - DNA, 24 bp, synthetic construct
  misc_feature 1..24: note = Description of Artificial Sequence: Syntheticoligonucleotide
  source 1..24: mol_type = other DNA
cgacgactctgcgcagagtcgtcg

SEQ ID NO: 444 - DNA, 24 bp, synthetic construct
  misc_feature 1..24: note = Description of Artificial Sequence: Syntheticoligonucleotide
  source 1..24: mol_type = other DNA
cggagactctgcgcagagtctccg

SEQ ID NO: 445 - DNA, 24 bp, synthetic construct
  misc_feature 1..24: note = Description of Artificial Sequence: Syntheticoligonucleotide
  source 1..24: mol_type = other DNA
ctgcgactctgcgcagagtcgcag

SEQ ID NO: 446 - DNA, 24 bp, synthetic construct
  misc_feature 1..24: note = Description of Artificial Sequence: Syntheticoligonucleotide
  source 1..24: mol_type = other DNA
cggtgactctgcgcagagtcaccg

SEQ ID NO: 447 - DNA, 24 bp, synthetic construct
  misc_feature 1..24: note = Description of Artificial Sequence: Syntheticoligonucleotide
  source 1..24: mol_type = other DNA
cacggactctgcgcagagtccgtg

SEQ ID NO: 448 - DNA, 24 bp, synthetic construct
  misc_feature 1..24: note = Description of Artificial Sequence: Syntheticoligonucleotide
  source 1..24: mol_type = other DNA
cccagactctgcgcagagtctggg

SEQ ID NO: 449 - DNA, 24 bp, synthetic construct
  misc_feature 1..24: note = Description of Artificial Sequence: Syntheticoligonucleotide
  source 1..24: mol_type = other DNA
ctcggactctgcgcagagtccgag

SEQ ID NO: 450 - DNA, 24 bp, synthetic construct
  misc_feature 1..24: note = Description of Artificial Sequence: Syntheticoligonucleotide
  source 1..24: mol_type = other DNA
ccctgactctgcgcagagtcaggg

SEQ ID NO: 451 - DNA, 24 bp, synthetic construct
  misc_feature 1..24: note = Description of Artificial Sequence: Syntheticoligonucleotide
  source 1..24: mol_type = other DNA
ccacgactctgcgcagagtcgtgg

SEQ ID NO: 452 - DNA, 24 bp, synthetic construct
  misc_feature 1..24: note = Description of Artificial Sequence: Syntheticoligonucleotide
  source 1..24: mol_type = other DNA
agccgactctgcgcagagtcggct

SEQ ID NO: 453 - DNA, 24 bp, synthetic construct
  misc_feature 1..24: note = Description of Artificial Sequence: Syntheticoligonucleotide
  source 1..24: mol_type = other DNA
tgccgactctgcgcagagtcggca

SEQ ID NO: 454 - DNA, 24 bp, synthetic construct
  misc_feature 1..24: note = Description of Artificial Sequence: Syntheticoligonucleotide
  source 1..24: mol_type = other DNA
gcgagactctgcgcagagtctcgc

SEQ ID NO: 455 - DNA, 24 bp, synthetic construct
  misc_feature 1..24: note = Description of Artificial Sequence: Syntheticoligonucleotide
  source 1..24: mol_type = other DNA
gcgtgactctgcgcagagtcacgc

SEQ ID NO: 456 - DNA, 24 bp, synthetic construct
  misc_feature 1..24: note = Description of Artificial Sequence: Syntheticoligonucleotide
  source 1..24: mol_type = other DNA
gcaggactctgcgcagagtcctgc

SEQ ID NO: 457 - DNA, 24 bp, synthetic construct
  misc_feature 1..24: note = Description of Artificial Sequence: Syntheticoligonucleotide
  source 1..24: mol_type = other DNA
gctggactctgcgcagagtccagc

SEQ ID NO: 458 - DNA, 24 bp, synthetic construct
  misc_feature 1..24: note = Description of Artificial Sequence: Syntheticoligonucleotide
  source 1..24: mol_type = other DNA
cgaggactctgcgcagagtcctcg

SEQ ID NO: 459 - DNA, 24 bp, synthetic construct
  misc_feature 1..24: note = Description of Artificial Sequence: Syntheticoligonucleotide
  source 1..24: mol_type = other DNA
cgtggactctgcgcagagtccacg

SEQ ID NO: 460 - DNA, 24 bp, synthetic construct
  misc_feature 1..24: note = Description of Artificial Sequence: Syntheticoligonucleotide
  source 1..24: mol_type = other DNA
caccgactctgcgcagagtcggtg

SEQ ID NO: 461 - DNA, 24 bp, synthetic construct
  misc_feature 1..24: note = Description of Artificial Sequence: Syntheticoligonucleotide
  source 1..24: mol_type = other DNA
ctccgactctgcgcagagtcggag

SEQ ID NO: 462 - DNA, 24 bp, synthetic construct
  misc_feature 1..24: note = Description of Artificial Sequence: Syntheticoligonucleotide
  source 1..24: mol_type = other DNA
gcgggactctgcgcagagtcccgc

SEQ ID NO: 463 - DNA, 24 bp, synthetic construct
  misc_feature 1..24: note = Description of Artificial Sequence: Syntheticoligonucleotide
  source 1..24: mol_type = other DNA
gagggactctgcgcagagtccctc

SEQ ID NO: 464 - DNA, 24 bp, synthetic construct
  misc_feature 1..24: note = Description of Artificial Sequence: Syntheticoligonucleotide
  source 1..24: mol_type = other DNA
gtgggactctgcgcagagtcccac

SEQ ID NO: 465 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcgcatgcgagtcnnnn

SEQ ID NO: 466 - DNA, 24 bp, synthetic construct
  misc_feature 1..24: note = Description of Artificial Sequence: Syntheticoligonucleotide
  source 1..24: mol_type = other DNA
ggcggactcgcatgcgagtccgcc

SEQ ID NO: 467 - DNA, 24 bp, synthetic construct
  misc_feature 1..24: note = Description of Artificial Sequence: Syntheticoligonucleotide
  source 1..24: mol_type = other DNA
agcggactcgcatgcgagtccgct

SEQ ID NO: 468 - DNA, 24 bp, synthetic construct
  misc_feature 1..24: note = Description of Artificial Sequence: Syntheticoligonucleotide
  source 1..24: mol_type = other DNA
gacggactcgcatgcgagtccgtc

SEQ ID NO: 469 - DNA, 24 bp, synthetic construct
  misc_feature 1..24: note = Description of Artificial Sequence: Syntheticoligonucleotide
  source 1..24: mol_type = other DNA
ggaggactcgcatgcgagtcctcc

SEQ ID NO: 470 - DNA, 24 bp, synthetic construct
  misc_feature 1..24: note = Description of Artificial Sequence: Syntheticoligonucleotide
  source 1..24: mol_type = other DNA
ggcagactcgcatgcgagtctgcc

SEQ ID NO: 471 - DNA, 24 bp, synthetic construct
  misc_feature 1..24: note = Description of Artificial Sequence: Syntheticoligonucleotide
  source 1..24: mol_type = other DNA
tgcggactcgcatgcgagtccgca

SEQ ID NO: 472 - DNA, 24 bp, synthetic construct
  misc_feature 1..24: note = Description of Artificial Sequence: Syntheticoligonucleotide
  source 1..24: mol_type = other DNA
gtcggactcgcatgcgagtccgac

SEQ ID NO: 473 - DNA, 24 bp, synthetic construct
  misc_feature 1..24: note = Description of Artificial Sequence: Syntheticoligonucleotide
  source 1..24: mol_type = other DNA
ggtggactcgcatgcgagtccacc

SEQ ID NO: 474 - DNA, 24 bp, synthetic construct
  misc_feature 1..24: note = Description of Artificial Sequence: Syntheticoligonucleotide
  source 1..24: mol_type = other DNA
ggctgactcgcatgcgagtcagcc

SEQ ID NO: 475 - DNA, 24 bp, synthetic construct
  misc_feature 1..24: note = Description of Artificial Sequence: Syntheticoligonucleotide
  source 1..24: mol_type = other DNA
gcccgactcgcatgcgagtcgggc

SEQ ID NO: 476 - DNA, 24 bp, synthetic construct
  misc_feature 1..24: note = Description of Artificial Sequence: Syntheticoligonucleotide
  source 1..24: mol_type = other DNA
acccgactcgcatgcgagtcgggt

SEQ ID NO: 477 - DNA, 24 bp, synthetic construct
  misc_feature 1..24: note = Description of Artificial Sequence: Syntheticoligonucleotide
  source 1..24: mol_type = other DNA
gaccgactcgcatgcgagtcggtc

SEQ ID NO: 478 - DNA, 24 bp, synthetic construct
  misc_feature 1..24: note = Description of Artificial Sequence: Syntheticoligonucleotide
  source 1..24: mol_type = other DNA
gcacgactcgcatgcgagtcgtgc

SEQ ID NO: 479 - DNA, 24 bp, synthetic construct
  misc_feature 1..24: note = Description of Artificial Sequence: Syntheticoligonucleotide
  source 1..24: mol_type = other DNA
gccagactcgcatgcgagtctggc

SEQ ID NO: 480 - DNA, 24 bp, synthetic construct
  misc_feature 1..24: note = Description of Artificial Sequence: Syntheticoligonucleotide
  source 1..24: mol_type = other DNA
tcccgactcgcatgcgagtcggga

SEQ ID NO: 481 - DNA, 24 bp, synthetic construct
  misc_feature 1..24: note = Description of Artificial Sequence: Syntheticoligonucleotide
  source 1..24: mol_type = other DNA
gtccgactcgcatgcgagtcggac

SEQ ID NO: 482 - DNA, 24 bp, synthetic construct
  misc_feature 1..24: note = Description of Artificial Sequence: Syntheticoligonucleotide
  source 1..24: mol_type = other DNA
gcctgactcgcatgcgagtcaggc

SEQ ID NO: 483 - DNA, 24 bp, synthetic construct
  misc_feature 1..24: note = Description of Artificial Sequence: Syntheticoligonucleotide
  source 1..24: mol_type = other DNA
gggcgactcgcatgcgagtcgccc

SEQ ID NO: 484 - DNA, 24 bp, synthetic construct
  misc_feature 1..24: note = Description of Artificial Sequence: Syntheticoligonucleotide
  source 1..24: mol_type = other DNA
aggcgactcgcatgcgagtcgcct

SEQ ID NO: 485 - DNA, 24 bp, synthetic construct
  misc_feature 1..24: note = Description of Artificial Sequence: Syntheticoligonucleotide
  source 1..24: mol_type = other DNA
gagcgactcgcatgcgagtcgctc

SEQ ID NO: 486 - DNA, 24 bp, synthetic construct
  misc_feature 1..24: note = Description of Artificial Sequence: Syntheticoligonucleotide
  source 1..24: mol_type = other DNA
ggacgactcgcatgcgagtcgtcc

SEQ ID NO: 487 - DNA, 24 bp, synthetic construct
  misc_feature 1..24: note = Description of Artificial Sequence: Syntheticoligonucleotide
  source 1..24: mol_type = other DNA
gggagactcgcatgcgagtctccc

SEQ ID NO: 488 - DNA, 24 bp, synthetic construct
  misc_feature 1..24: note = Description of Artificial Sequence: Syntheticoligonucleotide
  source 1..24: mol_type = other DNA
tggcgactcgcatgcgagtcgcca

SEQ ID NO: 489 - DNA, 24 bp, synthetic construct
  misc_feature 1..24: note = Description of Artificial Sequence: Syntheticoligonucleotide
  source 1..24: mol_type = other DNA
gtgcgactcgcatgcgagtcgcac

SEQ ID NO: 490 - DNA, 24 bp, synthetic construct
  misc_feature 1..24: note = Description of Artificial Sequence: Syntheticoligonucleotide
  source 1..24: mol_type = other DNA
gggtgactcgcatgcgagtcaccc

SEQ ID NO: 491 - DNA, 24 bp, synthetic construct
  misc_feature 1..24: note = Description of Artificial Sequence: Syntheticoligonucleotide
  source 1..24: mol_type = other DNA
acgggactcgcatgcgagtcccgt

SEQ ID NO: 492 - DNA, 24 bp, synthetic construct
  misc_feature 1..24: note = Description of Artificial Sequence: Syntheticoligonucleotide
  source 1..24: mol_type = other DNA
cagggactcgcatgcgagtccctg

SEQ ID NO: 493 - DNA, 24 bp, synthetic construct
  misc_feature 1..24: note = Description of Artificial Sequence: Syntheticoligonucleotide
  source 1..24: mol_type = other DNA
ccaggactcgcatgcgagtcctgg

SEQ ID NO: 494 - DNA, 24 bp, synthetic construct
  misc_feature 1..24: note = Description of Artificial Sequence: Syntheticoligonucleotide
  source 1..24: mol_type = other DNA
ccgagactcgcatgcgagtctcgg

SEQ ID NO: 495 - DNA, 24 bp, synthetic construct
  misc_feature 1..24: note = Description of Artificial Sequence: Syntheticoligonucleotide
  source 1..24: mol_type = other DNA
tcgggactcgcatgcgagtcccga

SEQ ID NO: 496 - DNA, 24 bp, synthetic construct
  misc_feature 1..24: note = Description of Artificial Sequence: Syntheticoligonucleotide
  source 1..24: mol_type = other DNA
ctgggactcgcatgcgagtcccag

SEQ ID NO: 497 - DNA, 24 bp, synthetic construct
  misc_feature 1..24: note = Description of Artificial Sequence: Syntheticoligonucleotide
  source 1..24: mol_type = other DNA
cctggactcgcatgcgagtccagg

SEQ ID NO: 498 - DNA, 24 bp, synthetic construct
  misc_feature 1..24: note = Description of Artificial Sequence: Syntheticoligonucleotide
  source 1..24: mol_type = other DNA
ccgtgactcgcatgcgagtcacgg

SEQ ID NO: 499 - DNA, 24 bp, synthetic construct
  misc_feature 1..24: note = Description of Artificial Sequence: Syntheticoligonucleotide
  source 1..24: mol_type = other DNA
cggcgactcgcatgcgagtcgccg

SEQ ID NO: 500 - DNA, 24 bp, synthetic construct
  misc_feature 1..24: note = Description of Artificial Sequence: Syntheticoligonucleotide
  source 1..24: mol_type = other DNA
cagcgactcgcatgcgagtcgctg

SEQ ID NO: 501 - DNA, 24 bp, synthetic construct
  misc_feature 1..24: note = Description of Artificial Sequence: Syntheticoligonucleotide
  source 1..24: mol_type = other DNA
cgacgactcgcatgcgagtcgtcg

SEQ ID NO: 502 - DNA, 24 bp, synthetic construct
  misc_feature 1..24: note = Description of Artificial Sequence: Syntheticoligonucleotide
  source 1..24: mol_type = other DNA
cggagactcgcatgcgagtctccg

SEQ ID NO: 503 - DNA, 24 bp, synthetic construct
  misc_feature 1..24: note = Description of Artificial Sequence: Syntheticoligonucleotide
  source 1..24: mol_type = other DNA
ctgcgactcgcatgcgagtcgcag

SEQ ID NO: 504 - DNA, 24 bp, synthetic construct
  misc_feature 1..24: note = Description of Artificial Sequence: Syntheticoligonucleotide
  source 1..24: mol_type = other DNA
cggtgactcgcatgcgagtcaccg

SEQ ID NO: 505 - DNA, 24 bp, synthetic construct
  misc_feature 1..24: note = Description of Artificial Sequence: Syntheticoligonucleotide
  source 1..24: mol_type = other DNA
cacggactcgcatgcgagtccgtg

SEQ ID NO: 506 - DNA, 24 bp, synthetic construct
  misc_feature 1..24: note = Description of Artificial Sequence: Syntheticoligonucleotide
  source 1..24: mol_type = other DNA
cccagactcgcatgcgagtctggg

SEQ ID NO: 507 - DNA, 24 bp, synthetic construct
  misc_feature 1..24: note = Description of Artificial Sequence: Syntheticoligonucleotide
  source 1..24: mol_type = other DNA
ctcggactcgcatgcgagtccgag

SEQ ID NO: 508 - DNA, 24 bp, synthetic construct
  misc_feature 1..24: note = Description of Artificial Sequence: Syntheticoligonucleotide
  source 1..24: mol_type = other DNA
ccctgactcgcatgcgagtcaggg

SEQ ID NO: 509 - DNA, 24 bp, synthetic construct
  misc_feature 1..24: note = Description of Artificial Sequence: Syntheticoligonucleotide
  source 1..24: mol_type = other DNA
ccacgactcgcatgcgagtcgtgg

SEQ ID NO: 510 - DNA, 24 bp, synthetic construct
  misc_feature 1..24: note = Description of Artificial Sequence: Syntheticoligonucleotide
  source 1..24: mol_type = other DNA
agccgactcgcatgcgagtcggct

SEQ ID NO: 511 - DNA, 24 bp, synthetic construct
  misc_feature 1..24: note = Description of Artificial Sequence: Syntheticoligonucleotide
  source 1..24: mol_type = other DNA
tgccgactcgcatgcgagtcggca

SEQ ID NO: 512 - DNA, 24 bp, synthetic construct
  misc_feature 1..24: note = Description of Artificial Sequence: Syntheticoligonucleotide
  source 1..24: mol_type = other DNA
gcgagactcgcatgcgagtctcgc

SEQ ID NO: 513 - DNA, 24 bp, synthetic construct
  misc_feature 1..24: note = Description of Artificial Sequence: Syntheticoligonucleotide
  source 1..24: mol_type = other DNA
gcgtgactcgcatgcgagtcacgc

SEQ ID NO: 514 - DNA, 24 bp, synthetic construct
  misc_feature 1..24: note = Description of Artificial Sequence: Syntheticoligonucleotide
  source 1..24: mol_type = other DNA
gcaggactcgcatgcgagtcctgc

SEQ ID NO: 515 - DNA, 24 bp, synthetic construct
  misc_feature 1..24: note = Description of Artificial Sequence: Syntheticoligonucleotide
  source 1..24: mol_type = other DNA
gctggactcgcatgcgagtccagc

SEQ ID NO: 516 - DNA, 24 bp, synthetic construct
  misc_feature 1..24: note = Description of Artificial Sequence: Syntheticoligonucleotide
  source 1..24: mol_type = other DNA
cgaggactcgcatgcgagtcctcg

SEQ ID NO: 517 - DNA, 24 bp, synthetic construct
  misc_feature 1..24: note = Description of Artificial Sequence: Syntheticoligonucleotide
  source 1..24: mol_type = other DNA
cgtggactcgcatgcgagtccacg

SEQ ID NO: 518 - DNA, 24 bp, synthetic construct
  misc_feature 1..24: note = Description of Artificial Sequence: Syntheticoligonucleotide
  source 1..24: mol_type = other DNA
caccgactcgcatgcgagtcggtg

SEQ ID NO: 519 - DNA, 24 bp, synthetic construct
  misc_feature 1..24: note = Description of Artificial Sequence: Syntheticoligonucleotide
  source 1..24: mol_type = other DNA
ctccgactcgcatgcgagtcggag

SEQ ID NO: 520 - DNA, 24 bp, synthetic construct
  misc_feature 1..24: note = Description of Artificial Sequence: Syntheticoligonucleotide
  source 1..24: mol_type = other DNA
gcgggactcgcatgcgagtcccgc

SEQ ID NO: 521 - DNA, 24 bp, synthetic construct
  misc_feature 1..24: note = Description of Artificial Sequence: Syntheticoligonucleotide
  source 1..24: mol_type = other DNA
gagggactcgcatgcgagtccctc

SEQ ID NO: 522 - DNA, 24 bp, synthetic construct
  misc_feature 1..24: note = Description of Artificial Sequence: Syntheticoligonucleotide
  source 1..24: mol_type = other DNA
gtgggactcgcatgcgagtcccac

SEQ ID NO: 523 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcgctagcgagtcnnnn

SEQ ID NO: 524 - DNA, 24 bp, synthetic construct
  misc_feature 1..24: note = Description of Artificial Sequence: Syntheticoligonucleotide
  source 1..24: mol_type = other DNA
ggcggactcgctagcgagtccgcc

SEQ ID NO: 525 - DNA, 24 bp, synthetic construct
  misc_feature 1..24: note = Description of Artificial Sequence: Syntheticoligonucleotide
  source 1..24: mol_type = other DNA
agcggactcgctagcgagtccgct

SEQ ID NO: 526 - DNA, 24 bp, synthetic construct
  misc_feature 1..24: note = Description of Artificial Sequence: Syntheticoligonucleotide
  source 1..24: mol_type = other DNA
gacggactcgctagcgagtccgtc

SEQ ID NO: 527 - DNA, 24 bp, synthetic construct
  misc_feature 1..24: note = Description of Artificial Sequence: Syntheticoligonucleotide
  source 1..24: mol_type = other DNA
ggaggactcgctagcgagtcctcc

SEQ ID NO: 528 - DNA, 24 bp, synthetic construct
  misc_feature 1..24: note = Description of Artificial Sequence: Syntheticoligonucleotide
  source 1..24: mol_type = other DNA
ggcagactcgctagcgagtctgcc

SEQ ID NO: 529 - DNA, 24 bp, synthetic construct
  misc_feature 1..24: note = Description of Artificial Sequence: Syntheticoligonucleotide
  source 1..24: mol_type = other DNA
tgcggactcgctagcgagtccgca

SEQ ID NO: 530 - DNA, 24 bp, synthetic construct
  misc_feature 1..24: note = Description of Artificial Sequence: Syntheticoligonucleotide
  source 1..24: mol_type = other DNA
gtcggactcgctagcgagtccgac

SEQ ID NO: 531 - DNA, 24 bp, synthetic construct
  misc_feature 1..24: note = Description of Artificial Sequence: Syntheticoligonucleotide
  source 1..24: mol_type = other DNA
ggtggactcgctagcgagtccacc

SEQ ID NO: 532 - DNA, 24 bp, synthetic construct
  misc_feature 1..24: note = Description of Artificial Sequence: Syntheticoligonucleotide
  source 1..24: mol_type = other DNA
ggctgactcgctagcgagtcagcc

SEQ ID NO: 533 - DNA, 24 bp, synthetic construct
  misc_feature 1..24: note = Description of Artificial Sequence: Syntheticoligonucleotide
  source 1..24: mol_type = other DNA
gcccgactcgctagcgagtcgggc

SEQ ID NO: 534 - DNA, 24 bp, synthetic construct
  misc_feature 1..24: note = Description of Artificial Sequence: Syntheticoligonucleotide
  source 1..24: mol_type = other DNA
acccgactcgctagcgagtcgggt

SEQ ID NO: 535 - DNA, 24 bp, synthetic construct
  misc_feature 1..24: note = Description of Artificial Sequence: Syntheticoligonucleotide
  source 1..24: mol_type = other DNA
gaccgactcgctagcgagtcggtc

SEQ ID NO: 536 - DNA, 24 bp, synthetic construct
  misc_feature 1..24: note = Description of Artificial Sequence: Syntheticoligonucleotide
  source 1..24: mol_type = other DNA
gcacgactcgctagcgagtcgtgc

SEQ ID NO: 537 - DNA, 24 bp, synthetic construct
  misc_feature 1..24: note = Description of Artificial Sequence: Syntheticoligonucleotide
  source 1..24: mol_type = other DNA
gccagactcgctagcgagtctggc

SEQ ID NO: 538 - DNA, 24 bp, synthetic construct
  misc_feature 1..24: note = Description of Artificial Sequence: Syntheticoligonucleotide
  source 1..24: mol_type = other DNA
tcccgactcgctagcgagtcggga

SEQ ID NO: 539 - DNA, 24 bp, synthetic construct
  misc_feature 1..24: note = Description of Artificial Sequence: Syntheticoligonucleotide
  source 1..24: mol_type = other DNA
gtccgactcgctagcgagtcggac

SEQ ID NO: 540 - DNA, 24 bp, synthetic construct
  misc_feature 1..24: note = Description of Artificial Sequence: Syntheticoligonucleotide
  source 1..24: mol_type = other DNA
gcctgactcgctagcgagtcaggc

SEQ ID NO: 541 - DNA, 24 bp, synthetic construct
  misc_feature 1..24: note = Description of Artificial Sequence: Syntheticoligonucleotide
  source 1..24: mol_type = other DNA
gggcgactcgctagcgagtcgccc

SEQ ID NO: 542 - DNA, 24 bp, synthetic construct
  misc_feature 1..24: note = Description of Artificial Sequence: Syntheticoligonucleotide
  source 1..24: mol_type = other DNA
aggcgactcgctagcgagtcgcct

SEQ ID NO: 543 - DNA, 24 bp, synthetic construct
  misc_feature 1..24: note = Description of Artificial Sequence: Syntheticoligonucleotide
  source 1..24: mol_type = other DNA
gagcgactcgctagcgagtcgctc

SEQ ID NO: 544 - DNA, 24 bp, synthetic construct
  misc_feature 1..24: note = Description of Artificial Sequence: Syntheticoligonucleotide
  source 1..24: mol_type = other DNA
ggacgactcgctagcgagtcgtcc

SEQ ID NO: 545 - DNA, 24 bp, synthetic construct
  misc_feature 1..24: note = Description of Artificial Sequence: Syntheticoligonucleotide
  source 1..24: mol_type = other DNA
gggagactcgctagcgagtctccc

SEQ ID NO: 546 - DNA, 24 bp, synthetic construct
  misc_feature 1..24: note = Description of Artificial Sequence: Syntheticoligonucleotide
  source 1..24: mol_type = other DNA
tggcgactcgctagcgagtcgcca

SEQ ID NO: 547 - DNA, 24 bp, synthetic construct
  misc_feature 1..24: note = Description of Artificial Sequence: Syntheticoligonucleotide
  source 1..24: mol_type = other DNA
gtgcgactcgctagcgagtcgcac

SEQ ID NO: 548 - DNA, 24 bp, synthetic construct
  misc_feature 1..24: note = Description of Artificial Sequence: Syntheticoligonucleotide
  source 1..24: mol_type = other DNA
gggtgactcgctagcgagtcaccc

SEQ ID NO: 549 - DNA, 24 bp, synthetic construct
  misc_feature 1..24: note = Description of Artificial Sequence: Syntheticoligonucleotide
  source 1..24: mol_type = other DNA
acgggactcgctagcgagtcccgt

SEQ ID NO: 550 - DNA, 24 bp, synthetic construct
  misc_feature 1..24: note = Description of Artificial Sequence: Syntheticoligonucleotide
  source 1..24: mol_type = other DNA
cagggactcgctagcgagtccctg

SEQ ID NO: 551 - DNA, 24 bp, synthetic construct
  misc_feature 1..24: note = Description of Artificial Sequence: Syntheticoligonucleotide
  source 1..24: mol_type = other DNA
ccaggactcgctagcgagtcctgg

SEQ ID NO: 552 - DNA, 24 bp, synthetic construct
  misc_feature 1..24: note = Description of Artificial Sequence: Syntheticoligonucleotide
  source 1..24: mol_type = other DNA
ccgagactcgctagcgagtctcgg

SEQ ID NO: 553 - DNA, 24 bp, synthetic construct
  misc_feature 1..24: note = Description of Artificial Sequence: Syntheticoligonucleotide
  source 1..24: mol_type = other DNA
tcgggactcgctagcgagtcccga

SEQ ID NO: 554 - DNA, 24 bp, synthetic construct
  misc_feature 1..24: note = Description of Artificial Sequence: Syntheticoligonucleotide
  source 1..24: mol_type = other DNA
ctgggactcgctagcgagtcccag

SEQ ID NO: 555 - DNA, 24 bp, synthetic construct
  misc_feature 1..24: note = Description of Artificial Sequence: Syntheticoligonucleotide
  source 1..24: mol_type = other DNA
cctggactcgctagcgagtccagg

SEQ ID NO: 556 - DNA, 24 bp, synthetic construct
  misc_feature 1..24: note = Description of Artificial Sequence: Syntheticoligonucleotide
  source 1..24: mol_type = other DNA
ccgtgactcgctagcgagtcacgg

SEQ ID NO: 557 - DNA, 24 bp, synthetic construct
  misc_feature 1..24: note = Description of Artificial Sequence: Syntheticoligonucleotide
  source 1..24: mol_type = other DNA
cggcgactcgctagcgagtcgccg

SEQ ID NO: 558 - DNA, 24 bp, synthetic construct
  misc_feature 1..24: note = Description of Artificial Sequence: Syntheticoligonucleotide
  source 1..24: mol_type = other DNA
cagcgactcgctagcgagtcgctg

SEQ ID NO: 559 - DNA, 24 bp, synthetic construct
  misc_feature 1..24: note = Description of Artificial Sequence: Syntheticoligonucleotide
  source 1..24: mol_type = other DNA
cgacgactcgctagcgagtcgtcg

SEQ ID NO: 560 - DNA, 24 bp, synthetic construct
  misc_feature 1..24: note = Description of Artificial Sequence: Syntheticoligonucleotide
  source 1..24: mol_type = other DNA
cggagactcgctagcgagtctccg

SEQ ID NO: 561 - DNA, 24 bp, synthetic construct
  misc_feature 1..24: note = Description of Artificial Sequence: Syntheticoligonucleotide
  source 1..24: mol_type = other DNA
ctgcgactcgctagcgagtcgcag

SEQ ID NO: 562 - DNA, 24 bp, synthetic construct
  misc_feature 1..24: note = Description of Artificial Sequence: Syntheticoligonucleotide
  source 1..24: mol_type = other DNA
cggtgactcgctagcgagtcaccg

SEQ ID NO: 563 - DNA, 24 bp, synthetic construct
  misc_feature 1..24: note = Description of Artificial Sequence: Syntheticoligonucleotide
  source 1..24: mol_type = other DNA
cacggactcgctagcgagtccgtg

SEQ ID NO: 564 - DNA, 24 bp, synthetic construct
  misc_feature 1..24: note = Description of Artificial Sequence: Syntheticoligonucleotide
  source 1..24: mol_type = other DNA
cccagactcgctagcgagtctggg

SEQ ID NO: 565 - DNA, 24 bp, synthetic construct
  misc_feature 1..24: note = Description of Artificial Sequence: Syntheticoligonucleotide
  source 1..24: mol_type = other DNA
ctcggactcgctagcgagtccgag

SEQ ID NO: 566 - DNA, 24 bp, synthetic construct
  misc_feature 1..24: note = Description of Artificial Sequence: Syntheticoligonucleotide
  source 1..24: mol_type = other DNA
ccctgactcgctagcgagtcaggg

SEQ ID NO: 567 - DNA, 24 bp, synthetic construct
  misc_feature 1..24: note = Description of Artificial Sequence: Syntheticoligonucleotide
  source 1..24: mol_type = other DNA
ccacgactcgctagcgagtcgtgg

SEQ ID NO: 568 - DNA, 24 bp, synthetic construct
  misc_feature 1..24: note = Description of Artificial Sequence: Syntheticoligonucleotide
  source 1..24: mol_type = other DNA
agccgactcgctagcgagtcggct

SEQ ID NO: 569 - DNA, 24 bp, synthetic construct
  misc_feature 1..24: note = Description of Artificial Sequence: Syntheticoligonucleotide
  source 1..24: mol_type = other DNA
tgccgactcgctagcgagtcggca

SEQ ID NO: 570 - DNA, 24 bp, synthetic construct
  misc_feature 1..24: note = Description of Artificial Sequence: Syntheticoligonucleotide
  source 1..24: mol_type = other DNA
gcgagactcgctagcgagtctcgc

SEQ ID NO: 571 - DNA, 24 bp, synthetic construct
  misc_feature 1..24: note = Description of Artificial Sequence: Syntheticoligonucleotide
  source 1..24: mol_type = other DNA
gcgtgactcgctagcgagtcacgc

SEQ ID NO: 572 - DNA, 24 bp, synthetic construct
  misc_feature 1..24: note = Description of Artificial Sequence: Syntheticoligonucleotide
  source 1..24: mol_type = other DNA
gcaggactcgctagcgagtcctgc

SEQ ID NO: 573 - DNA, 24 bp, synthetic construct
  misc_feature 1..24: note = Description of Artificial Sequence: Syntheticoligonucleotide
  source 1..24: mol_type = other DNA
gctggactcgctagcgagtccagc

SEQ ID NO: 574 - DNA, 24 bp, synthetic construct
  misc_feature 1..24: note = Description of Artificial Sequence: Syntheticoligonucleotide
  source 1..24: mol_type = other DNA
cgaggactcgctagcgagtcctcg

SEQ ID NO: 575 - DNA, 24 bp, synthetic construct
  misc_feature 1..24: note = Description of Artificial Sequence: Syntheticoligonucleotide
  source 1..24: mol_type = other DNA
cgtggactcgctagcgagtccacg

SEQ ID NO: 576 - DNA, 24 bp, synthetic construct
  misc_feature 1..24: note = Description of Artificial Sequence: Syntheticoligonucleotide
  source 1..24: mol_type = other DNA
caccgactcgctagcgagtcggtg

SEQ ID NO: 577 - DNA, 24 bp, synthetic construct
  misc_feature 1..24: note = Description of Artificial Sequence: Syntheticoligonucleotide
  source 1..24: mol_type = other DNA
ctccgactcgctagcgagtcggag

SEQ ID NO: 578 - DNA, 24 bp, synthetic construct
  misc_feature 1..24: note = Description of Artificial Sequence: Syntheticoligonucleotide
  source 1..24: mol_type = other DNA
gcgggactcgctagcgagtcccgc

SEQ ID NO: 579 - DNA, 24 bp, synthetic construct
  misc_feature 1..24: note = Description of Artificial Sequence: Syntheticoligonucleotide
  source 1..24: mol_type = other DNA
gagggactcgctagcgagtccctc

SEQ ID NO: 580 - DNA, 24 bp, synthetic construct
  misc_feature 1..24: note = Description of Artificial Sequence: Syntheticoligonucleotide
  source 1..24: mol_type = other DNA
gtgggactcgctagcgagtcccac

SEQ ID NO: 581 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcgcgcgcgagtcnnnn

SEQ ID NO: 582 - DNA, 24 bp, synthetic construct
  misc_feature 1..24: note = Description of Artificial Sequence: Syntheticoligonucleotide
  source 1..24: mol_type = other DNA
ggcggactcgcgcgcgagtccgcc

SEQ ID NO: 583 - DNA, 24 bp, synthetic construct
  misc_feature 1..24: note = Description of Artificial Sequence: Syntheticoligonucleotide
  source 1..24: mol_type = other DNA
agcggactcgcgcgcgagtccgct

SEQ ID NO: 584 - DNA, 24 bp, synthetic construct
  misc_feature 1..24: note = Description of Artificial Sequence: Syntheticoligonucleotide
  source 1..24: mol_type = other DNA
gacggactcgcgcgcgagtccgtc

SEQ ID NO: 585 - DNA, 24 bp, synthetic construct
  misc_feature 1..24: note = Description of Artificial Sequence: Syntheticoligonucleotide
  source 1..24: mol_type = other DNA
ggaggactcgcgcgcgagtcctcc

SEQ ID NO: 586 - DNA, 24 bp, synthetic construct
  misc_feature 1..24: note = Description of Artificial Sequence: Syntheticoligonucleotide
  source 1..24: mol_type = other DNA
ggcagactcgcgcgcgagtctgcc

SEQ ID NO: 587 - DNA, 24 bp, synthetic construct
  misc_feature 1..24: note = Description of Artificial Sequence: Syntheticoligonucleotide
  source 1..24: mol_type = other DNA
tgcggactcgcgcgcgagtccgca

SEQ ID NO: 588 - DNA, 24 bp, synthetic construct
  misc_feature 1..24: note = Description of Artificial Sequence: Syntheticoligonucleotide
  source 1..24: mol_type = other DNA
gtcggactcgcgcgcgagtccgac

SEQ ID NO: 589 - DNA, 24 bp, synthetic construct
  misc_feature 1..24: note = Description of Artificial Sequence: Syntheticoligonucleotide
  source 1..24: mol_type = other DNA
ggtggactcgcgcgcgagtccacc

SEQ ID NO: 590 - DNA, 24 bp, synthetic construct
  misc_feature 1..24: note = Description of Artificial Sequence: Syntheticoligonucleotide
  source 1..24: mol_type = other DNA
ggctgactcgcgcgcgagtcagcc

SEQ ID NO: 591 - DNA, 24 bp, synthetic construct
  misc_feature 1..24: note = Description of Artificial Sequence: Syntheticoligonucleotide
  source 1..24: mol_type = other DNA
gcccgactcgcgcgcgagtcgggc

SEQ ID NO: 592 - DNA, 24 bp, synthetic construct
  misc_feature 1..24: note = Description of Artificial Sequence: Syntheticoligonucleotide
  source 1..24: mol_type = other DNA
acccgactcgcgcgcgagtcgggt

SEQ ID NO: 593 - DNA, 24 bp, synthetic construct
  misc_feature 1..24: note = Description of Artificial Sequence: Syntheticoligonucleotide
  source 1..24: mol_type = other DNA
gaccgactcgcgcgcgagtcggtc

SEQ ID NO: 594 - DNA, 24 bp, synthetic construct
  misc_feature 1..24: note = Description of Artificial Sequence: Syntheticoligonucleotide
  source 1..24: mol_type = other DNA
gcacgactcgcgcgcgagtcgtgc

SEQ ID NO: 595 - DNA, 24 bp, synthetic construct
  misc_feature 1..24: note = Description of Artificial Sequence: Syntheticoligonucleotide
  source 1..24: mol_type = other DNA
gccagactcgcgcgcgagtctggc

SEQ ID NO: 596 - DNA, 24 bp, synthetic construct
  misc_feature 1..24: note = Description of Artificial Sequence: Syntheticoligonucleotide
  source 1..24: mol_type = other DNA
tcccgactcgcgcgcgagtcggga

SEQ ID NO: 597 - DNA, 24 bp, synthetic construct
  misc_feature 1..24: note = Description of Artificial Sequence: Syntheticoligonucleotide
  source 1..24: mol_type = other DNA
gtccgactcgcgcgcgagtcggac

SEQ ID NO: 598 - DNA, 24 bp, synthetic construct
  misc_feature 1..24: note = Description of Artificial Sequence: Syntheticoligonucleotide
  source 1..24: mol_type = other DNA
gcctgactcgcgcgcgagtcaggc

SEQ ID NO: 599 - DNA, 24 bp, synthetic construct
  misc_feature 1..24: note = Description of Artificial Sequence: Syntheticoligonucleotide
  source 1..24: mol_type = other DNA
gggcgactcgcgcgcgagtcgccc

SEQ ID NO: 600 - DNA, 24 bp, synthetic construct
  misc_feature 1..24: note = Description of Artificial Sequence: Syntheticoligonucleotide
  source 1..24: mol_type = other DNA
aggcgactcgcgcgcgagtcgcct

SEQ ID NO: 601 - DNA, 24 bp, synthetic construct
  misc_feature 1..24: note = Description of Artificial Sequence: Syntheticoligonucleotide
  source 1..24: mol_type = other DNA
gagcgactcgcgcgcgagtcgctc

SEQ ID NO: 602 - DNA, 24 bp, synthetic construct
  misc_feature 1..24: note = Description of Artificial Sequence: Syntheticoligonucleotide
  source 1..24: mol_type = other DNA
ggacgactcgcgcgcgagtcgtcc

SEQ ID NO: 603 - DNA, 24 bp, synthetic construct
  misc_feature 1..24: note = Description of Artificial Sequence: Syntheticoligonucleotide
  source 1..24: mol_type = other DNA
gggagactcgcgcgcgagtctccc

SEQ ID NO: 604 - DNA, 24 bp, synthetic construct
  misc_feature 1..24: note = Description of Artificial Sequence: Syntheticoligonucleotide
  source 1..24: mol_type = other DNA
tggcgactcgcgcgcgagtcgcca

SEQ ID NO: 605 - DNA, 24 bp, synthetic construct
  misc_feature 1..24: note = Description of Artificial Sequence: Syntheticoligonucleotide
  source 1..24: mol_type = other DNA
gtgcgactcgcgcgcgagtcgcac

SEQ ID NO: 606 - DNA, 24 bp, synthetic construct
  misc_feature 1..24: note = Description of Artificial Sequence: Syntheticoligonucleotide
  source 1..24: mol_type = other DNA
gggtgactcgcgcgcgagtcaccc

SEQ ID NO: 607 - DNA, 24 bp, synthetic construct
  misc_feature 1..24: note = Description of Artificial Sequence: Syntheticoligonucleotide
  source 1..24: mol_type = other DNA
acgggactcgcgcgcgagtcccgt

SEQ ID NO: 608 - DNA, 24 bp, synthetic construct
  misc_feature 1..24: note = Description of Artificial Sequence: Syntheticoligonucleotide
  source 1..24: mol_type = other DNA
cagggactcgcgcgcgagtccctg

SEQ ID NO: 609 - DNA, 24 bp, synthetic construct
  misc_feature 1..24: note = Description of Artificial Sequence: Syntheticoligonucleotide
  source 1..24: mol_type = other DNA
ccaggactcgcgcgcgagtcctgg

SEQ ID NO: 610 - DNA, 24 bp, synthetic construct
  misc_feature 1..24: note = Description of Artificial Sequence: Syntheticoligonucleotide
  source 1..24: mol_type = other DNA
ccgagactcgcgcgcgagtctcgg

SEQ ID NO: 611 - DNA, 24 bp, synthetic construct
  misc_feature 1..24: note = Description of Artificial Sequence: Syntheticoligonucleotide
  source 1..24: mol_type = other DNA
tcgggactcgcgcgcgagtcccga

SEQ ID NO: 612 - DNA, 24 bp, synthetic construct
  misc_feature 1..24: note = Description of Artificial Sequence: Syntheticoligonucleotide
  source 1..24: mol_type = other DNA
ctgggactcgcgcgcgagtcccag

SEQ ID NO: 613 - DNA, 24 bp, synthetic construct
  misc_feature 1..24: note = Description of Artificial Sequence: Syntheticoligonucleotide
  source 1..24: mol_type = other DNA
cctggactcgcgcgcgagtccagg

SEQ ID NO: 614 - DNA, 24 bp, synthetic construct
  misc_feature 1..24: note = Description of Artificial Sequence: Syntheticoligonucleotide
  source 1..24: mol_type = other DNA
ccgtgactcgcgcgcgagtcacgg

SEQ ID NO: 615 - DNA, 24 bp, synthetic construct
  misc_feature 1..24: note = Description of Artificial Sequence: Syntheticoligonucleotide
  source 1..24: mol_type = other DNA
cggcgactcgcgcgcgagtcgccg

SEQ ID NO: 616 - DNA, 24 bp, synthetic construct
  misc_feature 1..24: note = Description of Artificial Sequence: Syntheticoligonucleotide
  source 1..24: mol_type = other DNA
cagcgactcgcgcgcgagtcgctg

SEQ ID NO: 617 - DNA, 24 bp, synthetic construct
  misc_feature 1..24: note = Description of Artificial Sequence: Syntheticoligonucleotide
  source 1..24: mol_type = other DNA
cgacgactcgcgcgcgagtcgtcg

SEQ ID NO: 618 - DNA, 24 bp, synthetic construct
  misc_feature 1..24: note = Description of Artificial Sequence: Syntheticoligonucleotide
  source 1..24: mol_type = other DNA
cggagactcgcgcgcgagtctccg

SEQ ID NO: 619 - DNA, 24 bp, synthetic construct
  misc_feature 1..24: note = Description of Artificial Sequence: Syntheticoligonucleotide
  source 1..24: mol_type = other DNA
ctgcgactcgcgcgcgagtcgcag

SEQ ID NO: 620 - DNA, 24 bp, synthetic construct
  misc_feature 1..24: note = Description of Artificial Sequence: Syntheticoligonucleotide
  source 1..24: mol_type = other DNA
cggtgactcgcgcgcgagtcaccg

SEQ ID NO: 621 - DNA, 24 bp, synthetic construct
  misc_feature 1..24: note = Description of Artificial Sequence: Syntheticoligonucleotide
  source 1..24: mol_type = other DNA
cacggactcgcgcgcgagtccgtg

SEQ ID NO: 622 - DNA, 24 bp, synthetic construct
  misc_feature 1..24: note = Description of Artificial Sequence: Syntheticoligonucleotide
  source 1..24: mol_type = other DNA
cccagactcgcgcgcgagtctggg

SEQ ID NO: 623 - DNA, 24 bp, synthetic construct
  misc_feature 1..24: note = Description of Artificial Sequence: Syntheticoligonucleotide
  source 1..24: mol_type = other DNA
ctcggactcgcgcgcgagtccgag

SEQ ID NO: 624 - DNA, 24 bp, synthetic construct
  misc_feature 1..24: note = Description of Artificial Sequence: Syntheticoligonucleotide
  source 1..24: mol_type = other DNA
ccctgactcgcgcgcgagtcaggg

SEQ ID NO: 625 - DNA, 24 bp, synthetic construct
  misc_feature 1..24: note = Description of Artificial Sequence: Syntheticoligonucleotide
  source 1..24: mol_type = other DNA
ccacgactcgcgcgcgagtcgtgg

SEQ ID NO: 626 - DNA, 24 bp, synthetic construct
  misc_feature 1..24: note = Description of Artificial Sequence: Syntheticoligonucleotide
  source 1..24: mol_type = other DNA
agccgactcgcgcgcgagtcggct

SEQ ID NO: 627 - DNA, 24 bp, synthetic construct
  misc_feature 1..24: note = Description of Artificial Sequence: Syntheticoligonucleotide
  source 1..24: mol_type = other DNA
tgccgactcgcgcgcgagtcggca

SEQ ID NO: 628 - DNA, 24 bp, synthetic construct
  misc_feature 1..24: note = Description of Artificial Sequence: Syntheticoligonucleotide
  source 1..24: mol_type = other DNA
gcgagactcgcgcgcgagtctcgc

SEQ ID NO: 629 - DNA, 24 bp, synthetic construct
  misc_feature 1..24: note = Description of Artificial Sequence: Syntheticoligonucleotide
  source 1..24: mol_type = other DNA
gcgtgactcgcgcgcgagtcacgc

SEQ ID NO: 630 - DNA, 24 bp, synthetic construct
  misc_feature 1..24: note = Description of Artificial Sequence: Syntheticoligonucleotide
  source 1..24: mol_type = other DNA
gcaggactcgcgcgcgagtcctgc

SEQ ID NO: 631 - DNA, 24 bp, synthetic construct
  misc_feature 1..24: note = Description of Artificial Sequence: Syntheticoligonucleotide
  source 1..24: mol_type = other DNA
gctggactcgcgcgcgagtccagc

SEQ ID NO: 632 - DNA, 24 bp, synthetic construct
  misc_feature 1..24: note = Description of Artificial Sequence: Syntheticoligonucleotide
  source 1..24: mol_type = other DNA
cgaggactcgcgcgcgagtcctcg

SEQ ID NO: 633 - DNA, 24 bp, synthetic construct
  misc_feature 1..24: note = Description of Artificial Sequence: Syntheticoligonucleotide
  source 1..24: mol_type = other DNA
cgtggactcgcgcgcgagtccacg

SEQ ID NO: 634 - DNA, 24 bp, synthetic construct
  misc_feature 1..24: note = Description of Artificial Sequence: Syntheticoligonucleotide
  source 1..24: mol_type = other DNA
caccgactcgcgcgcgagtcggtg

SEQ ID NO: 635 - DNA, 24 bp, synthetic construct
  misc_feature 1..24: note = Description of Artificial Sequence: Syntheticoligonucleotide
  source 1..24: mol_type = other DNA
ctccgactcgcgcgcgagtcggag

SEQ ID NO: 636 - DNA, 24 bp, synthetic construct
  misc_feature 1..24: note = Description of Artificial Sequence: Syntheticoligonucleotide
  source 1..24: mol_type = other DNA
gcgggactcgcgcgcgagtcccgc

SEQ ID NO: 637 - DNA, 24 bp, synthetic construct
  misc_feature 1..24: note = Description of Artificial Sequence: Syntheticoligonucleotide
  source 1..24: mol_type = other DNA
gagggactcgcgcgcgagtccctc

SEQ ID NO: 638 - DNA, 24 bp, synthetic construct
  misc_feature 1..24: note = Description of Artificial Sequence: Syntheticoligonucleotide
  source 1..24: mol_type = other DNA
gtgggactcgcgcgcgagtcccac

SEQ ID NO: 639 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcgccggcgagtcnnnn

SEQ ID NO: 640 - DNA, 24 bp, synthetic construct
  misc_feature 1..24: note = Description of Artificial Sequence: Syntheticoligonucleotide
  source 1..24: mol_type = other DNA
ggcggactcgccggcgagtccgcc

SEQ ID NO: 641 - DNA, 24 bp, synthetic construct
  misc_feature 1..24: note = Description of Artificial Sequence: Syntheticoligonucleotide
  source 1..24: mol_type = other DNA
agcggactcgccggcgagtccgct

SEQ ID NO: 642 - DNA, 24 bp, synthetic construct
  misc_feature 1..24: note = Description of Artificial Sequence: Syntheticoligonucleotide
  source 1..24: mol_type = other DNA
gacggactcgccggcgagtccgtc

SEQ ID NO: 643 - DNA, 24 bp, synthetic construct
  misc_feature 1..24: note = Description of Artificial Sequence: Syntheticoligonucleotide
  source 1..24: mol_type = other DNA
ggaggactcgccggcgagtcctcc

SEQ ID NO: 644 - DNA, 24 bp, synthetic construct
  misc_feature 1..24: note = Description of Artificial Sequence: Syntheticoligonucleotide
  source 1..24: mol_type = other DNA
ggcagactcgccggcgagtctgcc

SEQ ID NO: 645 - DNA, 24 bp, synthetic construct
  misc_feature 1..24: note = Description of Artificial Sequence: Syntheticoligonucleotide
  source 1..24: mol_type = other DNA
tgcggactcgccggcgagtccgca

SEQ ID NO: 646 - DNA, 24 bp, synthetic construct
  misc_feature 1..24: note = Description of Artificial Sequence: Syntheticoligonucleotide
  source 1..24: mol_type = other DNA
gtcggactcgccggcgagtccgac

SEQ ID NO: 647 - DNA, 24 bp, synthetic construct
  misc_feature 1..24: note = Description of Artificial Sequence: Syntheticoligonucleotide
  source 1..24: mol_type = other DNA
ggtggactcgccggcgagtccacc

SEQ ID NO: 648 - DNA, 24 bp, synthetic construct
  misc_feature 1..24: note = Description of Artificial Sequence: Syntheticoligonucleotide
  source 1..24: mol_type = other DNA
ggctgactcgccggcgagtcagcc

SEQ ID NO: 649 - DNA, 24 bp, synthetic construct
  misc_feature 1..24: note = Description of Artificial Sequence: Syntheticoligonucleotide
  source 1..24: mol_type = other DNA
gcccgactcgccggcgagtcgggc

SEQ ID NO: 650 - DNA, 24 bp, synthetic construct
  misc_feature 1..24: note = Description of Artificial Sequence: Syntheticoligonucleotide
  source 1..24: mol_type = other DNA
acccgactcgccggcgagtcgggt

SEQ ID NO: 651 - DNA, 24 bp, synthetic construct
  misc_feature 1..24: note = Description of Artificial Sequence: Syntheticoligonucleotide
  source 1..24: mol_type = other DNA
gaccgactcgccggcgagtcggtc

SEQ ID NO: 652 - DNA, 24 bp, synthetic construct
  misc_feature 1..24: note = Description of Artificial Sequence: Syntheticoligonucleotide
  source 1..24: mol_type = other DNA
gcacgactcgccggcgagtcgtgc

SEQ ID NO: 653 - DNA, 24 bp, synthetic construct
  misc_feature 1..24: note = Description of Artificial Sequence: Syntheticoligonucleotide
  source 1..24: mol_type = other DNA
gccagactcgccggcgagtctggc

SEQ ID NO: 654 - DNA, 24 bp, synthetic construct
  misc_feature 1..24: note = Description of Artificial Sequence: Syntheticoligonucleotide
  source 1..24: mol_type = other DNA
tcccgactcgccggcgagtcggga

SEQ ID NO: 655 - DNA, 24 bp, synthetic construct
  misc_feature 1..24: note = Description of Artificial Sequence: Syntheticoligonucleotide
  source 1..24: mol_type = other DNA
gtccgactcgccggcgagtcggac

SEQ ID NO: 656 - DNA, 24 bp, synthetic construct
  misc_feature 1..24: note = Description of Artificial Sequence: Syntheticoligonucleotide
  source 1..24: mol_type = other DNA
gcctgactcgccggcgagtcaggc

SEQ ID NO: 657 - DNA, 24 bp, synthetic construct
  misc_feature 1..24: note = Description of Artificial Sequence: Syntheticoligonucleotide
  source 1..24: mol_type = other DNA
gggcgactcgccggcgagtcgccc

SEQ ID NO: 658 - DNA, 24 bp, synthetic construct
  misc_feature 1..24: note = Description of Artificial Sequence: Syntheticoligonucleotide
  source 1..24: mol_type = other DNA
aggcgactcgccggcgagtcgcct

SEQ ID NO: 659 - DNA, 24 bp, synthetic construct
  misc_feature 1..24: note = Description of Artificial Sequence: Syntheticoligonucleotide
  source 1..24: mol_type = other DNA
gagcgactcgccggcgagtcgctc

SEQ ID NO: 660 - DNA, 24 bp, synthetic construct
  misc_feature 1..24: note = Description of Artificial Sequence: Syntheticoligonucleotide
  source 1..24: mol_type = other DNA
ggacgactcgccggcgagtcgtcc

SEQ ID NO: 661 - DNA, 24 bp, synthetic construct
  misc_feature 1..24: note = Description of Artificial Sequence: Syntheticoligonucleotide
  source 1..24: mol_type = other DNA
gggagactcgccggcgagtctccc

SEQ ID NO: 662 - DNA, 24 bp, synthetic construct
  misc_feature 1..24: note = Description of Artificial Sequence: Syntheticoligonucleotide
  source 1..24: mol_type = other DNA
tggcgactcgccggcgagtcgcca

SEQ ID NO: 663 - DNA, 24 bp, synthetic construct
  misc_feature 1..24: note = Description of Artificial Sequence: Syntheticoligonucleotide
  source 1..24: mol_type = other DNA
gtgcgactcgccggcgagtcgcac

SEQ ID NO: 664 - DNA, 24 bp, synthetic construct
  misc_feature 1..24: note = Description of Artificial Sequence: Syntheticoligonucleotide
  source 1..24: mol_type = other DNA
gggtgactcgccggcgagtcaccc

SEQ ID NO: 665 - DNA, 24 bp, synthetic construct
  misc_feature 1..24: note = Description of Artificial Sequence: Syntheticoligonucleotide
  source 1..24: mol_type = other DNA
acgggactcgccggcgagtcccgt

SEQ ID NO: 666 - DNA, 24 bp, synthetic construct
  misc_feature 1..24: note = Description of Artificial Sequence: Syntheticoligonucleotide
  source 1..24: mol_type = other DNA
cagggactcgccggcgagtccctg

SEQ ID NO: 667 - DNA, 24 bp, synthetic construct
  misc_feature 1..24: note = Description of Artificial Sequence: Syntheticoligonucleotide
  source 1..24: mol_type = other DNA
ccaggactcgccggcgagtcctgg

SEQ ID NO: 668 - DNA, 24 bp, synthetic construct
  misc_feature 1..24: note = Description of Artificial Sequence: Syntheticoligonucleotide
  source 1..24: mol_type = other DNA
ccgagactcgccggcgagtctcgg

SEQ ID NO: 669 - DNA, 24 bp, synthetic construct
  misc_feature 1..24: note = Description of Artificial Sequence: Syntheticoligonucleotide
  source 1..24: mol_type = other DNA
tcgggactcgccggcgagtcccga

SEQ ID NO: 670 - DNA, 24 bp, synthetic construct
  misc_feature 1..24: note = Description of Artificial Sequence: Syntheticoligonucleotide
  source 1..24: mol_type = other DNA
ctgggactcgccggcgagtcccag

SEQ ID NO: 671 - DNA, 24 bp, synthetic construct
  misc_feature 1..24: note = Description of Artificial Sequence: Syntheticoligonucleotide
  source 1..24: mol_type = other DNA
cctggactcgccggcgagtccagg

SEQ ID NO: 672 - DNA, 24 bp, synthetic construct
  misc_feature 1..24: note = Description of Artificial Sequence: Syntheticoligonucleotide
  source 1..24: mol_type = other DNA
ccgtgactcgccggcgagtcacgg

SEQ ID NO: 673 - DNA, 24 bp, synthetic construct
  misc_feature 1..24: note = Description of Artificial Sequence: Syntheticoligonucleotide
  source 1..24: mol_type = other DNA
cggcgactcgccggcgagtcgccg

SEQ ID NO: 674 - DNA, 24 bp, synthetic construct
  misc_feature 1..24: note = Description of Artificial Sequence: Syntheticoligonucleotide
  source 1..24: mol_type = other DNA
cagcgactcgccggcgagtcgctg

SEQ ID NO: 675 - DNA, 24 bp, synthetic construct
  misc_feature 1..24: note = Description of Artificial Sequence: Syntheticoligonucleotide
  source 1..24: mol_type = other DNA
cgacgactcgccggcgagtcgtcg

SEQ ID NO: 676 - DNA, 24 bp, synthetic construct
  misc_feature 1..24: note = Description of Artificial Sequence: Syntheticoligonucleotide
  source 1..24: mol_type = other DNA
cggagactcgccggcgagtctccg

SEQ ID NO: 677 - DNA, 24 bp, synthetic construct
  misc_feature 1..24: note = Description of Artificial Sequence: Syntheticoligonucleotide
  source 1..24: mol_type = other DNA
ctgcgactcgccggcgagtcgcag

SEQ ID NO: 678 - DNA, 24 bp, synthetic construct
  misc_feature 1..24: note = Description of Artificial Sequence: Syntheticoligonucleotide
  source 1..24: mol_type = other DNA
cggtgactcgccggcgagtcaccg

SEQ ID NO: 679 - DNA, 24 bp, synthetic construct
  misc_feature 1..24: note = Description of Artificial Sequence: Syntheticoligonucleotide
  source 1..24: mol_type = other DNA
cacggactcgccggcgagtccgtg

SEQ ID NO: 680 - DNA, 24 bp, synthetic construct
  misc_feature 1..24: note = Description of Artificial Sequence: Syntheticoligonucleotide
  source 1..24: mol_type = other DNA
cccagactcgccggcgagtctggg

SEQ ID NO: 681 - DNA, 24 bp, synthetic construct
  misc_feature 1..24: note = Description of Artificial Sequence: Syntheticoligonucleotide
  source 1..24: mol_type = other DNA
ctcggactcgccggcgagtccgag

SEQ ID NO: 682 - DNA, 24 bp, synthetic construct
  misc_feature 1..24: note = Description of Artificial Sequence: Syntheticoligonucleotide
  source 1..24: mol_type = other DNA
ccctgactcgccggcgagtcaggg

SEQ ID NO: 683 - DNA, 24 bp, synthetic construct
  misc_feature 1..24: note = Description of Artificial Sequence: Syntheticoligonucleotide
  source 1..24: mol_type = other DNA
ccacgactcgccggcgagtcgtgg

SEQ ID NO: 684 - DNA, 24 bp, synthetic construct
  misc_feature 1..24: note = Description of Artificial Sequence: Syntheticoligonucleotide
  source 1..24: mol_type = other DNA
agccgactcgccggcgagtcggct

SEQ ID NO: 685 - DNA, 24 bp, synthetic construct
  misc_feature 1..24: note = Description of Artificial Sequence: Syntheticoligonucleotide
  source 1..24: mol_type = other DNA
tgccgactcgccggcgagtcggca

SEQ ID NO: 686 - DNA, 24 bp, synthetic construct
  misc_feature 1..24: note = Description of Artificial Sequence: Syntheticoligonucleotide
  source 1..24: mol_type = other DNA
gcgagactcgccggcgagtctcgc

SEQ ID NO: 687 - DNA, 24 bp, synthetic construct
  misc_feature 1..24: note = Description of Artificial Sequence: Syntheticoligonucleotide
  source 1..24: mol_type = other DNA
gcgtgactcgccggcgagtcacgc

SEQ ID NO: 688 - DNA, 24 bp, synthetic construct
  misc_feature 1..24: note = Description of Artificial Sequence: Syntheticoligonucleotide
  source 1..24: mol_type = other DNA
gcaggactcgccggcgagtcctgc

SEQ ID NO: 689 - DNA, 24 bp, synthetic construct
  misc_feature 1..24: note = Description of Artificial Sequence: Syntheticoligonucleotide
  source 1..24: mol_type = other DNA
gctggactcgccggcgagtccagc

SEQ ID NO: 690 - DNA, 24 bp, synthetic construct
  misc_feature 1..24: note = Description of Artificial Sequence: Syntheticoligonucleotide
  source 1..24: mol_type = other DNA
cgaggactcgccggcgagtcctcg

SEQ ID NO: 691 - DNA, 24 bp, synthetic construct
  misc_feature 1..24: note = Description of Artificial Sequence: Syntheticoligonucleotide
  source 1..24: mol_type = other DNA
cgtggactcgccggcgagtccacg

SEQ ID NO: 692 - DNA, 24 bp, synthetic construct
  misc_feature 1..24: note = Description of Artificial Sequence: Syntheticoligonucleotide
  source 1..24: mol_type = other DNA
caccgactcgccggcgagtcggtg

SEQ ID NO: 693 - DNA, 24 bp, synthetic construct
  misc_feature 1..24: note = Description of Artificial Sequence: Syntheticoligonucleotide
  source 1..24: mol_type = other DNA
ctccgactcgccggcgagtcggag

SEQ ID NO: 694 - DNA, 24 bp, synthetic construct
  misc_feature 1..24: note = Description of Artificial Sequence: Syntheticoligonucleotide
  source 1..24: mol_type = other DNA
gcgggactcgccggcgagtcccgc

SEQ ID NO: 695 - DNA, 24 bp, synthetic construct
  misc_feature 1..24: note = Description of Artificial Sequence: Syntheticoligonucleotide
  source 1..24: mol_type = other DNA
gagggactcgccggcgagtccctc

SEQ ID NO: 696 - DNA, 24 bp, synthetic construct
  misc_feature 1..24: note = Description of Artificial Sequence: Syntheticoligonucleotide
  source 1..24: mol_type = other DNA
gtgggactcgccggcgagtcccac

SEQ ID NO: 697 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcacatgtgagtcnnnn

SEQ ID NO: 698 - DNA, 24 bp, synthetic construct
  misc_feature 1..24: note = Description of Artificial Sequence: Syntheticoligonucleotide
  source 1..24: mol_type = other DNA
ggcggactcacatgtgagtccgcc

SEQ ID NO: 699 - DNA, 24 bp, synthetic construct
  misc_feature 1..24: note = Description of Artificial Sequence: Syntheticoligonucleotide
  source 1..24: mol_type = other DNA
agcggactcacatgtgagtccgct

SEQ ID NO: 700 - DNA, 24 bp, synthetic construct
  misc_feature 1..24: note = Description of Artificial Sequence: Syntheticoligonucleotide
  source 1..24: mol_type = other DNA
gacggactcacatgtgagtccgtc

SEQ ID NO: 701 - DNA, 24 bp, synthetic construct
  misc_feature 1..24: note = Description of Artificial Sequence: Syntheticoligonucleotide
  source 1..24: mol_type = other DNA
ggaggactcacatgtgagtcctcc

SEQ ID NO: 702 - DNA, 24 bp, synthetic construct
  misc_feature 1..24: note = Description of Artificial Sequence: Syntheticoligonucleotide
  source 1..24: mol_type = other DNA
ggcagactcacatgtgagtctgcc

SEQ ID NO: 703 - DNA, 24 bp, synthetic construct
  misc_feature 1..24: note = Description of Artificial Sequence: Syntheticoligonucleotide
  source 1..24: mol_type = other DNA
tgcggactcacatgtgagtccgca

SEQ ID NO: 704 - DNA, 24 bp, synthetic construct
  misc_feature 1..24: note = Description of Artificial Sequence: Syntheticoligonucleotide
  source 1..24: mol_type = other DNA
gtcggactcacatgtgagtccgac

SEQ ID NO: 705 - DNA, 24 bp, synthetic construct
  misc_feature 1..24: note = Description of Artificial Sequence: Syntheticoligonucleotide
  source 1..24: mol_type = other DNA
ggtggactcacatgtgagtccacc

SEQ ID NO: 706 - DNA, 24 bp, synthetic construct
  misc_feature 1..24: note = Description of Artificial Sequence: Syntheticoligonucleotide
  source 1..24: mol_type = other DNA
ggctgactcacatgtgagtcagcc

SEQ ID NO: 707 - DNA, 24 bp, synthetic construct
  misc_feature 1..24: note = Description of Artificial Sequence: Syntheticoligonucleotide
  source 1..24: mol_type = other DNA
gcccgactcacatgtgagtcgggc

SEQ ID NO: 708 - DNA, 24 bp, synthetic construct
  misc_feature 1..24: note = Description of Artificial Sequence: Syntheticoligonucleotide
  source 1..24: mol_type = other DNA
acccgactcacatgtgagtcgggt

SEQ ID NO: 709 - DNA, 24 bp, synthetic construct
  misc_feature 1..24: note = Description of Artificial Sequence: Syntheticoligonucleotide
  source 1..24: mol_type = other DNA
gaccgactcacatgtgagtcggtc

SEQ ID NO: 710 - DNA, 24 bp, synthetic construct
  misc_feature 1..24: note = Description of Artificial Sequence: Syntheticoligonucleotide
  source 1..24: mol_type = other DNA
gcacgactcacatgtgagtcgtgc

SEQ ID NO: 711 - DNA, 24 bp, synthetic construct
  misc_feature 1..24: note = Description of Artificial Sequence: Syntheticoligonucleotide
  source 1..24: mol_type = other DNA
gccagactcacatgtgagtctggc

SEQ ID NO: 712 - DNA, 24 bp, synthetic construct
  misc_feature 1..24: note = Description of Artificial Sequence: Syntheticoligonucleotide
  source 1..24: mol_type = other DNA
tcccgactcacatgtgagtcggga

SEQ ID NO: 713 - DNA, 24 bp, synthetic construct
  misc_feature 1..24: note = Description of Artificial Sequence: Syntheticoligonucleotide
  source 1..24: mol_type = other DNA
gtccgactcacatgtgagtcggac

SEQ ID NO: 714 - DNA, 24 bp, synthetic construct
  misc_feature 1..24: note = Description of Artificial Sequence: Syntheticoligonucleotide
  source 1..24: mol_type = other DNA
gcctgactcacatgtgagtcaggc

SEQ ID NO: 715 - DNA, 24 bp, synthetic construct
  misc_feature 1..24: note = Description of Artificial Sequence: Syntheticoligonucleotide
  source 1..24: mol_type = other DNA
gggcgactcacatgtgagtcgccc

SEQ ID NO: 716 - DNA, 24 bp, synthetic construct
  misc_feature 1..24: note = Description of Artificial Sequence: Syntheticoligonucleotide
  source 1..24: mol_type = other DNA
aggcgactcacatgtgagtcgcct

SEQ ID NO: 717 - DNA, 24 bp, synthetic construct
  misc_feature 1..24: note = Description of Artificial Sequence: Syntheticoligonucleotide
  source 1..24: mol_type = other DNA
gagcgactcacatgtgagtcgctc

SEQ ID NO: 718 - DNA, 24 bp, synthetic construct
  misc_feature 1..24: note = Description of Artificial Sequence: Syntheticoligonucleotide
  source 1..24: mol_type = other DNA
ggacgactcacatgtgagtcgtcc

SEQ ID NO: 719 - DNA, 24 bp, synthetic construct
  misc_feature 1..24: note = Description of Artificial Sequence: Syntheticoligonucleotide
  source 1..24: mol_type = other DNA
gggagactcacatgtgagtctccc

SEQ ID NO: 720 - DNA, 24 bp, synthetic construct
  misc_feature 1..24: note = Description of Artificial Sequence: Syntheticoligonucleotide
  source 1..24: mol_type = other DNA
tggcgactcacatgtgagtcgcca

SEQ ID NO: 721 - DNA, 24 bp, synthetic construct
  misc_feature 1..24: note = Description of Artificial Sequence: Syntheticoligonucleotide
  source 1..24: mol_type = other DNA
gtgcgactcacatgtgagtcgcac

SEQ ID NO: 722 - DNA, 24 bp, synthetic construct
  misc_feature 1..24: note = Description of Artificial Sequence: Syntheticoligonucleotide
  source 1..24: mol_type = other DNA
gggtgactcacatgtgagtcaccc

SEQ ID NO: 723 - DNA, 24 bp, synthetic construct
  misc_feature 1..24: note = Description of Artificial Sequence: Syntheticoligonucleotide
  source 1..24: mol_type = other DNA
acgggactcacatgtgagtcccgt

SEQ ID NO: 724 - DNA, 24 bp, synthetic construct
  misc_feature 1..24: note = Description of Artificial Sequence: Syntheticoligonucleotide
  source 1..24: mol_type = other DNA
cagggactcacatgtgagtccctg

SEQ ID NO: 725 - DNA, 24 bp, synthetic construct
  misc_feature 1..24: note = Description of Artificial Sequence: Syntheticoligonucleotide
  source 1..24: mol_type = other DNA
ccaggactcacatgtgagtcctgg

SEQ ID NO: 726 - DNA, 24 bp, synthetic construct
  misc_feature 1..24: note = Description of Artificial Sequence: Syntheticoligonucleotide
  source 1..24: mol_type = other DNA
ccgagactcacatgtgagtctcgg

SEQ ID NO: 727 - DNA, 24 bp, synthetic construct
  misc_feature 1..24: note = Description of Artificial Sequence: Syntheticoligonucleotide
  source 1..24: mol_type = other DNA
tcgggactcacatgtgagtcccga

SEQ ID NO: 728 - DNA, 24 bp, synthetic construct
  misc_feature 1..24: note = Description of Artificial Sequence: Syntheticoligonucleotide
  source 1..24: mol_type = other DNA
ctgggactcacatgtgagtcccag

SEQ ID NO: 729 - DNA, 24 bp, synthetic construct
  misc_feature 1..24: note = Description of Artificial Sequence: Syntheticoligonucleotide
  source 1..24: mol_type = other DNA
cctggactcacatgtgagtccagg

SEQ ID NO: 730 - DNA, 24 bp, synthetic construct
  misc_feature 1..24: note = Description of Artificial Sequence: Syntheticoligonucleotide
  source 1..24: mol_type = other DNA
ccgtgactcacatgtgagtcacgg

SEQ ID NO: 731 - DNA, 24 bp, synthetic construct
  misc_feature 1..24: note = Description of Artificial Sequence: Syntheticoligonucleotide
  source 1..24: mol_type = other DNA
cggcgactcacatgtgagtcgccg

SEQ ID NO: 732 - DNA, 24 bp, synthetic construct
  misc_feature 1..24: note = Description of Artificial Sequence: Syntheticoligonucleotide
  source 1..24: mol_type = other DNA
cagcgactcacatgtgagtcgctg

SEQ ID NO: 733 - DNA, 24 bp, synthetic construct
  misc_feature 1..24: note = Description of Artificial Sequence: Syntheticoligonucleotide
  source 1..24: mol_type = other DNA
cgacgactcacatgtgagtcgtcg

SEQ ID NO: 734 - DNA, 24 bp, synthetic construct
  misc_feature 1..24: note = Description of Artificial Sequence: Syntheticoligonucleotide
  source 1..24: mol_type = other DNA
cggagactcacatgtgagtctccg

SEQ ID NO: 735 - DNA, 24 bp, synthetic construct
  misc_feature 1..24: note = Description of Artificial Sequence: Syntheticoligonucleotide
  source 1..24: mol_type = other DNA
ctgcgactcacatgtgagtcgcag

SEQ ID NO: 736 - DNA, 24 bp, synthetic construct
  misc_feature 1..24: note = Description of Artificial Sequence: Syntheticoligonucleotide
  source 1..24: mol_type = other DNA
cggtgactcacatgtgagtcaccg

SEQ ID NO: 737 - DNA, 24 bp, synthetic construct
  misc_feature 1..24: note = Description of Artificial Sequence: Syntheticoligonucleotide
  source 1..24: mol_type = other DNA
cacggactcacatgtgagtccgtg

SEQ ID NO: 738 - DNA, 24 bp, synthetic construct
  misc_feature 1..24: note = Description of Artificial Sequence: Syntheticoligonucleotide
  source 1..24: mol_type = other DNA
cccagactcacatgtgagtctggg

SEQ ID NO: 739 - DNA, 24 bp, synthetic construct
  misc_feature 1..24: note = Description of Artificial Sequence: Syntheticoligonucleotide
  source 1..24: mol_type = other DNA
ctcggactcacatgtgagtccgag

SEQ ID NO: 740 - DNA, 24 bp, synthetic construct
  misc_feature 1..24: note = Description of Artificial Sequence: Syntheticoligonucleotide
  source 1..24: mol_type = other DNA
ccctgactcacatgtgagtcaggg

SEQ ID NO: 741 - DNA, 24 bp, synthetic construct
  misc_feature 1..24: note = Description of Artificial Sequence: Syntheticoligonucleotide
  source 1..24: mol_type = other DNA
ccacgactcacatgtgagtcgtgg

SEQ ID NO: 742 - DNA, 24 bp, synthetic construct
  misc_feature 1..24: note = Description of Artificial Sequence: Syntheticoligonucleotide
  source 1..24: mol_type = other DNA
agccgactcacatgtgagtcggct

SEQ ID NO: 743 - DNA, 24 bp, synthetic construct
  misc_feature 1..24: note = Description of Artificial Sequence: Syntheticoligonucleotide
  source 1..24: mol_type = other DNA
tgccgactcacatgtgagtcggca

SEQ ID NO: 744 - DNA, 24 bp, synthetic construct
  misc_feature 1..24: note = Description of Artificial Sequence: Syntheticoligonucleotide
  source 1..24: mol_type = other DNA
gcgagactcacatgtgagtctcgc

SEQ ID NO: 745 - DNA, 24 bp, synthetic construct
  misc_feature 1..24: note = Description of Artificial Sequence: Syntheticoligonucleotide
  source 1..24: mol_type = other DNA
gcgtgactcacatgtgagtcacgc

SEQ ID NO: 746 - DNA, 24 bp, synthetic construct
  misc_feature 1..24: note = Description of Artificial Sequence: Syntheticoligonucleotide
  source 1..24: mol_type = other DNA
gcaggactcacatgtgagtcctgc

SEQ ID NO: 747 - DNA, 24 bp, synthetic construct
  misc_feature 1..24: note = Description of Artificial Sequence: Syntheticoligonucleotide
  source 1..24: mol_type = other DNA
gctggactcacatgtgagtccagc

SEQ ID NO: 748 - DNA, 24 bp, synthetic construct
  misc_feature 1..24: note = Description of Artificial Sequence: Syntheticoligonucleotide
  source 1..24: mol_type = other DNA
cgaggactcacatgtgagtcctcg

SEQ ID NO: 749 - DNA, 24 bp, synthetic construct
  misc_feature 1..24: note = Description of Artificial Sequence: Syntheticoligonucleotide
  source 1..24: mol_type = other DNA
cgtggactcacatgtgagtccacg

SEQ ID NO: 750 - DNA, 24 bp, synthetic construct
  misc_feature 1..24: note = Description of Artificial Sequence: Syntheticoligonucleotide
  source 1..24: mol_type = other DNA
caccgactcacatgtgagtcggtg

SEQ ID NO: 751 - DNA, 24 bp, synthetic construct
  misc_feature 1..24: note = Description of Artificial Sequence: Syntheticoligonucleotide
  source 1..24: mol_type = other DNA
ctccgactcacatgtgagtcggag

SEQ ID NO: 752 - DNA, 24 bp, synthetic construct
  misc_feature 1..24: note = Description of Artificial Sequence: Syntheticoligonucleotide
  source 1..24: mol_type = other DNA
gcgggactcacatgtgagtcccgc

SEQ ID NO: 753 - DNA, 24 bp, synthetic construct
  misc_feature 1..24: note = Description of Artificial Sequence: Syntheticoligonucleotide
  source 1..24: mol_type = other DNA
gagggactcacatgtgagtccctc

SEQ ID NO: 754 - DNA, 24 bp, synthetic construct
  misc_feature 1..24: note = Description of Artificial Sequence: Syntheticoligonucleotide
  source 1..24: mol_type = other DNA
gtgggactcacatgtgagtcccac

SEQ ID NO: 755 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcactagtgagtcnnnn

SEQ ID NO: 756 - DNA, 24 bp, synthetic construct
  misc_feature 1..24: note = Description of Artificial Sequence: Syntheticoligonucleotide
  source 1..24: mol_type = other DNA
ggcggactcactagtgagtccgcc

SEQ ID NO: 757 - DNA, 24 bp, synthetic construct
  misc_feature 1..24: note = Description of Artificial Sequence: Syntheticoligonucleotide
  source 1..24: mol_type = other DNA
agcggactcactagtgagtccgct

SEQ ID NO: 758 - DNA, 24 bp, synthetic construct
  misc_feature 1..24: note = Description of Artificial Sequence: Syntheticoligonucleotide
  source 1..24: mol_type = other DNA
gacggactcactagtgagtccgtc

SEQ ID NO: 759 - DNA, 24 bp, synthetic construct
  misc_feature 1..24: note = Description of Artificial Sequence: Syntheticoligonucleotide
  source 1..24: mol_type = other DNA
ggaggactcactagtgagtcctcc

SEQ ID NO: 760 - DNA, 24 bp, synthetic construct
  misc_feature 1..24: note = Description of Artificial Sequence: Syntheticoligonucleotide
  source 1..24: mol_type = other DNA
ggcagactcactagtgagtctgcc

SEQ ID NO: 761 - DNA, 24 bp, synthetic construct
  misc_feature 1..24: note = Description of Artificial Sequence: Syntheticoligonucleotide
  source 1..24: mol_type = other DNA
tgcggactcactagtgagtccgca

SEQ ID NO: 762 - DNA, 24 bp, synthetic construct
  misc_feature 1..24: note = Description of Artificial Sequence: Syntheticoligonucleotide
  source 1..24: mol_type = other DNA
gtcggactcactagtgagtccgac

SEQ ID NO: 763 - DNA, 24 bp, synthetic construct
  misc_feature 1..24: note = Description of Artificial Sequence: Syntheticoligonucleotide
  source 1..24: mol_type = other DNA
ggtggactcactagtgagtccacc

SEQ ID NO: 764 - DNA, 24 bp, synthetic construct
  misc_feature 1..24: note = Description of Artificial Sequence: Syntheticoligonucleotide
  source 1..24: mol_type = other DNA
ggctgactcactagtgagtcagcc

SEQ ID NO: 765 - DNA, 24 bp, synthetic construct
  misc_feature 1..24: note = Description of Artificial Sequence: Syntheticoligonucleotide
  source 1..24: mol_type = other DNA
gcccgactcactagtgagtcgggc

SEQ ID NO: 766 - DNA, 24 bp, synthetic construct
  misc_feature 1..24: note = Description of Artificial Sequence: Syntheticoligonucleotide
  source 1..24: mol_type = other DNA
acccgactcactagtgagtcgggt

SEQ ID NO: 767 - DNA, 24 bp, synthetic construct
  misc_feature 1..24: note = Description of Artificial Sequence: Syntheticoligonucleotide
  source 1..24: mol_type = other DNA
gaccgactcactagtgagtcggtc

SEQ ID NO: 768 - DNA, 24 bp, synthetic construct
  misc_feature 1..24: note = Description of Artificial Sequence: Syntheticoligonucleotide
  source 1..24: mol_type = other DNA
gcacgactcactagtgagtcgtgc

SEQ ID NO: 769 - DNA, 24 bp, synthetic construct
  misc_feature 1..24: note = Description of Artificial Sequence: Syntheticoligonucleotide
  source 1..24: mol_type = other DNA
gccagactcactagtgagtctggc

SEQ ID NO: 770 - DNA, 24 bp, synthetic construct
  misc_feature 1..24: note = Description of Artificial Sequence: Syntheticoligonucleotide
  source 1..24: mol_type = other DNA
tcccgactcactagtgagtcggga

SEQ ID NO: 771 - DNA, 24 bp, synthetic construct
  misc_feature 1..24: note = Description of Artificial Sequence: Syntheticoligonucleotide
  source 1..24: mol_type = other DNA
gtccgactcactagtgagtcggac

SEQ ID NO: 772 - DNA, 24 bp, synthetic construct
  misc_feature 1..24: note = Description of Artificial Sequence: Syntheticoligonucleotide
  source 1..24: mol_type = other DNA
gcctgactcactagtgagtcaggc

SEQ ID NO: 773 - DNA, 24 bp, synthetic construct
  misc_feature 1..24: note = Description of Artificial Sequence: Syntheticoligonucleotide
  source 1..24: mol_type = other DNA
gggcgactcactagtgagtcgccc

SEQ ID NO: 774 - DNA, 24 bp, synthetic construct
  misc_feature 1..24: note = Description of Artificial Sequence: Syntheticoligonucleotide
  source 1..24: mol_type = other DNA
aggcgactcactagtgagtcgcct

SEQ ID NO: 775 - DNA, 24 bp, synthetic construct
  misc_feature 1..24: note = Description of Artificial Sequence: Syntheticoligonucleotide
  source 1..24: mol_type = other DNA
gagcgactcactagtgagtcgctc

SEQ ID NO: 776 - DNA, 24 bp, synthetic construct
  misc_feature 1..24: note = Description of Artificial Sequence: Syntheticoligonucleotide
  source 1..24: mol_type = other DNA
ggacgactcactagtgagtcgtcc

SEQ ID NO: 777 - DNA, 24 bp, synthetic construct
  misc_feature 1..24: note = Description of Artificial Sequence: Syntheticoligonucleotide
  source 1..24: mol_type = other DNA
gggagactcactagtgagtctccc

SEQ ID NO: 778 - DNA, 24 bp, synthetic construct
  misc_feature 1..24: note = Description of Artificial Sequence: Syntheticoligonucleotide
  source 1..24: mol_type = other DNA
tggcgactcactagtgagtcgcca

SEQ ID NO: 779 - DNA, 24 bp, synthetic construct
  misc_feature 1..24: note = Description of Artificial Sequence: Syntheticoligonucleotide
  source 1..24: mol_type = other DNA
gtgcgactcactagtgagtcgcac

SEQ ID NO: 780 - DNA, 24 bp, synthetic construct
  misc_feature 1..24: note = Description of Artificial Sequence: Syntheticoligonucleotide
  source 1..24: mol_type = other DNA
gggtgactcactagtgagtcaccc

SEQ ID NO: 781 - DNA, 24 bp, synthetic construct
  misc_feature 1..24: note = Description of Artificial Sequence: Syntheticoligonucleotide
  source 1..24: mol_type = other DNA
acgggactcactagtgagtcccgt

SEQ ID NO: 782 - DNA, 24 bp, synthetic construct
  misc_feature 1..24: note = Description of Artificial Sequence: Syntheticoligonucleotide
  source 1..24: mol_type = other DNA
cagggactcactagtgagtccctg

SEQ ID NO: 783 - DNA, 24 bp, synthetic construct
  misc_feature 1..24: note = Description of Artificial Sequence: Syntheticoligonucleotide
  source 1..24: mol_type = other DNA
ccaggactcactagtgagtcctgg

SEQ ID NO: 784 - DNA, 24 bp, synthetic construct
  misc_feature 1..24: note = Description of Artificial Sequence: Syntheticoligonucleotide
  source 1..24: mol_type = other DNA
ccgagactcactagtgagtctcgg

SEQ ID NO: 785 - DNA, 24 bp, synthetic construct
  misc_feature 1..24: note = Description of Artificial Sequence: Syntheticoligonucleotide
  source 1..24: mol_type = other DNA
tcgggactcactagtgagtcccga

SEQ ID NO: 786 - DNA, 24 bp, synthetic construct
  misc_feature 1..24: note = Description of Artificial Sequence: Syntheticoligonucleotide
  source 1..24: mol_type = other DNA
ctgggactcactagtgagtcccag

SEQ ID NO: 787 - DNA, 24 bp, synthetic construct
  misc_feature 1..24: note = Description of Artificial Sequence: Syntheticoligonucleotide
  source 1..24: mol_type = other DNA
cctggactcactagtgagtccagg

SEQ ID NO: 788 - DNA, 24 bp, synthetic construct
  misc_feature 1..24: note = Description of Artificial Sequence: Syntheticoligonucleotide
  source 1..24: mol_type = other DNA
ccgtgactcactagtgagtcacgg

SEQ ID NO: 789 - DNA, 24 bp, synthetic construct
  misc_feature 1..24: note = Description of Artificial Sequence: Syntheticoligonucleotide
  source 1..24: mol_type = other DNA
cggcgactcactagtgagtcgccg

SEQ ID NO: 790 - DNA, 24 bp, synthetic construct
  misc_feature 1..24: note = Description of Artificial Sequence: Syntheticoligonucleotide
  source 1..24: mol_type = other DNA
cagcgactcactagtgagtcgctg

SEQ ID NO: 791 - DNA, 24 bp, synthetic construct
  misc_feature 1..24: note = Description of Artificial Sequence: Syntheticoligonucleotide
  source 1..24: mol_type = other DNA
cgacgactcactagtgagtcgtcg

SEQ ID NO: 792 - DNA, 24 bp, synthetic construct
  misc_feature 1..24: note = Description of Artificial Sequence: Syntheticoligonucleotide
  source 1..24: mol_type = other DNA
cggagactcactagtgagtctccg

SEQ ID NO: 793 - DNA, 24 bp, synthetic construct
  misc_feature 1..24: note = Description of Artificial Sequence: Syntheticoligonucleotide
  source 1..24: mol_type = other DNA
ctgcgactcactagtgagtcgcag

SEQ ID NO: 794 - DNA, 24 bp, synthetic construct
  misc_feature 1..24: note = Description of Artificial Sequence: Syntheticoligonucleotide
  source 1..24: mol_type = other DNA
cggtgactcactagtgagtcaccg

SEQ ID NO: 795 - DNA, 24 bp, synthetic construct
  misc_feature 1..24: note = Description of Artificial Sequence: Syntheticoligonucleotide
  source 1..24: mol_type = other DNA
cacggactcactagtgagtccgtg

SEQ ID NO: 796 - DNA, 24 bp, synthetic construct
  misc_feature 1..24: note = Description of Artificial Sequence: Syntheticoligonucleotide
  source 1..24: mol_type = other DNA
cccagactcactagtgagtctggg

SEQ ID NO: 797 - DNA, 24 bp, synthetic construct
  misc_feature 1..24: note = Description of Artificial Sequence: Syntheticoligonucleotide
  source 1..24: mol_type = other DNA
ctcggactcactagtgagtccgag

SEQ ID NO: 798 - DNA, 24 bp, synthetic construct
  misc_feature 1..24: note = Description of Artificial Sequence: Syntheticoligonucleotide
  source 1..24: mol_type = other DNA
ccctgactcactagtgagtcaggg

SEQ ID NO: 799 - DNA, 24 bp, synthetic construct
  misc_feature 1..24: note = Description of Artificial Sequence: Syntheticoligonucleotide
  source 1..24: mol_type = other DNA
ccacgactcactagtgagtcgtgg

SEQ ID NO: 800 - DNA, 24 bp, synthetic construct
  misc_feature 1..24: note = Description of Artificial Sequence: Syntheticoligonucleotide
  source 1..24: mol_type = other DNA
agccgactcactagtgagtcggct

SEQ ID NO: 801 - DNA, 24 bp, synthetic construct
  misc_feature 1..24: note = Description of Artificial Sequence: Syntheticoligonucleotide
  source 1..24: mol_type = other DNA
tgccgactcactagtgagtcggca

SEQ ID NO: 802 - DNA, 24 bp, synthetic construct
  misc_feature 1..24: note = Description of Artificial Sequence: Syntheticoligonucleotide
  source 1..24: mol_type = other DNA
gcgagactcactagtgagtctcgc

SEQ ID NO: 803 - DNA, 24 bp, synthetic construct
  misc_feature 1..24: note = Description of Artificial Sequence: Syntheticoligonucleotide
  source 1..24: mol_type = other DNA
gcgtgactcactagtgagtcacgc

SEQ ID NO: 804 - DNA, 24 bp, synthetic construct
  misc_feature 1..24: note = Description of Artificial Sequence: Syntheticoligonucleotide
  source 1..24: mol_type = other DNA
gcaggactcactagtgagtcctgc

SEQ ID NO: 805 - DNA, 24 bp, synthetic construct
  misc_feature 1..24: note = Description of Artificial Sequence: Syntheticoligonucleotide
  source 1..24: mol_type = other DNA
gctggactcactagtgagtccagc

SEQ ID NO: 806 - DNA, 24 bp, synthetic construct
  misc_feature 1..24: note = Description of Artificial Sequence: Syntheticoligonucleotide
  source 1..24: mol_type = other DNA
cgaggactcactagtgagtcctcg

SEQ ID NO: 807 - DNA, 24 bp, synthetic construct
  misc_feature 1..24: note = Description of Artificial Sequence: Syntheticoligonucleotide
  source 1..24: mol_type = other DNA
cgtggactcactagtgagtccacg

SEQ ID NO: 808 - DNA, 24 bp, synthetic construct
  misc_feature 1..24: note = Description of Artificial Sequence: Syntheticoligonucleotide
  source 1..24: mol_type = other DNA
caccgactcactagtgagtcggtg

SEQ ID NO: 809 - DNA, 24 bp, synthetic construct
  misc_feature 1..24: note = Description of Artificial Sequence: Syntheticoligonucleotide
  source 1..24: mol_type = other DNA
ctccgactcactagtgagtcggag

SEQ ID NO: 810 - DNA, 24 bp, synthetic construct
  misc_feature 1..24: note = Description of Artificial Sequence: Syntheticoligonucleotide
  source 1..24: mol_type = other DNA
gcgggactcactagtgagtcccgc

SEQ ID NO: 811 - DNA, 24 bp, synthetic construct
  misc_feature 1..24: note = Description of Artificial Sequence: Syntheticoligonucleotide
  source 1..24: mol_type = other DNA
gagggactcactagtgagtccctc

SEQ ID NO: 812 - DNA, 24 bp, synthetic construct
  misc_feature 1..24: note = Description of Artificial Sequence: Syntheticoligonucleotide
  source 1..24: mol_type = other DNA
gtgggactcactagtgagtcccac

SEQ ID NO: 813 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcacgcgtgagtcnnnn

SEQ ID NO: 814 - DNA, 24 bp, synthetic construct
  misc_feature 1..24: note = Description of Artificial Sequence: Syntheticoligonucleotide
  source 1..24: mol_type = other DNA
ggcggactcacgcgtgagtccgcc

SEQ ID NO: 815 - DNA, 24 bp, synthetic construct
  misc_feature 1..24: note = Description of Artificial Sequence: Syntheticoligonucleotide
  source 1..24: mol_type = other DNA
agcggactcacgcgtgagtccgct

SEQ ID NO: 816 - DNA, 24 bp, synthetic construct
  misc_feature 1..24: note = Description of Artificial Sequence: Syntheticoligonucleotide
  source 1..24: mol_type = other DNA
gacggactcacgcgtgagtccgtc

SEQ ID NO: 817 - DNA, 24 bp, synthetic construct
  misc_feature 1..24: note = Description of Artificial Sequence: Syntheticoligonucleotide
  source 1..24: mol_type = other DNA
ggaggactcacgcgtgagtcctcc

SEQ ID NO: 818 - DNA, 24 bp, synthetic construct
  misc_feature 1..24: note = Description of Artificial Sequence: Syntheticoligonucleotide
  source 1..24: mol_type = other DNA
ggcagactcacgcgtgagtctgcc

SEQ ID NO: 819 - DNA, 24 bp, synthetic construct
  misc_feature 1..24: note = Description of Artificial Sequence: Syntheticoligonucleotide
  source 1..24: mol_type = other DNA
tgcggactcacgcgtgagtccgca

SEQ ID NO: 820 - DNA, 24 bp, synthetic construct
  misc_feature 1..24: note = Description of Artificial Sequence: Syntheticoligonucleotide
  source 1..24: mol_type = other DNA
gtcggactcacgcgtgagtccgac

SEQ ID NO: 821 - DNA, 24 bp, synthetic construct
  misc_feature 1..24: note = Description of Artificial Sequence: Syntheticoligonucleotide
  source 1..24: mol_type = other DNA
ggtggactcacgcgtgagtccacc

SEQ ID NO: 822 - DNA, 24 bp, synthetic construct
  misc_feature 1..24: note = Description of Artificial Sequence: Syntheticoligonucleotide
  source 1..24: mol_type = other DNA
ggctgactcacgcgtgagtcagcc

SEQ ID NO: 823 - DNA, 24 bp, synthetic construct
  misc_feature 1..24: note = Description of Artificial Sequence: Syntheticoligonucleotide
  source 1..24: mol_type = other DNA
gcccgactcacgcgtgagtcgggc

SEQ ID NO: 824 - DNA, 24 bp, synthetic construct
  misc_feature 1..24: note = Description of Artificial Sequence: Syntheticoligonucleotide
  source 1..24: mol_type = other DNA
acccgactcacgcgtgagtcgggt

SEQ ID NO: 825 - DNA, 24 bp, synthetic construct
  misc_feature 1..24: note = Description of Artificial Sequence: Syntheticoligonucleotide
  source 1..24: mol_type = other DNA
gaccgactcacgcgtgagtcggtc

SEQ ID NO: 826 - DNA, 24 bp, synthetic construct
  misc_feature 1..24: note = Description of Artificial Sequence: Syntheticoligonucleotide
  source 1..24: mol_type = other DNA
gcacgactcacgcgtgagtcgtgc

SEQ ID NO: 827 - DNA, 24 bp, synthetic construct
  misc_feature 1..24: note = Description of Artificial Sequence: Syntheticoligonucleotide
  source 1..24: mol_type = other DNA
gccagactcacgcgtgagtctggc

SEQ ID NO: 828 - DNA, 24 bp, synthetic construct
  misc_feature 1..24: note = Description of Artificial Sequence: Syntheticoligonucleotide
  source 1..24: mol_type = other DNA
tcccgactcacgcgtgagtcggga

SEQ ID NO: 829 - DNA, 24 bp, synthetic construct
  misc_feature 1..24: note = Description of Artificial Sequence: Syntheticoligonucleotide
  source 1..24: mol_type = other DNA
gtccgactcacgcgtgagtcggac

SEQ ID NO: 830 - DNA, 24 bp, synthetic construct
  misc_feature 1..24: note = Description of Artificial Sequence: Syntheticoligonucleotide
  source 1..24: mol_type = other DNA
gcctgactcacgcgtgagtcaggc

SEQ ID NO: 831 - DNA, 24 bp, synthetic construct
  misc_feature 1..24: note = Description of Artificial Sequence: Syntheticoligonucleotide
  source 1..24: mol_type = other DNA
gggcgactcacgcgtgagtcgccc

SEQ ID NO: 832 - DNA, 24 bp, synthetic construct
  misc_feature 1..24: note = Description of Artificial Sequence: Syntheticoligonucleotide
  source 1..24: mol_type = other DNA
aggcgactcacgcgtgagtcgcct

SEQ ID NO: 833 - DNA, 24 bp, synthetic construct
  misc_feature 1..24: note = Description of Artificial Sequence: Syntheticoligonucleotide
  source 1..24: mol_type = other DNA
gagcgactcacgcgtgagtcgctc

SEQ ID NO: 834 - DNA, 24 bp, synthetic construct
  misc_feature 1..24: note = Description of Artificial Sequence: Syntheticoligonucleotide
  source 1..24: mol_type = other DNA
ggacgactcacgcgtgagtcgtcc

SEQ ID NO: 835 - DNA, 24 bp, synthetic construct
  misc_feature 1..24: note = Description of Artificial Sequence: Syntheticoligonucleotide
  source 1..24: mol_type = other DNA
gggagactcacgcgtgagtctccc

SEQ ID NO: 836 - DNA, 24 bp, synthetic construct
  misc_feature 1..24: note = Description of Artificial Sequence: Syntheticoligonucleotide
  source 1..24: mol_type = other DNA
tggcgactcacgcgtgagtcgcca

SEQ ID NO: 837 - DNA, 24 bp, synthetic construct
  misc_feature 1..24: note = Description of Artificial Sequence: Syntheticoligonucleotide
  source 1..24: mol_type = other DNA
gtgcgactcacgcgtgagtcgcac

SEQ ID NO: 838 - DNA, 24 bp, synthetic construct
  misc_feature 1..24: note = Description of Artificial Sequence: Syntheticoligonucleotide
  source 1..24: mol_type = other DNA
gggtgactcacgcgtgagtcaccc

SEQ ID NO: 839 - DNA, 24 bp, synthetic construct
  misc_feature 1..24: note = Description of Artificial Sequence: Syntheticoligonucleotide
  source 1..24: mol_type = other DNA
acgggactcacgcgtgagtcccgt

SEQ ID NO: 840 - DNA, 24 bp, synthetic construct
  misc_feature 1..24: note = Description of Artificial Sequence: Syntheticoligonucleotide
  source 1..24: mol_type = other DNA
cagggactcacgcgtgagtccctg

SEQ ID NO: 841 - DNA, 24 bp, synthetic construct
  misc_feature 1..24: note = Description of Artificial Sequence: Syntheticoligonucleotide
  source 1..24: mol_type = other DNA
ccaggactcacgcgtgagtcctgg

SEQ ID NO: 842 - DNA, 24 bp, synthetic construct
  misc_feature 1..24: note = Description of Artificial Sequence: Syntheticoligonucleotide
  source 1..24: mol_type = other DNA
ccgagactcacgcgtgagtctcgg

SEQ ID NO: 843 - DNA, 24 bp, synthetic construct
  misc_feature 1..24: note = Description of Artificial Sequence: Syntheticoligonucleotide
  source 1..24: mol_type = other DNA
tcgggactcacgcgtgagtcccga

SEQ ID NO: 844 - DNA, 24 bp, synthetic construct
  misc_feature 1..24: note = Description of Artificial Sequence: Syntheticoligonucleotide
  source 1..24: mol_type = other DNA
ctgggactcacgcgtgagtcccag

SEQ ID NO: 845 - DNA, 24 bp, synthetic construct
  misc_feature 1..24: note = Description of Artificial Sequence: Syntheticoligonucleotide
  source 1..24: mol_type = other DNA
cctggactcacgcgtgagtccagg

SEQ ID NO: 846 - DNA, 24 bp, synthetic construct
  misc_feature 1..24: note = Description of Artificial Sequence: Syntheticoligonucleotide
  source 1..24: mol_type = other DNA
ccgtgactcacgcgtgagtcacgg

SEQ ID NO: 847 - DNA, 24 bp, synthetic construct
  misc_feature 1..24: note = Description of Artificial Sequence: Syntheticoligonucleotide
  source 1..24: mol_type = other DNA
cggcgactcacgcgtgagtcgccg

SEQ ID NO: 848 - DNA, 24 bp, synthetic construct
  misc_feature 1..24: note = Description of Artificial Sequence: Syntheticoligonucleotide
  source 1..24: mol_type = other DNA
cagcgactcacgcgtgagtcgctg

SEQ ID NO: 849 - DNA, 24 bp, synthetic construct
  misc_feature 1..24: note = Description of Artificial Sequence: Syntheticoligonucleotide
  source 1..24: mol_type = other DNA
cgacgactcacgcgtgagtcgtcg

SEQ ID NO: 850 - DNA, 24 bp, synthetic construct
  misc_feature 1..24: note = Description of Artificial Sequence: Syntheticoligonucleotide
  source 1..24: mol_type = other DNA
cggagactcacgcgtgagtctccg

SEQ ID NO: 851 - DNA, 24 bp, synthetic construct
  misc_feature 1..24: note = Description of Artificial Sequence: Syntheticoligonucleotide
  source 1..24: mol_type = other DNA
ctgcgactcacgcgtgagtcgcag

SEQ ID NO: 852 - DNA, 24 bp, synthetic construct
  misc_feature 1..24: note = Description of Artificial Sequence: Syntheticoligonucleotide
  source 1..24: mol_type = other DNA
cggtgactcacgcgtgagtcaccg

SEQ ID NO: 853 - DNA, 24 bp, synthetic construct
  misc_feature 1..24: note = Description of Artificial Sequence: Syntheticoligonucleotide
  source 1..24: mol_type = other DNA
cacggactcacgcgtgagtccgtg

SEQ ID NO: 854 - DNA, 24 bp, synthetic construct
  misc_feature 1..24: note = Description of Artificial Sequence: Syntheticoligonucleotide
  source 1..24: mol_type = other DNA
cccagactcacgcgtgagtctggg

SEQ ID NO: 855 - DNA, 24 bp, synthetic construct
  misc_feature 1..24: note = Description of Artificial Sequence: Syntheticoligonucleotide
  source 1..24: mol_type = other DNA
ctcggactcacgcgtgagtccgag

SEQ ID NO: 856 - DNA, 24 bp, synthetic construct
  misc_feature 1..24: note = Description of Artificial Sequence: Syntheticoligonucleotide
  source 1..24: mol_type = other DNA
ccctgactcacgcgtgagtcaggg

SEQ ID NO: 857 - DNA, 24 bp, synthetic construct
  misc_feature 1..24: note = Description of Artificial Sequence: Syntheticoligonucleotide
  source 1..24: mol_type = other DNA
ccacgactcacgcgtgagtcgtgg

SEQ ID NO: 858 - DNA, 24 bp, synthetic construct
  misc_feature 1..24: note = Description of Artificial Sequence: Syntheticoligonucleotide
  source 1..24: mol_type = other DNA
agccgactcacgcgtgagtcggct

SEQ ID NO: 859 - DNA, 24 bp, synthetic construct
  misc_feature 1..24: note = Description of Artificial Sequence: Syntheticoligonucleotide
  source 1..24: mol_type = other DNA
tgccgactcacgcgtgagtcggca

SEQ ID NO: 860 - DNA, 24 bp, synthetic construct
  misc_feature 1..24: note = Description of Artificial Sequence: Syntheticoligonucleotide
  source 1..24: mol_type = other DNA
gcgagactcacgcgtgagtctcgc

SEQ ID NO: 861 - DNA, 24 bp, synthetic construct
  misc_feature 1..24: note = Description of Artificial Sequence: Syntheticoligonucleotide
  source 1..24: mol_type = other DNA
gcgtgactcacgcgtgagtcacgc

SEQ ID NO: 862 - DNA, 24 bp, synthetic construct
  misc_feature 1..24: note = Description of Artificial Sequence: Syntheticoligonucleotide
  source 1..24: mol_type = other DNA
gcaggactcacgcgtgagtcctgc

SEQ ID NO: 863 - DNA, 24 bp, synthetic construct
  misc_feature 1..24: note = Description of Artificial Sequence: Syntheticoligonucleotide
  source 1..24: mol_type = other DNA
gctggactcacgcgtgagtccagc

SEQ ID NO: 864 - DNA, 24 bp, synthetic construct
  misc_feature 1..24: note = Description of Artificial Sequence: Syntheticoligonucleotide
  source 1..24: mol_type = other DNA
cgaggactcacgcgtgagtcctcg

SEQ ID NO: 865 - DNA, 24 bp, synthetic construct
  misc_feature 1..24: note = Description of Artificial Sequence: Syntheticoligonucleotide
  source 1..24: mol_type = other DNA
cgtggactcacgcgtgagtccacg

SEQ ID NO: 866 - DNA, 24 bp, synthetic construct
  misc_feature 1..24: note = Description of Artificial Sequence: Syntheticoligonucleotide
  source 1..24: mol_type = other DNA
caccgactcacgcgtgagtcggtg

SEQ ID NO: 867 - DNA, 24 bp, synthetic construct
  misc_feature 1..24: note = Description of Artificial Sequence: Syntheticoligonucleotide
  source 1..24: mol_type = other DNA
ctccgactcacgcgtgagtcggag

SEQ ID NO: 868 - DNA, 24 bp, synthetic construct
  misc_feature 1..24: note = Description of Artificial Sequence: Syntheticoligonucleotide
  source 1..24: mol_type = other DNA
gcgggactcacgcgtgagtcccgc

SEQ ID NO: 869 - DNA, 24 bp, synthetic construct
  misc_feature 1..24: note = Description of Artificial Sequence: Syntheticoligonucleotide
  source 1..24: mol_type = other DNA
gagggactcacgcgtgagtccctc

SEQ ID NO: 870 - DNA, 24 bp, synthetic construct
  misc_feature 1..24: note = Description of Artificial Sequence: Syntheticoligonucleotide
  source 1..24: mol_type = other DNA
gtgggactcacgcgtgagtcccac

SEQ ID NO: 871 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcaccggtgagtcnnnn

SEQ ID NO: 872 - DNA, 24 bp, synthetic construct
  misc_feature 1..24: note = Description of Artificial Sequence: Syntheticoligonucleotide
  source 1..24: mol_type = other DNA
ggcggactcaccggtgagtccgcc

SEQ ID NO: 873 - DNA, 24 bp, synthetic construct
  misc_feature 1..24: note = Description of Artificial Sequence: Syntheticoligonucleotide
  source 1..24: mol_type = other DNA
agcggactcaccggtgagtccgct

SEQ ID NO: 874 - DNA, 24 bp, synthetic construct
  misc_feature 1..24: note = Description of Artificial Sequence: Syntheticoligonucleotide
  source 1..24: mol_type = other DNA
gacggactcaccggtgagtccgtc

SEQ ID NO: 875 - DNA, 24 bp, synthetic construct
  misc_feature 1..24: note = Description of Artificial Sequence: Syntheticoligonucleotide
  source 1..24: mol_type = other DNA
ggaggactcaccggtgagtcctcc

SEQ ID NO: 876 - DNA, 24 bp, synthetic construct
  misc_feature 1..24: note = Description of Artificial Sequence: Syntheticoligonucleotide
  source 1..24: mol_type = other DNA
ggcagactcaccggtgagtctgcc

SEQ ID NO: 877 - DNA, 24 bp, synthetic construct
  misc_feature 1..24: note = Description of Artificial Sequence: Syntheticoligonucleotide
  source 1..24: mol_type = other DNA
tgcggactcaccggtgagtccgca

SEQ ID NO: 878 - DNA, 24 bp, synthetic construct
  misc_feature 1..24: note = Description of Artificial Sequence: Syntheticoligonucleotide
  source 1..24: mol_type = other DNA
gtcggactcaccggtgagtccgac

SEQ ID NO: 879 - DNA, 24 bp, synthetic construct
  misc_feature 1..24: note = Description of Artificial Sequence: Syntheticoligonucleotide
  source 1..24: mol_type = other DNA
ggtggactcaccggtgagtccacc

SEQ ID NO: 880 - DNA, 24 bp, synthetic construct
  misc_feature 1..24: note = Description of Artificial Sequence: Syntheticoligonucleotide
  source 1..24: mol_type = other DNA
ggctgactcaccggtgagtcagcc

SEQ ID NO: 881 - DNA, 24 bp, synthetic construct
  misc_feature 1..24: note = Description of Artificial Sequence: Syntheticoligonucleotide
  source 1..24: mol_type = other DNA
gcccgactcaccggtgagtcgggc

SEQ ID NO: 882 - DNA, 24 bp, synthetic construct
  misc_feature 1..24: note = Description of Artificial Sequence: Syntheticoligonucleotide
  source 1..24: mol_type = other DNA
acccgactcaccggtgagtcgggt

SEQ ID NO: 883 - DNA, 24 bp, synthetic construct
  misc_feature 1..24: note = Description of Artificial Sequence: Syntheticoligonucleotide
  source 1..24: mol_type = other DNA
gaccgactcaccggtgagtcggtc

SEQ ID NO: 884 - DNA, 24 bp, synthetic construct
  misc_feature 1..24: note = Description of Artificial Sequence: Syntheticoligonucleotide
  source 1..24: mol_type = other DNA
gcacgactcaccggtgagtcgtgc

SEQ ID NO: 885 - DNA, 24 bp, synthetic construct
  misc_feature 1..24: note = Description of Artificial Sequence: Syntheticoligonucleotide
  source 1..24: mol_type = other DNA
gccagactcaccggtgagtctggc

SEQ ID NO: 886 - DNA, 24 bp, synthetic construct
  misc_feature 1..24: note = Description of Artificial Sequence: Syntheticoligonucleotide
  source 1..24: mol_type = other DNA
tcccgactcaccggtgagtcggga

SEQ ID NO: 887 - DNA, 24 bp, synthetic construct
  misc_feature 1..24: note = Description of Artificial Sequence: Syntheticoligonucleotide
  source 1..24: mol_type = other DNA
gtccgactcaccggtgagtcggac

SEQ ID NO: 888 - DNA, 24 bp, synthetic construct
  misc_feature 1..24: note = Description of Artificial Sequence: Syntheticoligonucleotide
  source 1..24: mol_type = other DNA
gcctgactcaccggtgagtcaggc

SEQ ID NO: 889 - DNA, 24 bp, synthetic construct
  misc_feature 1..24: note = Description of Artificial Sequence: Syntheticoligonucleotide
  source 1..24: mol_type = other DNA
gggcgactcaccggtgagtcgccc

SEQ ID NO: 890 - DNA, 24 bp, synthetic construct
  misc_feature 1..24: note = Description of Artificial Sequence: Syntheticoligonucleotide
  source 1..24: mol_type = other DNA
aggcgactcaccggtgagtcgcct

SEQ ID NO: 891 - DNA, 24 bp, synthetic construct
  misc_feature 1..24: note = Description of Artificial Sequence: Syntheticoligonucleotide
  source 1..24: mol_type = other DNA
gagcgactcaccggtgagtcgctc

SEQ ID NO: 892 - DNA, 24 bp, synthetic construct
  misc_feature 1..24: note = Description of Artificial Sequence: Syntheticoligonucleotide
  source 1..24: mol_type = other DNA
ggacgactcaccggtgagtcgtcc

SEQ ID NO: 893 - DNA, 24 bp, synthetic construct
  misc_feature 1..24: note = Description of Artificial Sequence: Syntheticoligonucleotide
  source 1..24: mol_type = other DNA
gggagactcaccggtgagtctccc

SEQ ID NO: 894 - DNA, 24 bp, synthetic construct
  misc_feature 1..24: note = Description of Artificial Sequence: Syntheticoligonucleotide
  source 1..24: mol_type = other DNA
tggcgactcaccggtgagtcgcca

SEQ ID NO: 895 - DNA, 24 bp, synthetic construct
  misc_feature 1..24: note = Description of Artificial Sequence: Syntheticoligonucleotide
  source 1..24: mol_type = other DNA
gtgcgactcaccggtgagtcgcac

SEQ ID NO: 896 - DNA, 24 bp, synthetic construct
  misc_feature 1..24: note = Description of Artificial Sequence: Syntheticoligonucleotide
  source 1..24: mol_type = other DNA
gggtgactcaccggtgagtcaccc

SEQ ID NO: 897 - DNA, 24 bp, synthetic construct
  misc_feature 1..24: note = Description of Artificial Sequence: Syntheticoligonucleotide
  source 1..24: mol_type = other DNA
acgggactcaccggtgagtcccgt

SEQ ID NO: 898 - DNA, 24 bp, synthetic construct
  misc_feature 1..24: note = Description of Artificial Sequence: Syntheticoligonucleotide
  source 1..24: mol_type = other DNA
cagggactcaccggtgagtccctg

SEQ ID NO: 899 - DNA, 24 bp, synthetic construct
  misc_feature 1..24: note = Description of Artificial Sequence: Syntheticoligonucleotide
  source 1..24: mol_type = other DNA
ccaggactcaccggtgagtcctgg

SEQ ID NO: 900 - DNA, 24 bp, synthetic construct
  misc_feature 1..24: note = Description of Artificial Sequence: Syntheticoligonucleotide
  source 1..24: mol_type = other DNA
ccgagactcaccggtgagtctcgg

SEQ ID NO: 901 - DNA, 24 bp, synthetic construct
  misc_feature 1..24: note = Description of Artificial Sequence: Syntheticoligonucleotide
  source 1..24: mol_type = other DNA
tcgggactcaccggtgagtcccga

SEQ ID NO: 902 - DNA, 24 bp, synthetic construct
  misc_feature 1..24: note = Description of Artificial Sequence: Syntheticoligonucleotide
  source 1..24: mol_type = other DNA
ctgggactcaccggtgagtcccag

SEQ ID NO: 903 - DNA, 24 bp, synthetic construct
  misc_feature 1..24: note = Description of Artificial Sequence: Syntheticoligonucleotide
  source 1..24: mol_type = other DNA
cctggactcaccggtgagtccagg

SEQ ID NO: 904 - DNA, 24 bp, synthetic construct
  misc_feature 1..24: note = Description of Artificial Sequence: Syntheticoligonucleotide
  source 1..24: mol_type = other DNA
ccgtgactcaccggtgagtcacgg

SEQ ID NO: 905 - DNA, 24 bp, synthetic construct
  misc_feature 1..24: note = Description of Artificial Sequence: Syntheticoligonucleotide
  source 1..24: mol_type = other DNA
cggcgactcaccggtgagtcgccg

SEQ ID NO: 906 - DNA, 24 bp, synthetic construct
  misc_feature 1..24: note = Description of Artificial Sequence: Syntheticoligonucleotide
  source 1..24: mol_type = other DNA
cagcgactcaccggtgagtcgctg

SEQ ID NO: 907 - DNA, 24 bp, synthetic construct
  misc_feature 1..24: note = Description of Artificial Sequence: Syntheticoligonucleotide
  source 1..24: mol_type = other DNA
cgacgactcaccggtgagtcgtcg

SEQ ID NO: 908 - DNA, 24 bp, synthetic construct
  misc_feature 1..24: note = Description of Artificial Sequence: Syntheticoligonucleotide
  source 1..24: mol_type = other DNA
cggagactcaccggtgagtctccg

SEQ ID NO: 909 - DNA, 24 bp, synthetic construct
  misc_feature 1..24: note = Description of Artificial Sequence: Syntheticoligonucleotide
  source 1..24: mol_type = other DNA
ctgcgactcaccggtgagtcgcag

SEQ ID NO: 910 - DNA, 24 bp, synthetic construct
  misc_feature 1..24: note = Description of Artificial Sequence: Syntheticoligonucleotide
  source 1..24: mol_type = other DNA
cggtgactcaccggtgagtcaccg

SEQ ID NO: 911 - DNA, 24 bp, synthetic construct
  misc_feature 1..24: note = Description of Artificial Sequence: Syntheticoligonucleotide
  source 1..24: mol_type = other DNA
cacggactcaccggtgagtccgtg

SEQ ID NO: 912 - DNA, 24 bp, synthetic construct
  misc_feature 1..24: note = Description of Artificial Sequence: Syntheticoligonucleotide
  source 1..24: mol_type = other DNA
cccagactcaccggtgagtctggg

SEQ ID NO: 913 - DNA, 24 bp, synthetic construct
  misc_feature 1..24: note = Description of Artificial Sequence: Syntheticoligonucleotide
  source 1..24: mol_type = other DNA
ctcggactcaccggtgagtccgag

SEQ ID NO: 914 - DNA, 24 bp, synthetic construct
  misc_feature 1..24: note = Description of Artificial Sequence: Syntheticoligonucleotide
  source 1..24: mol_type = other DNA
ccctgactcaccggtgagtcaggg

SEQ ID NO: 915 - DNA, 24 bp, synthetic construct
  misc_feature 1..24: note = Description of Artificial Sequence: Syntheticoligonucleotide
  source 1..24: mol_type = other DNA
ccacgactcaccggtgagtcgtgg

SEQ ID NO: 916 - DNA, 24 bp, synthetic construct
  misc_feature 1..24: note = Description of Artificial Sequence: Syntheticoligonucleotide
  source 1..24: mol_type = other DNA
agccgactcaccggtgagtcggct

SEQ ID NO: 917 - DNA, 24 bp, synthetic construct
  misc_feature 1..24: note = Description of Artificial Sequence: Syntheticoligonucleotide
  source 1..24: mol_type = other DNA
tgccgactcaccggtgagtcggca

SEQ ID NO: 918 - DNA, 24 bp, synthetic construct
  misc_feature 1..24: note = Description of Artificial Sequence: Syntheticoligonucleotide
  source 1..24: mol_type = other DNA
gcgagactcaccggtgagtctcgc

SEQ ID NO: 919 - DNA, 24 bp, synthetic construct
  misc_feature 1..24: note = Description of Artificial Sequence: Syntheticoligonucleotide
  source 1..24: mol_type = other DNA
gcgtgactcaccggtgagtcacgc

SEQ ID NO: 920 - DNA, 24 bp, synthetic construct
  misc_feature 1..24: note = Description of Artificial Sequence: Syntheticoligonucleotide
  source 1..24: mol_type = other DNA
gcaggactcaccggtgagtcctgc

SEQ ID NO: 921 - DNA, 24 bp, synthetic construct
  misc_feature 1..24: note = Description of Artificial Sequence: Syntheticoligonucleotide
  source 1..24: mol_type = other DNA
gctggactcaccggtgagtccagc

SEQ ID NO: 922 - DNA, 24 bp, synthetic construct
  misc_feature 1..24: note = Description of Artificial Sequence: Syntheticoligonucleotide
  source 1..24: mol_type = other DNA
cgaggactcaccggtgagtcctcg

SEQ ID NO: 923 - DNA, 24 bp, synthetic construct
  misc_feature 1..24: note = Description of Artificial Sequence: Syntheticoligonucleotide
  source 1..24: mol_type = other DNA
cgtggactcaccggtgagtccacg

SEQ ID NO: 924 - DNA, 24 bp, synthetic construct
  misc_feature 1..24: note = Description of Artificial Sequence: Syntheticoligonucleotide
  source 1..24: mol_type = other DNA
caccgactcaccggtgagtcggtg

SEQ ID NO: 925 - DNA, 24 bp, synthetic construct
  misc_feature 1..24: note = Description of Artificial Sequence: Syntheticoligonucleotide
  source 1..24: mol_type = other DNA
ctccgactcaccggtgagtcggag

SEQ ID NO: 926 - DNA, 24 bp, synthetic construct
  misc_feature 1..24: note = Description of Artificial Sequence: Syntheticoligonucleotide
  source 1..24: mol_type = other DNA
gcgggactcaccggtgagtcccgc

SEQ ID NO: 927 - DNA, 24 bp, synthetic construct
  misc_feature 1..24: note = Description of Artificial Sequence: Syntheticoligonucleotide
  source 1..24: mol_type = other DNA
gagggactcaccggtgagtccctc

SEQ ID NO: 928 - DNA, 24 bp, synthetic construct
  misc_feature 1..24: note = Description of Artificial Sequence: Syntheticoligonucleotide
  source 1..24: mol_type = other DNA
gtgggactcaccggtgagtcccac

SEQ ID NO: 929 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcccatgggagtcnnnn

SEQ ID NO: 930 - DNA, 24 bp, synthetic construct
  misc_feature 1..24: note = Description of Artificial Sequence: Syntheticoligonucleotide
  source 1..24: mol_type = other DNA
ggcggactcccatgggagtccgcc

SEQ ID NO: 931 - DNA, 24 bp, synthetic construct
  misc_feature 1..24: note = Description of Artificial Sequence: Syntheticoligonucleotide
  source 1..24: mol_type = other DNA
agcggactcccatgggagtccgct

SEQ ID NO: 932 - DNA, 24 bp, synthetic construct
  misc_feature 1..24: note = Description of Artificial Sequence: Syntheticoligonucleotide
  source 1..24: mol_type = other DNA
gacggactcccatgggagtccgtc

SEQ ID NO: 933 - DNA, 24 bp, synthetic construct
  misc_feature 1..24: note = Description of Artificial Sequence: Syntheticoligonucleotide
  source 1..24: mol_type = other DNA
ggaggactcccatgggagtcctcc

SEQ ID NO: 934 - DNA, 24 bp, synthetic construct
  misc_feature 1..24: note = Description of Artificial Sequence: Syntheticoligonucleotide
  source 1..24: mol_type = other DNA
ggcagactcccatgggagtctgcc

SEQ ID NO: 935 - DNA, 24 bp, synthetic construct
  misc_feature 1..24: note = Description of Artificial Sequence: Syntheticoligonucleotide
  source 1..24: mol_type = other DNA
tgcggactcccatgggagtccgca

SEQ ID NO: 936 - DNA, 24 bp, synthetic construct
  misc_feature 1..24: note = Description of Artificial Sequence: Syntheticoligonucleotide
  source 1..24: mol_type = other DNA
gtcggactcccatgggagtccgac

SEQ ID NO: 937 - DNA, 24 bp, synthetic construct
  misc_feature 1..24: note = Description of Artificial Sequence: Syntheticoligonucleotide
  source 1..24: mol_type = other DNA
ggtggactcccatgggagtccacc

SEQ ID NO: 938 - DNA, 24 bp, synthetic construct
  misc_feature 1..24: note = Description of Artificial Sequence: Syntheticoligonucleotide
  source 1..24: mol_type = other DNA
ggctgactcccatgggagtcagcc

SEQ ID NO: 939 - DNA, 24 bp, synthetic construct
  misc_feature 1..24: note = Description of Artificial Sequence: Syntheticoligonucleotide
  source 1..24: mol_type = other DNA
gcccgactcccatgggagtcgggc

SEQ ID NO: 940 - DNA, 24 bp, synthetic construct
  misc_feature 1..24: note = Description of Artificial Sequence: Syntheticoligonucleotide
  source 1..24: mol_type = other DNA
acccgactcccatgggagtcgggt

SEQ ID NO: 941 - DNA, 24 bp, synthetic construct
  misc_feature 1..24: note = Description of Artificial Sequence: Syntheticoligonucleotide
  source 1..24: mol_type = other DNA
gaccgactcccatgggagtcggtc

SEQ ID NO: 942 - DNA, 24 bp, synthetic construct
  misc_feature 1..24: note = Description of Artificial Sequence: Syntheticoligonucleotide
  source 1..24: mol_type = other DNA
gcacgactcccatgggagtcgtgc

SEQ ID NO: 943 - DNA, 24 bp, synthetic construct
  misc_feature 1..24: note = Description of Artificial Sequence: Syntheticoligonucleotide
  source 1..24: mol_type = other DNA
gccagactcccatgggagtctggc

SEQ ID NO: 944 - DNA, 24 bp, synthetic construct
  misc_feature 1..24: note = Description of Artificial Sequence: Syntheticoligonucleotide
  source 1..24: mol_type = other DNA
tcccgactcccatgggagtcggga

SEQ ID NO: 945 - DNA, 24 bp, synthetic construct
  misc_feature 1..24: note = Description of Artificial Sequence: Syntheticoligonucleotide
  source 1..24: mol_type = other DNA
gtccgactcccatgggagtcggac

SEQ ID NO: 946 - DNA, 24 bp, synthetic construct
  misc_feature 1..24: note = Description of Artificial Sequence: Syntheticoligonucleotide
  source 1..24: mol_type = other DNA
gcctgactcccatgggagtcaggc

SEQ ID NO: 947 - DNA, 24 bp, synthetic construct
  misc_feature 1..24: note = Description of Artificial Sequence: Syntheticoligonucleotide
  source 1..24: mol_type = other DNA
gggcgactcccatgggagtcgccc

SEQ ID NO: 948 - DNA, 24 bp, synthetic construct
  misc_feature 1..24: note = Description of Artificial Sequence: Syntheticoligonucleotide
  source 1..24: mol_type = other DNA
aggcgactcccatgggagtcgcct

SEQ ID NO: 949 - DNA, 24 bp, synthetic construct
  misc_feature 1..24: note = Description of Artificial Sequence: Syntheticoligonucleotide
  source 1..24: mol_type = other DNA
gagcgactcccatgggagtcgctc

SEQ ID NO: 950 - DNA, 24 bp, synthetic construct
  misc_feature 1..24: note = Description of Artificial Sequence: Syntheticoligonucleotide
  source 1..24: mol_type = other DNA
ggacgactcccatgggagtcgtcc

SEQ ID NO: 951 - DNA, 24 bp, synthetic construct
  misc_feature 1..24: note = Description of Artificial Sequence: Syntheticoligonucleotide
  source 1..24: mol_type = other DNA
gggagactcccatgggagtctccc

SEQ ID NO: 952 - DNA, 24 bp, synthetic construct
  misc_feature 1..24: note = Description of Artificial Sequence: Syntheticoligonucleotide
  source 1..24: mol_type = other DNA
tggcgactcccatgggagtcgcca

SEQ ID NO: 953 - DNA, 24 bp, synthetic construct
  misc_feature 1..24: note = Description of Artificial Sequence: Syntheticoligonucleotide
  source 1..24: mol_type = other DNA
gtgcgactcccatgggagtcgcac

SEQ ID NO: 954 - DNA, 24 bp, synthetic construct
  misc_feature 1..24: note = Description of Artificial Sequence: Syntheticoligonucleotide
  source 1..24: mol_type = other DNA
gggtgactcccatgggagtcaccc

SEQ ID NO: 955 - DNA, 24 bp, synthetic construct
  misc_feature 1..24: note = Description of Artificial Sequence: Syntheticoligonucleotide
  source 1..24: mol_type = other DNA
acgggactcccatgggagtcccgt

SEQ ID NO: 956 - DNA, 24 bp, synthetic construct
  misc_feature 1..24: note = Description of Artificial Sequence: Syntheticoligonucleotide
  source 1..24: mol_type = other DNA
cagggactcccatgggagtccctg

SEQ ID NO: 957 - DNA, 24 bp, synthetic construct
  misc_feature 1..24: note = Description of Artificial Sequence: Syntheticoligonucleotide
  source 1..24: mol_type = other DNA
ccaggactcccatgggagtcctgg

SEQ ID NO: 958 - DNA, 24 bp, synthetic construct
  misc_feature 1..24: note = Description of Artificial Sequence: Syntheticoligonucleotide
  source 1..24: mol_type = other DNA
ccgagactcccatgggagtctcgg

SEQ ID NO: 959 - DNA, 24 bp, synthetic construct
  misc_feature 1..24: note = Description of Artificial Sequence: Syntheticoligonucleotide
  source 1..24: mol_type = other DNA
tcgggactcccatgggagtcccga

SEQ ID NO: 960 - DNA, 24 bp, synthetic construct
  misc_feature 1..24: note = Description of Artificial Sequence: Syntheticoligonucleotide
  source 1..24: mol_type = other DNA
ctgggactcccatgggagtcccag

SEQ ID NO: 961 - DNA, 24 bp, synthetic construct
  misc_feature 1..24: note = Description of Artificial Sequence: Syntheticoligonucleotide
  source 1..24: mol_type = other DNA
cctggactcccatgggagtccagg

SEQ ID NO: 962 - DNA, 24 bp, synthetic construct
  misc_feature 1..24: note = Description of Artificial Sequence: Syntheticoligonucleotide
  source 1..24: mol_type = other DNA
ccgtgactcccatgggagtcacgg

SEQ ID NO: 963 - DNA, 24 bp, synthetic construct
  misc_feature 1..24: note = Description of Artificial Sequence: Syntheticoligonucleotide
  source 1..24: mol_type = other DNA
cggcgactcccatgggagtcgccg

SEQ ID NO: 964 - DNA, 24 bp, synthetic construct
  misc_feature 1..24: note = Description of Artificial Sequence: Syntheticoligonucleotide
  source 1..24: mol_type = other DNA
cagcgactcccatgggagtcgctg

SEQ ID NO: 965 - DNA, 24 bp, synthetic construct
  misc_feature 1..24: note = Description of Artificial Sequence: Syntheticoligonucleotide
  source 1..24: mol_type = other DNA
cgacgactcccatgggagtcgtcg

SEQ ID NO: 966 - DNA, 24 bp, synthetic construct
  misc_feature 1..24: note = Description of Artificial Sequence: Syntheticoligonucleotide
  source 1..24: mol_type = other DNA
cggagactcccatgggagtctccg

SEQ ID NO: 967 - DNA, 24 bp, synthetic construct
  misc_feature 1..24: note = Description of Artificial Sequence: Syntheticoligonucleotide
  source 1..24: mol_type = other DNA
ctgcgactcccatgggagtcgcag

SEQ ID NO: 968 - DNA, 24 bp, synthetic construct
  misc_feature 1..24: note = Description of Artificial Sequence: Syntheticoligonucleotide
  source 1..24: mol_type = other DNA
cggtgactcccatgggagtcaccg

SEQ ID NO: 969 - DNA, 24 bp, synthetic construct
  misc_feature 1..24: note = Description of Artificial Sequence: Syntheticoligonucleotide
  source 1..24: mol_type = other DNA
cacggactcccatgggagtccgtg

SEQ ID NO: 970 - DNA, 24 bp, synthetic construct
  misc_feature 1..24: note = Description of Artificial Sequence: Syntheticoligonucleotide
  source 1..24: mol_type = other DNA
cccagactcccatgggagtctggg

SEQ ID NO: 971 - DNA, 24 bp, synthetic construct
  misc_feature 1..24: note = Description of Artificial Sequence: Syntheticoligonucleotide
  source 1..24: mol_type = other DNA
ctcggactcccatgggagtccgag

SEQ ID NO: 972 - DNA, 24 bp, synthetic construct
  misc_feature 1..24: note = Description of Artificial Sequence: Syntheticoligonucleotide
  source 1..24: mol_type = other DNA
ccctgactcccatgggagtcaggg

SEQ ID NO: 973 - DNA, 24 bp, synthetic construct
  misc_feature 1..24: note = Description of Artificial Sequence: Syntheticoligonucleotide
  source 1..24: mol_type = other DNA
ccacgactcccatgggagtcgtgg

SEQ ID NO: 974 - DNA, 24 bp, synthetic construct
  misc_feature 1..24: note = Description of Artificial Sequence: Syntheticoligonucleotide
  source 1..24: mol_type = other DNA
agccgactcccatgggagtcggct

SEQ ID NO: 975 - DNA, 24 bp, synthetic construct
  misc_feature 1..24: note = Description of Artificial Sequence: Syntheticoligonucleotide
  source 1..24: mol_type = other DNA
tgccgactcccatgggagtcggca

SEQ ID NO: 976 - DNA, 24 bp, synthetic construct
  misc_feature 1..24: note = Description of Artificial Sequence: Syntheticoligonucleotide
  source 1..24: mol_type = other DNA
gcgagactcccatgggagtctcgc

SEQ ID NO: 977 - DNA, 24 bp, synthetic construct
  misc_feature 1..24: note = Description of Artificial Sequence: Syntheticoligonucleotide
  source 1..24: mol_type = other DNA
gcgtgactcccatgggagtcacgc

SEQ ID NO: 978 - DNA, 24 bp, synthetic construct
  misc_feature 1..24: note = Description of Artificial Sequence: Syntheticoligonucleotide
  source 1..24: mol_type = other DNA
gcaggactcccatgggagtcctgc

SEQ ID NO: 979 - DNA, 24 bp, synthetic construct
  misc_feature 1..24: note = Description of Artificial Sequence: Syntheticoligonucleotide
  source 1..24: mol_type = other DNA
gctggactcccatgggagtccagc

SEQ ID NO: 980 - DNA, 24 bp, synthetic construct
  misc_feature 1..24: note = Description of Artificial Sequence: Syntheticoligonucleotide
  source 1..24: mol_type = other DNA
cgaggactcccatgggagtcctcg

SEQ ID NO: 981 - DNA, 24 bp, synthetic construct
  misc_feature 1..24: note = Description of Artificial Sequence: Syntheticoligonucleotide
  source 1..24: mol_type = other DNA
cgtggactcccatgggagtccacg

SEQ ID NO: 982 - DNA, 24 bp, synthetic construct
  misc_feature 1..24: note = Description of Artificial Sequence: Syntheticoligonucleotide
  source 1..24: mol_type = other DNA
caccgactcccatgggagtcggtg

SEQ ID NO: 983 - DNA, 24 bp, synthetic construct
  misc_feature 1..24: note = Description of Artificial Sequence: Syntheticoligonucleotide
  source 1..24: mol_type = other DNA
ctccgactcccatgggagtcggag

SEQ ID NO: 984 - DNA, 24 bp, synthetic construct
  misc_feature 1..24: note = Description of Artificial Sequence: Syntheticoligonucleotide
  source 1..24: mol_type = other DNA
gcgggactcccatgggagtcccgc

SEQ ID NO: 985 - DNA, 24 bp, synthetic construct
  misc_feature 1..24: note = Description of Artificial Sequence: Syntheticoligonucleotide
  source 1..24: mol_type = other DNA
gagggactcccatgggagtccctc

SEQ ID NO: 986 - DNA, 24 bp, synthetic construct
  misc_feature 1..24: note = Description of Artificial Sequence: Syntheticoligonucleotide
  source 1..24: mol_type = other DNA
gtgggactcccatgggagtcccac

SEQ ID NO: 987 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactccctagggagtcnnnn

SEQ ID NO: 988 - DNA, 24 bp, synthetic construct
  misc_feature 1..24: note = Description of Artificial Sequence: Syntheticoligonucleotide
  source 1..24: mol_type = other DNA
ggcggactccctagggagtccgcc

SEQ ID NO: 989 - DNA, 24 bp, synthetic construct
  misc_feature 1..24: note = Description of Artificial Sequence: Syntheticoligonucleotide
  source 1..24: mol_type = other DNA
agcggactccctagggagtccgct

SEQ ID NO: 990 - DNA, 24 bp, synthetic construct
  misc_feature 1..24: note = Description of Artificial Sequence: Syntheticoligonucleotide
  source 1..24: mol_type = other DNA
gacggactccctagggagtccgtc

SEQ ID NO: 991 - DNA, 24 bp, synthetic construct
  misc_feature 1..24: note = Description of Artificial Sequence: Syntheticoligonucleotide
  source 1..24: mol_type = other DNA
ggaggactccctagggagtcctcc

SEQ ID NO: 992 - DNA, 24 bp, synthetic construct
  misc_feature 1..24: note = Description of Artificial Sequence: Syntheticoligonucleotide
  source 1..24: mol_type = other DNA
ggcagactccctagggagtctgcc

SEQ ID NO: 993 - DNA, 24 bp, synthetic construct
  misc_feature 1..24: note = Description of Artificial Sequence: Syntheticoligonucleotide
  source 1..24: mol_type = other DNA
tgcggactccctagggagtccgca

SEQ ID NO: 994 - DNA, 24 bp, synthetic construct
  misc_feature 1..24: note = Description of Artificial Sequence: Syntheticoligonucleotide
  source 1..24: mol_type = other DNA
gtcggactccctagggagtccgac

SEQ ID NO: 995 - DNA, 24 bp, synthetic construct
  misc_feature 1..24: note = Description of Artificial Sequence: Syntheticoligonucleotide
  source 1..24: mol_type = other DNA
ggtggactccctagggagtccacc

SEQ ID NO: 996 - DNA, 24 bp, synthetic construct
  misc_feature 1..24: note = Description of Artificial Sequence: Syntheticoligonucleotide
  source 1..24: mol_type = other DNA
ggctgactccctagggagtcagcc

SEQ ID NO: 997 - DNA, 24 bp, synthetic construct
  misc_feature 1..24: note = Description of Artificial Sequence: Syntheticoligonucleotide
  source 1..24: mol_type = other DNA
gcccgactccctagggagtcgggc

SEQ ID NO: 998 - DNA, 24 bp, synthetic construct
  misc_feature 1..24: note = Description of Artificial Sequence: Syntheticoligonucleotide
  source 1..24: mol_type = other DNA
acccgactccctagggagtcgggt

SEQ ID NO: 999 - DNA, 24 bp, synthetic construct
  misc_feature 1..24: note = Description of Artificial Sequence: Syntheticoligonucleotide
  source 1..24: mol_type = other DNA
gaccgactccctagggagtcggtc

SEQ ID NO: 1000 - DNA, 24 bp, synthetic construct
  misc_feature 1..24: note = Description of Artificial Sequence: Syntheticoligonucleotide
  source 1..24: mol_type = other DNA
gcacgactccctagggagtcgtgc

SEQ ID NO: 1001 - DNA, 24 bp, synthetic construct
  misc_feature 1..24: note = Description of Artificial Sequence: Syntheticoligonucleotide
  source 1..24: mol_type = other DNA
gccagactccctagggagtctggc

SEQ ID NO: 1002 - DNA, 24 bp, synthetic construct
  misc_feature 1..24: note = Description of Artificial Sequence: Syntheticoligonucleotide
  source 1..24: mol_type = other DNA
tcccgactccctagggagtcggga

SEQ ID NO: 1003 - DNA, 24 bp, synthetic construct
  misc_feature 1..24: note = Description of Artificial Sequence: Syntheticoligonucleotide
  source 1..24: mol_type = other DNA
gtccgactccctagggagtcggac

SEQ ID NO: 1004 - DNA, 24 bp, synthetic construct
  misc_feature 1..24: note = Description of Artificial Sequence: Syntheticoligonucleotide
  source 1..24: mol_type = other DNA
gcctgactccctagggagtcaggc

SEQ ID NO: 1005 - DNA, 24 bp, synthetic construct
  misc_feature 1..24: note = Description of Artificial Sequence: Syntheticoligonucleotide
  source 1..24: mol_type = other DNA
gggcgactccctagggagtcgccc

SEQ ID NO: 1006 - DNA, 24 bp, synthetic construct
  misc_feature 1..24: note = Description of Artificial Sequence: Syntheticoligonucleotide
  source 1..24: mol_type = other DNA
aggcgactccctagggagtcgcct

SEQ ID NO: 1007 - DNA, 24 bp, synthetic construct
  misc_feature 1..24: note = Description of Artificial Sequence: Syntheticoligonucleotide
  source 1..24: mol_type = other DNA
gagcgactccctagggagtcgctc

SEQ ID NO: 1008 - DNA, 24 bp, synthetic construct
  misc_feature 1..24: note = Description of Artificial Sequence: Syntheticoligonucleotide
  source 1..24: mol_type = other DNA
ggacgactccctagggagtcgtcc

SEQ ID NO: 1009 - DNA, 24 bp, synthetic construct
  misc_feature 1..24: note = Description of Artificial Sequence: Syntheticoligonucleotide
  source 1..24: mol_type = other DNA
gggagactccctagggagtctccc

SEQ ID NO: 1010 - DNA, 24 bp, synthetic construct
  misc_feature 1..24: note = Description of Artificial Sequence: Syntheticoligonucleotide
  source 1..24: mol_type = other DNA
tggcgactccctagggagtcgcca

SEQ ID NO: 1011 - DNA, 24 bp, synthetic construct
  misc_feature 1..24: note = Description of Artificial Sequence: Syntheticoligonucleotide
  source 1..24: mol_type = other DNA
gtgcgactccctagggagtcgcac

SEQ ID NO: 1012 - DNA, 24 bp, synthetic construct
  misc_feature 1..24: note = Description of Artificial Sequence: Syntheticoligonucleotide
  source 1..24: mol_type = other DNA
gggtgactccctagggagtcaccc

SEQ ID NO: 1013 - DNA, 24 bp, synthetic construct
  misc_feature 1..24: note = Description of Artificial Sequence: Syntheticoligonucleotide
  source 1..24: mol_type = other DNA
acgggactccctagggagtcccgt

SEQ ID NO: 1014 - DNA, 24 bp, synthetic construct
  misc_feature 1..24: note = Description of Artificial Sequence: Syntheticoligonucleotide
  source 1..24: mol_type = other DNA
cagggactccctagggagtccctg

SEQ ID NO: 1015 - DNA, 24 bp, synthetic construct
  misc_feature 1..24: note = Description of Artificial Sequence: Syntheticoligonucleotide
  source 1..24: mol_type = other DNA
ccaggactccctagggagtcctgg

SEQ ID NO: 1016 - DNA, 24 bp, synthetic construct
  misc_feature 1..24: note = Description of Artificial Sequence: Syntheticoligonucleotide
  source 1..24: mol_type = other DNA
ccgagactccctagggagtctcgg

SEQ ID NO: 1017 - DNA, 24 bp, synthetic construct
  misc_feature 1..24: note = Description of Artificial Sequence: Syntheticoligonucleotide
  source 1..24: mol_type = other DNA
tcgggactccctagggagtcccga

SEQ ID NO: 1018 - DNA, 24 bp, synthetic construct
  misc_feature 1..24: note = Description of Artificial Sequence: Syntheticoligonucleotide
  source 1..24: mol_type = other DNA
ctgggactccctagggagtcccag

SEQ ID NO: 1019 - DNA, 24 bp, synthetic construct
  misc_feature 1..24: note = Description of Artificial Sequence: Syntheticoligonucleotide
  source 1..24: mol_type = other DNA
cctggactccctagggagtccagg

SEQ ID NO: 1020 - DNA, 24 bp, synthetic construct
  misc_feature 1..24: note = Description of Artificial Sequence: Syntheticoligonucleotide
  source 1..24: mol_type = other DNA
ccgtgactccctagggagtcacgg

SEQ ID NO: 1021 - DNA, 24 bp, synthetic construct
  misc_feature 1..24: note = Description of Artificial Sequence: Syntheticoligonucleotide
  source 1..24: mol_type = other DNA
cggcgactccctagggagtcgccg

SEQ ID NO: 1022 - DNA, 24 bp, synthetic construct
  misc_feature 1..24: note = Description of Artificial Sequence: Syntheticoligonucleotide
  source 1..24: mol_type = other DNA
cagcgactccctagggagtcgctg

SEQ ID NO: 1023 - DNA, 24 bp, synthetic construct
  misc_feature 1..24: note = Description of Artificial Sequence: Syntheticoligonucleotide
  source 1..24: mol_type = other DNA
cgacgactccctagggagtcgtcg

SEQ ID NO: 1024 - DNA, 24 bp, synthetic construct
  misc_feature 1..24: note = Description of Artificial Sequence: Syntheticoligonucleotide
  source 1..24: mol_type = other DNA
cggagactccctagggagtctccg

SEQ ID NO: 1025 - DNA, 24 bp, synthetic construct
  misc_feature 1..24: note = Description of Artificial Sequence: Syntheticoligonucleotide
  source 1..24: mol_type = other DNA
ctgcgactccctagggagtcgcag

SEQ ID NO: 1026 - DNA, 24 bp, synthetic construct
  misc_feature 1..24: note = Description of Artificial Sequence: Syntheticoligonucleotide
  source 1..24: mol_type = other DNA
cggtgactccctagggagtcaccg

SEQ ID NO: 1027 - DNA, 24 bp, synthetic construct
  misc_feature 1..24: note = Description of Artificial Sequence: Syntheticoligonucleotide
  source 1..24: mol_type = other DNA
cacggactccctagggagtccgtg

SEQ ID NO: 1028 - DNA, 24 bp, synthetic construct
  misc_feature 1..24: note = Description of Artificial Sequence: Syntheticoligonucleotide
  source 1..24: mol_type = other DNA
cccagactccctagggagtctggg

SEQ ID NO: 1029 - DNA, 24 bp, synthetic construct
  misc_feature 1..24: note = Description of Artificial Sequence: Syntheticoligonucleotide
  source 1..24: mol_type = other DNA
ctcggactccctagggagtccgag

SEQ ID NO: 1030 - DNA, 24 bp, synthetic construct
  misc_feature 1..24: note = Description of Artificial Sequence: Syntheticoligonucleotide
  source 1..24: mol_type = other DNA
ccctgactccctagggagtcaggg

SEQ ID NO: 1031 - DNA, 24 bp, synthetic construct
  misc_feature 1..24: note = Description of Artificial Sequence: Syntheticoligonucleotide
  source 1..24: mol_type = other DNA
ccacgactccctagggagtcgtgg

SEQ ID NO: 1032 - DNA, 24 bp, synthetic construct
  misc_feature 1..24: note = Description of Artificial Sequence: Syntheticoligonucleotide
  source 1..24: mol_type = other DNA
agccgactccctagggagtcggct

SEQ ID NO: 1033 - DNA, 24 bp, synthetic construct
  misc_feature 1..24: note = Description of Artificial Sequence: Syntheticoligonucleotide
  source 1..24: mol_type = other DNA
tgccgactccctagggagtcggca

SEQ ID NO: 1034 - DNA, 24 bp, synthetic construct
  misc_feature 1..24: note = Description of Artificial Sequence: Syntheticoligonucleotide
  source 1..24: mol_type = other DNA
gcgagactccctagggagtctcgc

SEQ ID NO: 1035 - DNA, 24 bp, synthetic construct
  misc_feature 1..24: note = Description of Artificial Sequence: Syntheticoligonucleotide
  source 1..24: mol_type = other DNA
gcgtgactccctagggagtcacgc

SEQ ID NO: 1036 - DNA, 24 bp, synthetic construct
  misc_feature 1..24: note = Description of Artificial Sequence: Syntheticoligonucleotide
  source 1..24: mol_type = other DNA
gcaggactccctagggagtcctgc

SEQ ID NO: 1037 - DNA, 24 bp, synthetic construct
  misc_feature 1..24: note = Description of Artificial Sequence: Syntheticoligonucleotide
  source 1..24: mol_type = other DNA
gctggactccctagggagtccagc

SEQ ID NO: 1038 - DNA, 24 bp, synthetic construct
  misc_feature 1..24: note = Description of Artificial Sequence: Syntheticoligonucleotide
  source 1..24: mol_type = other DNA
cgaggactccctagggagtcctcg

SEQ ID NO: 1039 - DNA, 24 bp, synthetic construct
  misc_feature 1..24: note = Description of Artificial Sequence: Syntheticoligonucleotide
  source 1..24: mol_type = other DNA
cgtggactccctagggagtccacg

SEQ ID NO: 1040 - DNA, 24 bp, synthetic construct
  misc_feature 1..24: note = Description of Artificial Sequence: Syntheticoligonucleotide
  source 1..24: mol_type = other DNA
caccgactccctagggagtcggtg

SEQ ID NO: 1041 - DNA, 24 bp, synthetic construct
  misc_feature 1..24: note = Description of Artificial Sequence: Syntheticoligonucleotide
  source 1..24: mol_type = other DNA
ctccgactccctagggagtcggag

SEQ ID NO: 1042 - DNA, 24 bp, synthetic construct
  misc_feature 1..24: note = Description of Artificial Sequence: Syntheticoligonucleotide
  source 1..24: mol_type = other DNA
gcgggactccctagggagtcccgc

SEQ ID NO: 1043 - DNA, 24 bp, synthetic construct
  misc_feature 1..24: note = Description of Artificial Sequence: Syntheticoligonucleotide
  source 1..24: mol_type = other DNA
gagggactccctagggagtccctc

SEQ ID NO: 1044 - DNA, 24 bp, synthetic construct
  misc_feature 1..24: note = Description of Artificial Sequence: Syntheticoligonucleotide
  source 1..24: mol_type = other DNA
gtgggactccctagggagtcccac

SEQ ID NO: 1045 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcccgcgggagtcnnnn

SEQ ID NO: 1046 - DNA, 24 bp, synthetic construct
  misc_feature 1..24: note = Description of Artificial Sequence: Syntheticoligonucleotide
  source 1..24: mol_type = other DNA
ggcggactcccgcgggagtccgcc

SEQ ID NO: 1047 - DNA, 24 bp, synthetic construct
  misc_feature 1..24: note = Description of Artificial Sequence: Syntheticoligonucleotide
  source 1..24: mol_type = other DNA
agcggactcccgcgggagtccgct

SEQ ID NO: 1048 - DNA, 24 bp, synthetic construct
  misc_feature 1..24: note = Description of Artificial Sequence: Syntheticoligonucleotide
  source 1..24: mol_type = other DNA
gacggactcccgcgggagtccgtc

SEQ ID NO: 1049 - DNA, 24 bp, synthetic construct
  misc_feature 1..24: note = Description of Artificial Sequence: Syntheticoligonucleotide
  source 1..24: mol_type = other DNA
ggaggactcccgcgggagtcctcc

SEQ ID NO: 1050 - DNA, 24 bp, synthetic construct
  misc_feature 1..24: note = Description of Artificial Sequence: Syntheticoligonucleotide
  source 1..24: mol_type = other DNA
ggcagactcccgcgggagtctgcc

SEQ ID NO: 1051 - DNA, 24 bp, synthetic construct
  misc_feature 1..24: note = Description of Artificial Sequence: Syntheticoligonucleotide
  source 1..24: mol_type = other DNA
tgcggactcccgcgggagtccgca

SEQ ID NO: 1052 - DNA, 24 bp, synthetic construct
  misc_feature 1..24: note = Description of Artificial Sequence: Syntheticoligonucleotide
  source 1..24: mol_type = other DNA
gtcggactcccgcgggagtccgac

SEQ ID NO: 1053 - DNA, 24 bp, synthetic construct
  misc_feature 1..24: note = Description of Artificial Sequence: Syntheticoligonucleotide
  source 1..24: mol_type = other DNA
ggtggactcccgcgggagtccacc

SEQ ID NO: 1054 - DNA, 24 bp, synthetic construct
  misc_feature 1..24: note = Description of Artificial Sequence: Syntheticoligonucleotide
  source 1..24: mol_type = other DNA
ggctgactcccgcgggagtcagcc

SEQ ID NO: 1055 - DNA, 24 bp, synthetic construct
  misc_feature 1..24: note = Description of Artificial Sequence: Syntheticoligonucleotide
  source 1..24: mol_type = other DNA
gcccgactcccgcgggagtcgggc

SEQ ID NO: 1056 - DNA, 24 bp, synthetic construct
  misc_feature 1..24: note = Description of Artificial Sequence: Syntheticoligonucleotide
  source 1..24: mol_type = other DNA
acccgactcccgcgggagtcgggt

SEQ ID NO: 1057 - DNA, 24 bp, synthetic construct
  misc_feature 1..24: note = Description of Artificial Sequence: Syntheticoligonucleotide
  source 1..24: mol_type = other DNA
gaccgactcccgcgggagtcggtc

SEQ ID NO: 1058 - DNA, 24 bp, synthetic construct
  misc_feature 1..24: note = Description of Artificial Sequence: Syntheticoligonucleotide
  source 1..24: mol_type = other DNA
gcacgactcccgcgggagtcgtgc

SEQ ID NO: 1059 - DNA, 24 bp, synthetic construct
  misc_feature 1..24: note = Description of Artificial Sequence: Syntheticoligonucleotide
  source 1..24: mol_type = other DNA
gccagactcccgcgggagtctggc

SEQ ID NO: 1060 - DNA, 24 bp, synthetic construct
  misc_feature 1..24: note = Description of Artificial Sequence: Syntheticoligonucleotide
  source 1..24: mol_type = other DNA
tcccgactcccgcgggagtcggga

SEQ ID NO: 1061 - DNA, 24 bp, synthetic construct
  misc_feature 1..24: note = Description of Artificial Sequence: Syntheticoligonucleotide
  source 1..24: mol_type = other DNA
gtccgactcccgcgggagtcggac

SEQ ID NO: 1062 - DNA, 24 bp, synthetic construct
  misc_feature 1..24: note = Description of Artificial Sequence: Syntheticoligonucleotide
  source 1..24: mol_type = other DNA
gcctgactcccgcgggagtcaggc

SEQ ID NO: 1063 - DNA, 24 bp, synthetic construct
  misc_feature 1..24: note = Description of Artificial Sequence: Syntheticoligonucleotide
  source 1..24: mol_type = other DNA
gggcgactcccgcgggagtcgccc

SEQ ID NO: 1064 - DNA, 24 bp, synthetic construct
  misc_feature 1..24: note = Description of Artificial Sequence: Syntheticoligonucleotide
  source 1..24: mol_type = other DNA
aggcgactcccgcgggagtcgcct

SEQ ID NO: 1065 - DNA, 24 bp, synthetic construct
  misc_feature 1..24: note = Description of Artificial Sequence: Syntheticoligonucleotide
  source 1..24: mol_type = other DNA
gagcgactcccgcgggagtcgctc

SEQ ID NO: 1066 - DNA, 24 bp, synthetic construct
  misc_feature 1..24: note = Description of Artificial Sequence: Syntheticoligonucleotide
  source 1..24: mol_type = other DNA
ggacgactcccgcgggagtcgtcc

SEQ ID NO: 1067 - DNA, 24 bp, synthetic construct
  misc_feature 1..24: note = Description of Artificial Sequence: Syntheticoligonucleotide
  source 1..24: mol_type = other DNA
gggagactcccgcgggagtctccc

SEQ ID NO: 1068 - DNA, 24 bp, synthetic construct
  misc_feature 1..24: note = Description of Artificial Sequence: Syntheticoligonucleotide
  source 1..24: mol_type = other DNA
tggcgactcccgcgggagtcgcca

SEQ ID NO: 1069 - DNA, 24 bp, synthetic construct
  misc_feature 1..24: note = Description of Artificial Sequence: Syntheticoligonucleotide
  source 1..24: mol_type = other DNA
gtgcgactcccgcgggagtcgcac

SEQ ID NO: 1070 - DNA, 24 bp, synthetic construct
  misc_feature 1..24: note = Description of Artificial Sequence: Syntheticoligonucleotide
  source 1..24: mol_type = other DNA
gggtgactcccgcgggagtcaccc

SEQ ID NO: 1071 - DNA, 24 bp, synthetic construct
  misc_feature 1..24: note = Description of Artificial Sequence: Syntheticoligonucleotide
  source 1..24: mol_type = other DNA
acgggactcccgcgggagtcccgt

SEQ ID NO: 1072 - DNA, 24 bp, synthetic construct
  misc_feature 1..24: note = Description of Artificial Sequence: Syntheticoligonucleotide
  source 1..24: mol_type = other DNA
cagggactcccgcgggagtccctg

SEQ ID NO: 1073 - DNA, 24 bp, synthetic construct
  misc_feature 1..24: note = Description of Artificial Sequence: Syntheticoligonucleotide
  source 1..24: mol_type = other DNA
ccaggactcccgcgggagtcctgg

SEQ ID NO: 1074 - DNA, 24 bp, synthetic construct
  misc_feature 1..24: note = Description of Artificial Sequence: Syntheticoligonucleotide
  source 1..24: mol_type = other DNA
ccgagactcccgcgggagtctcgg

SEQ ID NO: 1075 - DNA, 24 bp, synthetic construct
  misc_feature 1..24: note = Description of Artificial Sequence: Syntheticoligonucleotide
  source 1..24: mol_type = other DNA
tcgggactcccgcgggagtcccga

SEQ ID NO: 1076 - DNA, 24 bp, synthetic construct
  misc_feature 1..24: note = Description of Artificial Sequence: Syntheticoligonucleotide
  source 1..24: mol_type = other DNA
ctgggactcccgcgggagtcccag

SEQ ID NO: 1077 - DNA, 24 bp, synthetic construct
  misc_feature 1..24: note = Description of Artificial Sequence: Syntheticoligonucleotide
  source 1..24: mol_type = other DNA
cctggactcccgcgggagtccagg

SEQ ID NO: 1078 - DNA, 24 bp, synthetic construct
  misc_feature 1..24: note = Description of Artificial Sequence: Syntheticoligonucleotide
  source 1..24: mol_type = other DNA
ccgtgactcccgcgggagtcacgg

SEQ ID NO: 1079 - DNA, 24 bp, synthetic construct
  misc_feature 1..24: note = Description of Artificial Sequence: Syntheticoligonucleotide
  source 1..24: mol_type = other DNA
cggcgactcccgcgggagtcgccg

SEQ ID NO: 1080 - DNA, 24 bp, synthetic construct
  misc_feature 1..24: note = Description of Artificial Sequence: Syntheticoligonucleotide
  source 1..24: mol_type = other DNA
cagcgactcccgcgggagtcgctg

SEQ ID NO: 1081 - DNA, 24 bp, synthetic construct
  misc_feature 1..24: note = Description of Artificial Sequence: Syntheticoligonucleotide
  source 1..24: mol_type = other DNA
cgacgactcccgcgggagtcgtcg

SEQ ID NO: 1082 - DNA, 24 bp, synthetic construct
  misc_feature 1..24: note = Description of Artificial Sequence: Syntheticoligonucleotide
  source 1..24: mol_type = other DNA
cggagactcccgcgggagtctccg

SEQ ID NO: 1083 - DNA, 24 bp, synthetic construct
  misc_feature 1..24: note = Description of Artificial Sequence: Syntheticoligonucleotide
  source 1..24: mol_type = other DNA
ctgcgactcccgcgggagtcgcag

SEQ ID NO: 1084 - DNA, 24 bp, synthetic construct
  misc_feature 1..24: note = Description of Artificial Sequence: Syntheticoligonucleotide
  source 1..24: mol_type = other DNA
cggtgactcccgcgggagtcaccg

SEQ ID NO: 1085 - DNA, 24 bp, synthetic construct
  misc_feature 1..24: note = Description of Artificial Sequence: Syntheticoligonucleotide
  source 1..24: mol_type = other DNA
cacggactcccgcgggagtccgtg

SEQ ID NO: 1086 - DNA, 24 bp, synthetic construct
  misc_feature 1..24: note = Description of Artificial Sequence: Syntheticoligonucleotide
  source 1..24: mol_type = other DNA
cccagactcccgcgggagtctggg

SEQ ID NO: 1087 - DNA, 24 bp, synthetic construct
  misc_feature 1..24: note = Description of Artificial Sequence: Syntheticoligonucleotide
  source 1..24: mol_type = other DNA
ctcggactcccgcgggagtccgag

SEQ ID NO: 1088 - DNA, 24 bp, synthetic construct
  misc_feature 1..24: note = Description of Artificial Sequence: Syntheticoligonucleotide
  source 1..24: mol_type = other DNA
ccctgactcccgcgggagtcaggg

SEQ ID NO: 1089 - DNA, 24 bp, synthetic construct
  misc_feature 1..24: note = Description of Artificial Sequence: Syntheticoligonucleotide
  source 1..24: mol_type = other DNA
ccacgactcccgcgggagtcgtgg

SEQ ID NO: 1090 - DNA, 24 bp, synthetic construct
  misc_feature 1..24: note = Description of Artificial Sequence: Syntheticoligonucleotide
  source 1..24: mol_type = other DNA
agccgactcccgcgggagtcggct

SEQ ID NO: 1091 - DNA, 24 bp, synthetic construct
  misc_feature 1..24: note = Description of Artificial Sequence: Syntheticoligonucleotide
  source 1..24: mol_type = other DNA
tgccgactcccgcgggagtcggca

SEQ ID NO: 1092 - DNA, 24 bp, synthetic construct
  misc_feature 1..24: note = Description of Artificial Sequence: Syntheticoligonucleotide
  source 1..24: mol_type = other DNA
gcgagactcccgcgggagtctcgc

SEQ ID NO: 1093 - DNA, 24 bp, synthetic construct
  misc_feature 1..24: note = Description of Artificial Sequence: Syntheticoligonucleotide
  source 1..24: mol_type = other DNA
gcgtgactcccgcgggagtcacgc

SEQ ID NO: 1094 - DNA, 24 bp, synthetic construct
  misc_feature 1..24: note = Description of Artificial Sequence: Syntheticoligonucleotide
  source 1..24: mol_type = other DNA
gcaggactcccgcgggagtcctgc

SEQ ID NO: 1095 - DNA, 24 bp, synthetic construct
  misc_feature 1..24: note = Description of Artificial Sequence: Syntheticoligonucleotide
  source 1..24: mol_type = other DNA
gctggactcccgcgggagtccagc

SEQ ID NO: 1096 - DNA, 24 bp, synthetic construct
  misc_feature 1..24: note = Description of Artificial Sequence: Syntheticoligonucleotide
  source 1..24: mol_type = other DNA
cgaggactcccgcgggagtcctcg

SEQ ID NO: 1097 - DNA, 24 bp, synthetic construct
  misc_feature 1..24: note = Description of Artificial Sequence: Syntheticoligonucleotide
  source 1..24: mol_type = other DNA
cgtggactcccgcgggagtccacg

SEQ ID NO: 1098 - DNA, 24 bp, synthetic construct
  misc_feature 1..24: note = Description of Artificial Sequence: Syntheticoligonucleotide
  source 1..24: mol_type = other DNA
caccgactcccgcgggagtcggtg

SEQ ID NO: 1099 - DNA, 24 bp, synthetic construct
  misc_feature 1..24: note = Description of Artificial Sequence: Syntheticoligonucleotide
  source 1..24: mol_type = other DNA
ctccgactcccgcgggagtcggag

SEQ ID NO: 1100 - DNA, 24 bp, synthetic construct
  misc_feature 1..24: note = Description of Artificial Sequence: Syntheticoligonucleotide
  source 1..24: mol_type = other DNA
gcgggactcccgcgggagtcccgc

SEQ ID NO: 1101 - DNA, 24 bp, synthetic construct
  misc_feature 1..24: note = Description of Artificial Sequence: Syntheticoligonucleotide
  source 1..24: mol_type = other DNA
gagggactcccgcgggagtccctc

SEQ ID NO: 1102 - DNA, 24 bp, synthetic construct
  misc_feature 1..24: note = Description of Artificial Sequence: Syntheticoligonucleotide
  source 1..24: mol_type = other DNA
gtgggactcccgcgggagtcccac

SEQ ID NO: 1103 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactccccggggagtcnnnn

SEQ ID NO: 1104 - DNA, 24 bp, synthetic construct
  misc_feature 1..24: note = Description of Artificial Sequence: Syntheticoligonucleotide
  source 1..24: mol_type = other DNA
ggcggactccccggggagtccgcc

SEQ ID NO: 1105 - DNA, 24 bp, synthetic construct
  misc_feature 1..24: note = Description of Artificial Sequence: Syntheticoligonucleotide
  source 1..24: mol_type = other DNA
agcggactccccggggagtccgct

SEQ ID NO: 1106 - DNA, 24 bp, synthetic construct
  misc_feature 1..24: note = Description of Artificial Sequence: Syntheticoligonucleotide
  source 1..24: mol_type = other DNA
gacggactccccggggagtccgtc

SEQ ID NO: 1107 - DNA, 24 bp, synthetic construct
  misc_feature 1..24: note = Description of Artificial Sequence: Syntheticoligonucleotide
  source 1..24: mol_type = other DNA
ggaggactccccggggagtcctcc

SEQ ID NO: 1108 - DNA, 24 bp, synthetic construct
  misc_feature 1..24: note = Description of Artificial Sequence: Syntheticoligonucleotide
  source 1..24: mol_type = other DNA
ggcagactccccggggagtctgcc

SEQ ID NO: 1109 - DNA, 24 bp, synthetic construct
  misc_feature 1..24: note = Description of Artificial Sequence: Syntheticoligonucleotide
  source 1..24: mol_type = other DNA
tgcggactccccggggagtccgca

SEQ ID NO: 1110 - DNA, 24 bp, synthetic construct
  misc_feature 1..24: note = Description of Artificial Sequence: Syntheticoligonucleotide
  source 1..24: mol_type = other DNA
gtcggactccccggggagtccgac

SEQ ID NO: 1111 - DNA, 24 bp, synthetic construct
  misc_feature 1..24: note = Description of Artificial Sequence: Syntheticoligonucleotide
  source 1..24: mol_type = other DNA
ggtggactccccggggagtccacc

SEQ ID NO: 1112 - DNA, 24 bp, synthetic construct
  misc_feature 1..24: note = Description of Artificial Sequence: Syntheticoligonucleotide
  source 1..24: mol_type = other DNA
ggctgactccccggggagtcagcc

SEQ ID NO: 1113 - DNA, 24 bp, synthetic construct
  misc_feature 1..24: note = Description of Artificial Sequence: Syntheticoligonucleotide
  source 1..24: mol_type = other DNA
gcccgactccccggggagtcgggc

SEQ ID NO: 1114 - DNA, 24 bp, synthetic construct
  misc_feature 1..24: note = Description of Artificial Sequence: Syntheticoligonucleotide
  source 1..24: mol_type = other DNA
acccgactccccggggagtcgggt

SEQ ID NO: 1115 - DNA, 24 bp, synthetic construct
  misc_feature 1..24: note = Description of Artificial Sequence: Syntheticoligonucleotide
  source 1..24: mol_type = other DNA
gaccgactccccggggagtcggtc

SEQ ID NO: 1116 - DNA, 24 bp, synthetic construct
  misc_feature 1..24: note = Description of Artificial Sequence: Syntheticoligonucleotide
  source 1..24: mol_type = other DNA
gcacgactccccggggagtcgtgc

SEQ ID NO: 1117 - DNA, 24 bp, synthetic construct
  misc_feature 1..24: note = Description of Artificial Sequence: Syntheticoligonucleotide
  source 1..24: mol_type = other DNA
gccagactccccggggagtctggc

SEQ ID NO: 1118 - DNA, 24 bp, synthetic construct
  misc_feature 1..24: note = Description of Artificial Sequence: Syntheticoligonucleotide
  source 1..24: mol_type = other DNA
tcccgactccccggggagtcggga

SEQ ID NO: 1119 - DNA, 24 bp, synthetic construct
  misc_feature 1..24: note = Description of Artificial Sequence: Syntheticoligonucleotide
  source 1..24: mol_type = other DNA
gtccgactccccggggagtcggac

SEQ ID NO: 1120 - DNA, 24 bp, synthetic construct
  misc_feature 1..24: note = Description of Artificial Sequence: Syntheticoligonucleotide
  source 1..24: mol_type = other DNA
gcctgactccccggggagtcaggc

SEQ ID NO: 1121 - DNA, 24 bp, synthetic construct
  misc_feature 1..24: note = Description of Artificial Sequence: Syntheticoligonucleotide
  source 1..24: mol_type = other DNA
gggcgactccccggggagtcgccc

SEQ ID NO: 1122 - DNA, 24 bp, synthetic construct
  misc_feature 1..24: note = Description of Artificial Sequence: Syntheticoligonucleotide
  source 1..24: mol_type = other DNA
aggcgactccccggggagtcgcct

SEQ ID NO: 1123 - DNA, 24 bp, synthetic construct
  misc_feature 1..24: note = Description of Artificial Sequence: Syntheticoligonucleotide
  source 1..24: mol_type = other DNA
gagcgactccccggggagtcgctc

SEQ ID NO: 1124 - DNA, 24 bp, synthetic construct
  misc_feature 1..24: note = Description of Artificial Sequence: Syntheticoligonucleotide
  source 1..24: mol_type = other DNA
ggacgactccccggggagtcgtcc

SEQ ID NO: 1125 - DNA, 24 bp, synthetic construct
  misc_feature 1..24: note = Description of Artificial Sequence: Syntheticoligonucleotide
  source 1..24: mol_type = other DNA
gggagactccccggggagtctccc

SEQ ID NO: 1126 - DNA, 24 bp, synthetic construct
  misc_feature 1..24: note = Description of Artificial Sequence: Syntheticoligonucleotide
  source 1..24: mol_type = other DNA
tggcgactccccggggagtcgcca

SEQ ID NO: 1127 - DNA, 24 bp, synthetic construct
  misc_feature 1..24: note = Description of Artificial Sequence: Syntheticoligonucleotide
  source 1..24: mol_type = other DNA
gtgcgactccccggggagtcgcac

SEQ ID NO: 1128 - DNA, 24 bp, synthetic construct
  misc_feature 1..24: note = Description of Artificial Sequence: Syntheticoligonucleotide
  source 1..24: mol_type = other DNA
gggtgactccccggggagtcaccc

SEQ ID NO: 1129 - DNA, 24 bp, synthetic construct
  misc_feature 1..24: note = Description of Artificial Sequence: Syntheticoligonucleotide
  source 1..24: mol_type = other DNA
acgggactccccggggagtcccgt

SEQ ID NO: 1130 - DNA, 24 bp, synthetic construct
  misc_feature 1..24: note = Description of Artificial Sequence: Syntheticoligonucleotide
  source 1..24: mol_type = other DNA
cagggactccccggggagtccctg

SEQ ID NO: 1131 - DNA, 24 bp, synthetic construct
  misc_feature 1..24: note = Description of Artificial Sequence: Syntheticoligonucleotide
  source 1..24: mol_type = other DNA
ccaggactccccggggagtcctgg

SEQ ID NO: 1132 - DNA, 24 bp, synthetic construct
  misc_feature 1..24: note = Description of Artificial Sequence: Syntheticoligonucleotide
  source 1..24: mol_type = other DNA
ccgagactccccggggagtctcgg

SEQ ID NO: 1133 - DNA, 24 bp, synthetic construct
  misc_feature 1..24: note = Description of Artificial Sequence: Syntheticoligonucleotide
  source 1..24: mol_type = other DNA
tcgggactccccggggagtcccga

SEQ ID NO: 1134 - DNA, 24 bp, synthetic construct
  misc_feature 1..24: note = Description of Artificial Sequence: Syntheticoligonucleotide
  source 1..24: mol_type = other DNA
ctgggactccccggggagtcccag

SEQ ID NO: 1135 - DNA, 24 bp, synthetic construct
  misc_feature 1..24: note = Description of Artificial Sequence: Syntheticoligonucleotide
  source 1..24: mol_type = other DNA
cctggactccccggggagtccagg

SEQ ID NO: 1136 - DNA, 24 bp, synthetic construct
  misc_feature 1..24: note = Description of Artificial Sequence: Syntheticoligonucleotide
  source 1..24: mol_type = other DNA
ccgtgactccccggggagtcacgg

SEQ ID NO: 1137 - DNA, 24 bp, synthetic construct
  misc_feature 1..24: note = Description of Artificial Sequence: Syntheticoligonucleotide
  source 1..24: mol_type = other DNA
cggcgactccccggggagtcgccg

SEQ ID NO: 1138 - DNA, 24 bp, synthetic construct
  misc_feature 1..24: note = Description of Artificial Sequence: Syntheticoligonucleotide
  source 1..24: mol_type = other DNA
cagcgactccccggggagtcgctg

SEQ ID NO: 1139 - DNA, 24 bp, synthetic construct
  misc_feature 1..24: note = Description of Artificial Sequence: Syntheticoligonucleotide
  source 1..24: mol_type = other DNA
cgacgactccccggggagtcgtcg

SEQ ID NO: 1140 - DNA, 24 bp, synthetic construct
  misc_feature 1..24: note = Description of Artificial Sequence: Syntheticoligonucleotide
  source 1..24: mol_type = other DNA
cggagactccccggggagtctccg

SEQ ID NO: 1141 - DNA, 24 bp, synthetic construct
  misc_feature 1..24: note = Description of Artificial Sequence: Syntheticoligonucleotide
  source 1..24: mol_type = other DNA
ctgcgactccccggggagtcgcag

SEQ ID NO: 1142 - DNA, 24 bp, synthetic construct
  misc_feature 1..24: note = Description of Artificial Sequence: Syntheticoligonucleotide
  source 1..24: mol_type = other DNA
cggtgactccccggggagtcaccg

SEQ ID NO: 1143 - DNA, 24 bp, synthetic construct
  misc_feature 1..24: note = Description of Artificial Sequence: Syntheticoligonucleotide
  source 1..24: mol_type = other DNA
cacggactccccggggagtccgtg

SEQ ID NO: 1144 - DNA, 24 bp, synthetic construct
  misc_feature 1..24: note = Description of Artificial Sequence: Syntheticoligonucleotide
  source 1..24: mol_type = other DNA
cccagactccccggggagtctggg

SEQ ID NO: 1145 - DNA, 24 bp, synthetic construct
  misc_feature 1..24: note = Description of Artificial Sequence: Syntheticoligonucleotide
  source 1..24: mol_type = other DNA
ctcggactccccggggagtccgag

SEQ ID NO: 1146 - DNA, 24 bp, synthetic construct
  misc_feature 1..24: note = Description of Artificial Sequence: Syntheticoligonucleotide
  source 1..24: mol_type = other DNA
ccctgactccccggggagtcaggg

SEQ ID NO: 1147 - DNA, 24 bp, synthetic construct
  misc_feature 1..24: note = Description of Artificial Sequence: Syntheticoligonucleotide
  source 1..24: mol_type = other DNA
ccacgactccccggggagtcgtgg

SEQ ID NO: 1148 - DNA, 24 bp, synthetic construct
  misc_feature 1..24: note = Description of Artificial Sequence: Syntheticoligonucleotide
  source 1..24: mol_type = other DNA
agccgactccccggggagtcggct

SEQ ID NO: 1149 - DNA, 24 bp, synthetic construct
  misc_feature 1..24: note = Description of Artificial Sequence: Syntheticoligonucleotide
  source 1..24: mol_type = other DNA
tgccgactccccggggagtcggca

SEQ ID NO: 1150 - DNA, 24 bp, synthetic construct
  misc_feature 1..24: note = Description of Artificial Sequence: Syntheticoligonucleotide
  source 1..24: mol_type = other DNA
gcgagactccccggggagtctcgc

SEQ ID NO: 1151 - DNA, 24 bp, synthetic construct
  misc_feature 1..24: note = Description of Artificial Sequence: Syntheticoligonucleotide
  source 1..24: mol_type = other DNA
gcgtgactccccggggagtcacgc

SEQ ID NO: 1152 - DNA, 24 bp, synthetic construct
  misc_feature 1..24: note = Description of Artificial Sequence: Syntheticoligonucleotide
  source 1..24: mol_type = other DNA
gcaggactccccggggagtcctgc

SEQ ID NO: 1153 - DNA, 24 bp, synthetic construct
  misc_feature 1..24: note = Description of Artificial Sequence: Syntheticoligonucleotide
  source 1..24: mol_type = other DNA
gctggactccccggggagtccagc

SEQ ID NO: 1154 - DNA, 24 bp, synthetic construct
  misc_feature 1..24: note = Description of Artificial Sequence: Syntheticoligonucleotide
  source 1..24: mol_type = other DNA
cgaggactccccggggagtcctcg

SEQ ID NO: 1155 - DNA, 24 bp, synthetic construct
  misc_feature 1..24: note = Description of Artificial Sequence: Syntheticoligonucleotide
  source 1..24: mol_type = other DNA
cgtggactccccggggagtccacg

SEQ ID NO: 1156 - DNA, 24 bp, synthetic construct
  misc_feature 1..24: note = Description of Artificial Sequence: Syntheticoligonucleotide
  source 1..24: mol_type = other DNA
caccgactccccggggagtcggtg

SEQ ID NO: 1157 - DNA, 24 bp, synthetic construct
  misc_feature 1..24: note = Description of Artificial Sequence: Syntheticoligonucleotide
  source 1..24: mol_type = other DNA
ctccgactccccggggagtcggag

SEQ ID NO: 1158 - DNA, 24 bp, synthetic construct
  misc_feature 1..24: note = Description of Artificial Sequence: Syntheticoligonucleotide
  source 1..24: mol_type = other DNA
gcgggactccccggggagtcccgc

SEQ ID NO: 1159 - DNA, 24 bp, synthetic construct
  misc_feature 1..24: note = Description of Artificial Sequence: Syntheticoligonucleotide
  source 1..24: mol_type = other DNA
gagggactccccggggagtccctc

SEQ ID NO: 1160 - DNA, 24 bp, synthetic construct
  misc_feature 1..24: note = Description of Artificial Sequence: Syntheticoligonucleotide
  source 1..24: mol_type = other DNA
gtgggactccccggggagtcccac

SEQ ID NO: 1161 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcgtatacgagtcnnnn

SEQ ID NO: 1162 - DNA, 24 bp, synthetic construct
  misc_feature 1..24: note = Description of Artificial Sequence: Syntheticoligonucleotide
  source 1..24: mol_type = other DNA
ggcggactcgtatacgagtccgcc

SEQ ID NO: 1163 - DNA, 24 bp, synthetic construct
  misc_feature 1..24: note = Description of Artificial Sequence: Syntheticoligonucleotide
  source 1..24: mol_type = other DNA
agcggactcgtatacgagtccgct

SEQ ID NO: 1164 - DNA, 24 bp, synthetic construct
  misc_feature 1..24: note = Description of Artificial Sequence: Syntheticoligonucleotide
  source 1..24: mol_type = other DNA
gacggactcgtatacgagtccgtc

SEQ ID NO: 1165 - DNA, 24 bp, synthetic construct
  misc_feature 1..24: note = Description of Artificial Sequence: Syntheticoligonucleotide
  source 1..24: mol_type = other DNA
ggaggactcgtatacgagtcctcc

SEQ ID NO: 1166 - DNA, 24 bp, synthetic construct
  misc_feature 1..24: note = Description of Artificial Sequence: Syntheticoligonucleotide
  source 1..24: mol_type = other DNA
ggcagactcgtatacgagtctgcc

SEQ ID NO: 1167 - DNA, 24 bp, synthetic construct
  misc_feature 1..24: note = Description of Artificial Sequence: Syntheticoligonucleotide
  source 1..24: mol_type = other DNA
tgcggactcgtatacgagtccgca

SEQ ID NO: 1168 - DNA, 24 bp, synthetic construct
  misc_feature 1..24: note = Description of Artificial Sequence: Syntheticoligonucleotide
  source 1..24: mol_type = other DNA
gtcggactcgtatacgagtccgac

SEQ ID NO: 1169 - DNA, 24 bp, synthetic construct
  misc_feature 1..24: note = Description of Artificial Sequence: Syntheticoligonucleotide
  source 1..24: mol_type = other DNA
ggtggactcgtatacgagtccacc

SEQ ID NO: 1170 - DNA, 24 bp, synthetic construct
  misc_feature 1..24: note = Description of Artificial Sequence: Syntheticoligonucleotide
  source 1..24: mol_type = other DNA
ggctgactcgtatacgagtcagcc

SEQ ID NO: 1171 - DNA, 24 bp, synthetic construct
  misc_feature 1..24: note = Description of Artificial Sequence: Syntheticoligonucleotide
  source 1..24: mol_type = other DNA
gcccgactcgtatacgagtcgggc

SEQ ID NO: 1172 - DNA, 24 bp, synthetic construct
  misc_feature 1..24: note = Description of Artificial Sequence: Syntheticoligonucleotide
  source 1..24: mol_type = other DNA
acccgactcgtatacgagtcgggt

SEQ ID NO: 1173 - DNA, 24 bp, synthetic construct
  misc_feature 1..24: note = Description of Artificial Sequence: Syntheticoligonucleotide
  source 1..24: mol_type = other DNA
gaccgactcgtatacgagtcggtc

SEQ ID NO: 1174 - DNA, 24 bp, synthetic construct
  misc_feature 1..24: note = Description of Artificial Sequence: Syntheticoligonucleotide
  source 1..24: mol_type = other DNA
gcacgactcgtatacgagtcgtgc

SEQ ID NO: 1175 - DNA, 24 bp, synthetic construct
  misc_feature 1..24: note = Description of Artificial Sequence: Syntheticoligonucleotide
  source 1..24: mol_type = other DNA
gccagactcgtatacgagtctggc

SEQ ID NO: 1176 - DNA, 24 bp, synthetic construct
  misc_feature 1..24: note = Description of Artificial Sequence: Syntheticoligonucleotide
  source 1..24: mol_type = other DNA
tcccgactcgtatacgagtcggga

SEQ ID NO: 1177 - DNA, 24 bp, synthetic construct
  misc_feature 1..24: note = Description of Artificial Sequence: Syntheticoligonucleotide
  source 1..24: mol_type = other DNA
gtccgactcgtatacgagtcggac

SEQ ID NO: 1178 - DNA, 24 bp, synthetic construct
  misc_feature 1..24: note = Description of Artificial Sequence: Syntheticoligonucleotide
  source 1..24: mol_type = other DNA
gcctgactcgtatacgagtcaggc

SEQ ID NO: 1179 - DNA, 24 bp, synthetic construct
  misc_feature 1..24: note = Description of Artificial Sequence: Syntheticoligonucleotide
  source 1..24: mol_type = other DNA
gggcgactcgtatacgagtcgccc

SEQ ID NO: 1180 - DNA, 24 bp, synthetic construct
  misc_feature 1..24: note = Description of Artificial Sequence: Syntheticoligonucleotide
  source 1..24: mol_type = other DNA
aggcgactcgtatacgagtcgcct

SEQ ID NO: 1181 - DNA, 24 bp, synthetic construct
  misc_feature 1..24: note = Description of Artificial Sequence: Syntheticoligonucleotide
  source 1..24: mol_type = other DNA
gagcgactcgtatacgagtcgctc

SEQ ID NO: 1182 - DNA, 24 bp, synthetic construct
  misc_feature 1..24: note = Description of Artificial Sequence: Syntheticoligonucleotide
  source 1..24: mol_type = other DNA
ggacgactcgtatacgagtcgtcc

SEQ ID NO: 1183 - DNA, 24 bp, synthetic construct
  misc_feature 1..24: note = Description of Artificial Sequence: Syntheticoligonucleotide
  source 1..24: mol_type = other DNA
gggagactcgtatacgagtctccc

SEQ ID NO: 1184 - DNA, 24 bp, synthetic construct
  misc_feature 1..24: note = Description of Artificial Sequence: Syntheticoligonucleotide
  source 1..24: mol_type = other DNA
tggcgactcgtatacgagtcgcca

SEQ ID NO: 1185 - DNA, 24 bp, synthetic construct
  misc_feature 1..24: note = Description of Artificial Sequence: Syntheticoligonucleotide
  source 1..24: mol_type = other DNA
gtgcgactcgtatacgagtcgcac

SEQ ID NO: 1186 - DNA, 24 bp, synthetic construct
  misc_feature 1..24: note = Description of Artificial Sequence: Syntheticoligonucleotide
  source 1..24: mol_type = other DNA
gggtgactcgtatacgagtcaccc

SEQ ID NO: 1187 - DNA, 24 bp, synthetic construct
  misc_feature 1..24: note = Description of Artificial Sequence: Syntheticoligonucleotide
  source 1..24: mol_type = other DNA
acgggactcgtatacgagtcccgt

SEQ ID NO: 1188 - DNA, 24 bp, synthetic construct
  misc_feature 1..24: note = Description of Artificial Sequence: Syntheticoligonucleotide
  source 1..24: mol_type = other DNA
cagggactcgtatacgagtccctg

SEQ ID NO: 1189 - DNA, 24 bp, synthetic construct
  misc_feature 1..24: note = Description of Artificial Sequence: Syntheticoligonucleotide
  source 1..24: mol_type = other DNA
ccaggactcgtatacgagtcctgg

SEQ ID NO: 1190 - DNA, 24 bp, synthetic construct
  misc_feature 1..24: note = Description of Artificial Sequence: Syntheticoligonucleotide
  source 1..24: mol_type = other DNA
ccgagactcgtatacgagtctcgg

SEQ ID NO: 1191 - DNA, 24 bp, synthetic construct
  misc_feature 1..24: note = Description of Artificial Sequence: Syntheticoligonucleotide
  source 1..24: mol_type = other DNA
tcgggactcgtatacgagtcccga

SEQ ID NO: 1192 - DNA, 24 bp, synthetic construct
  misc_feature 1..24: note = Description of Artificial Sequence: Syntheticoligonucleotide
  source 1..24: mol_type = other DNA
ctgggactcgtatacgagtcccag

SEQ ID NO: 1193 - DNA, 24 bp, synthetic construct
  misc_feature 1..24: note = Description of Artificial Sequence: Syntheticoligonucleotide
  source 1..24: mol_type = other DNA
cctggactcgtatacgagtccagg

SEQ ID NO: 1194 - DNA, 24 bp, synthetic construct
  misc_feature 1..24: note = Description of Artificial Sequence: Syntheticoligonucleotide
  source 1..24: mol_type = other DNA
ccgtgactcgtatacgagtcacgg

SEQ ID NO: 1195 - DNA, 24 bp, synthetic construct
  misc_feature 1..24: note = Description of Artificial Sequence: Syntheticoligonucleotide
  source 1..24: mol_type = other DNA
cggcgactcgtatacgagtcgccg

SEQ ID NO: 1196 - DNA, 24 bp, synthetic construct
  misc_feature 1..24: note = Description of Artificial Sequence: Syntheticoligonucleotide
  source 1..24: mol_type = other DNA
cagcgactcgtatacgagtcgctg

SEQ ID NO: 1197 - DNA, 24 bp, synthetic construct
  misc_feature 1..24: note = Description of Artificial Sequence: Syntheticoligonucleotide
  source 1..24: mol_type = other DNA
cgacgactcgtatacgagtcgtcg

SEQ ID NO: 1198 - DNA, 24 bp, synthetic construct
  misc_feature 1..24: note = Description of Artificial Sequence: Syntheticoligonucleotide
  source 1..24: mol_type = other DNA
cggagactcgtatacgagtctccg

SEQ ID NO: 1199 - DNA, 24 bp, synthetic construct
  misc_feature 1..24: note = Description of Artificial Sequence: Syntheticoligonucleotide
  source 1..24: mol_type = other DNA
ctgcgactcgtatacgagtcgcag

SEQ ID NO: 1200 - DNA, 24 bp, synthetic construct
  misc_feature 1..24: note = Description of Artificial Sequence: Syntheticoligonucleotide
  source 1..24: mol_type = other DNA
cggtgactcgtatacgagtcaccg

SEQ ID NO: 1201 - DNA, 24 bp, synthetic construct
  misc_feature 1..24: note = Description of Artificial Sequence: Syntheticoligonucleotide
  source 1..24: mol_type = other DNA
cacggactcgtatacgagtccgtg

SEQ ID NO: 1202 - DNA, 24 bp, synthetic construct
  misc_feature 1..24: note = Description of Artificial Sequence: Syntheticoligonucleotide
  source 1..24: mol_type = other DNA
cccagactcgtatacgagtctggg

SEQ ID NO: 1203 - DNA, 24 bp, synthetic construct
  misc_feature 1..24: note = Description of Artificial Sequence: Syntheticoligonucleotide
  source 1..24: mol_type = other DNA
ctcggactcgtatacgagtccgag

SEQ ID NO: 1204 - DNA, 24 bp, synthetic construct
  misc_feature 1..24: note = Description of Artificial Sequence: Syntheticoligonucleotide
  source 1..24: mol_type = other DNA
ccctgactcgtatacgagtcaggg

SEQ ID NO: 1205 - DNA, 24 bp, synthetic construct
  misc_feature 1..24: note = Description of Artificial Sequence: Syntheticoligonucleotide
  source 1..24: mol_type = other DNA
ccacgactcgtatacgagtcgtgg

SEQ ID NO: 1206 - DNA, 24 bp, synthetic construct
  misc_feature 1..24: note = Description of Artificial Sequence: Syntheticoligonucleotide
  source 1..24: mol_type = other DNA
agccgactcgtatacgagtcggct

SEQ ID NO: 1207 - DNA, 24 bp, synthetic construct
  misc_feature 1..24: note = Description of Artificial Sequence: Syntheticoligonucleotide
  source 1..24: mol_type = other DNA
tgccgactcgtatacgagtcggca

SEQ ID NO: 1208 - DNA, 24 bp, synthetic construct
  misc_feature 1..24: note = Description of Artificial Sequence: Syntheticoligonucleotide
  source 1..24: mol_type = other DNA
gcgagactcgtatacgagtctcgc

SEQ ID NO: 1209 - DNA, 24 bp, synthetic construct
  misc_feature 1..24: note = Description of Artificial Sequence: Syntheticoligonucleotide
  source 1..24: mol_type = other DNA
gcgtgactcgtatacgagtcacgc

SEQ ID NO: 1210 - DNA, 24 bp, synthetic construct
  misc_feature 1..24: note = Description of Artificial Sequence: Syntheticoligonucleotide
  source 1..24: mol_type = other DNA
gcaggactcgtatacgagtcctgc

SEQ ID NO: 1211 - DNA, 24 bp, synthetic construct
  misc_feature 1..24: note = Description of Artificial Sequence: Syntheticoligonucleotide
  source 1..24: mol_type = other DNA
gctggactcgtatacgagtccagc

SEQ ID NO: 1212 - DNA, 24 bp, synthetic construct
  misc_feature 1..24: note = Description of Artificial Sequence: Syntheticoligonucleotide
  source 1..24: mol_type = other DNA
cgaggactcgtatacgagtcctcg

SEQ ID NO: 1213 - DNA, 24 bp, synthetic construct
  misc_feature 1..24: note = Description of Artificial Sequence: Syntheticoligonucleotide
  source 1..24: mol_type = other DNA
cgtggactcgtatacgagtccacg

SEQ ID NO: 1214 - DNA, 24 bp, synthetic construct
  misc_feature 1..24: note = Description of Artificial Sequence: Syntheticoligonucleotide
  source 1..24: mol_type = other DNA
caccgactcgtatacgagtcggtg

SEQ ID NO: 1215 - DNA, 24 bp, synthetic construct
  misc_feature 1..24: note = Description of Artificial Sequence: Syntheticoligonucleotide
  source 1..24: mol_type = other DNA
ctccgactcgtatacgagtcggag

SEQ ID NO: 1216 - DNA, 24 bp, synthetic construct
  misc_feature 1..24: note = Description of Artificial Sequence: Syntheticoligonucleotide
  source 1..24: mol_type = other DNA
gcgggactcgtatacgagtcccgc

SEQ ID NO: 1217 - DNA, 24 bp, synthetic construct
  misc_feature 1..24: note = Description of Artificial Sequence: Syntheticoligonucleotide
  source 1..24: mol_type = other DNA
gagggactcgtatacgagtccctc

SEQ ID NO: 1218 - DNA, 24 bp, synthetic construct
  misc_feature 1..24: note = Description of Artificial Sequence: Syntheticoligonucleotide
  source 1..24: mol_type = other DNA
gtgggactcgtatacgagtcccac

SEQ ID NO: 1219 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcgttaacgagtcnnnn

SEQ ID NO: 1220 - DNA, 24 bp, synthetic construct
  misc_feature 1..24: note = Description of Artificial Sequence: Syntheticoligonucleotide
  source 1..24: mol_type = other DNA
ggcggactcgttaacgagtccgcc

SEQ ID NO: 1221 - DNA, 24 bp, synthetic construct
  misc_feature 1..24: note = Description of Artificial Sequence: Syntheticoligonucleotide
  source 1..24: mol_type = other DNA
agcggactcgttaacgagtccgct

SEQ ID NO: 1222 - DNA, 24 bp, synthetic construct
  misc_feature 1..24: note = Description of Artificial Sequence: Syntheticoligonucleotide
  source 1..24: mol_type = other DNA
gacggactcgttaacgagtccgtc

SEQ ID NO: 1223 - DNA, 24 bp, synthetic construct
  misc_feature 1..24: note = Description of Artificial Sequence: Syntheticoligonucleotide
  source 1..24: mol_type = other DNA
ggaggactcgttaacgagtcctcc

SEQ ID NO: 1224 - DNA, 24 bp, synthetic construct
  misc_feature 1..24: note = Description of Artificial Sequence: Syntheticoligonucleotide
  source 1..24: mol_type = other DNA
ggcagactcgttaacgagtctgcc

SEQ ID NO: 1225 - DNA, 24 bp, synthetic construct
  misc_feature 1..24: note = Description of Artificial Sequence: Syntheticoligonucleotide
  source 1..24: mol_type = other DNA
tgcggactcgttaacgagtccgca

SEQ ID NO: 1226 - DNA, 24 bp, synthetic construct
  misc_feature 1..24: note = Description of Artificial Sequence: Syntheticoligonucleotide
  source 1..24: mol_type = other DNA
gtcggactcgttaacgagtccgac

SEQ ID NO: 1227 - DNA, 24 bp, synthetic construct
  misc_feature 1..24: note = Description of Artificial Sequence: Syntheticoligonucleotide
  source 1..24: mol_type = other DNA
ggtggactcgttaacgagtccacc

SEQ ID NO: 1228 - DNA, 24 bp, synthetic construct
  misc_feature 1..24: note = Description of Artificial Sequence: Syntheticoligonucleotide
  source 1..24: mol_type = other DNA
ggctgactcgttaacgagtcagcc

SEQ ID NO: 1229 - DNA, 24 bp, synthetic construct
  misc_feature 1..24: note = Description of Artificial Sequence: Syntheticoligonucleotide
  source 1..24: mol_type = other DNA
gcccgactcgttaacgagtcgggc

SEQ ID NO: 1230 - DNA, 24 bp, synthetic construct
  misc_feature 1..24: note = Description of Artificial Sequence: Syntheticoligonucleotide
  source 1..24: mol_type = other DNA
acccgactcgttaacgagtcgggt

SEQ ID NO: 1231 - DNA, 24 bp, synthetic construct
  misc_feature 1..24: note = Description of Artificial Sequence: Syntheticoligonucleotide
  source 1..24: mol_type = other DNA
gaccgactcgttaacgagtcggtc

SEQ ID NO: 1232 - DNA, 24 bp, synthetic construct
  misc_feature 1..24: note = Description of Artificial Sequence: Syntheticoligonucleotide
  source 1..24: mol_type = other DNA
gcacgactcgttaacgagtcgtgc

SEQ ID NO: 1233 - DNA, 24 bp, synthetic construct
  misc_feature 1..24: note = Description of Artificial Sequence: Syntheticoligonucleotide
  source 1..24: mol_type = other DNA
gccagactcgttaacgagtctggc

SEQ ID NO: 1234 - DNA, 24 bp, synthetic construct
  misc_feature 1..24: note = Description of Artificial Sequence: Syntheticoligonucleotide
  source 1..24: mol_type = other DNA
tcccgactcgttaacgagtcggga

SEQ ID NO: 1235 - DNA, 24 bp, synthetic construct
  misc_feature 1..24: note = Description of Artificial Sequence: Syntheticoligonucleotide
  source 1..24: mol_type = other DNA
gtccgactcgttaacgagtcggac

SEQ ID NO: 1236 - DNA, 24 bp, synthetic construct
  misc_feature 1..24: note = Description of Artificial Sequence: Syntheticoligonucleotide
  source 1..24: mol_type = other DNA
gcctgactcgttaacgagtcaggc

SEQ ID NO: 1237 - DNA, 24 bp, synthetic construct
  misc_feature 1..24: note = Description of Artificial Sequence: Syntheticoligonucleotide
  source 1..24: mol_type = other DNA
gggcgactcgttaacgagtcgccc

SEQ ID NO: 1238 - DNA, 24 bp, synthetic construct
  misc_feature 1..24: note = Description of Artificial Sequence: Syntheticoligonucleotide
  source 1..24: mol_type = other DNA
aggcgactcgttaacgagtcgcct

SEQ ID NO: 1239 - DNA, 24 bp, synthetic construct
  misc_feature 1..24: note = Description of Artificial Sequence: Syntheticoligonucleotide
  source 1..24: mol_type = other DNA
gagcgactcgttaacgagtcgctc

SEQ ID NO: 1240 - DNA, 24 bp, synthetic construct
  misc_feature 1..24: note = Description of Artificial Sequence: Syntheticoligonucleotide
  source 1..24: mol_type = other DNA
ggacgactcgttaacgagtcgtcc

SEQ ID NO: 1241 - DNA, 24 bp, synthetic construct
  misc_feature 1..24: note = Description of Artificial Sequence: Syntheticoligonucleotide
  source 1..24: mol_type = other DNA
gggagactcgttaacgagtctccc

SEQ ID NO: 1242 - DNA, 24 bp, synthetic construct
  misc_feature 1..24: note = Description of Artificial Sequence: Syntheticoligonucleotide
  source 1..24: mol_type = other DNA
tggcgactcgttaacgagtcgcca

SEQ ID NO: 1243 - DNA, 24 bp, synthetic construct
  misc_feature 1..24: note = Description of Artificial Sequence: Syntheticoligonucleotide
  source 1..24: mol_type = other DNA
gtgcgactcgttaacgagtcgcac

SEQ ID NO: 1244 - DNA, 24 bp, synthetic construct
  misc_feature 1..24: note = Description of Artificial Sequence: Syntheticoligonucleotide
  source 1..24: mol_type = other DNA
gggtgactcgttaacgagtcaccc

SEQ ID NO: 1245 - DNA, 24 bp, synthetic construct
  misc_feature 1..24: note = Description of Artificial Sequence: Syntheticoligonucleotide
  source 1..24: mol_type = other DNA
acgggactcgttaacgagtcccgt

SEQ ID NO: 1246 - DNA, 24 bp, synthetic construct
  misc_feature 1..24: note = Description of Artificial Sequence: Syntheticoligonucleotide
  source 1..24: mol_type = other DNA
cagggactcgttaacgagtccctg

SEQ ID NO: 1247 - DNA, 24 bp, synthetic construct
  misc_feature 1..24: note = Description of Artificial Sequence: Syntheticoligonucleotide
  source 1..24: mol_type = other DNA
ccaggactcgttaacgagtcctgg

SEQ ID NO: 1248 - DNA, 24 bp, synthetic construct
  misc_feature 1..24: note = Description of Artificial Sequence: Syntheticoligonucleotide
  source 1..24: mol_type = other DNA
ccgagactcgttaacgagtctcgg

SEQ ID NO: 1249 - DNA, 24 bp, synthetic construct
  misc_feature 1..24: note = Description of Artificial Sequence: Syntheticoligonucleotide
  source 1..24: mol_type = other DNA
tcgggactcgttaacgagtcccga

SEQ ID NO: 1250 - DNA, 24 bp, synthetic construct
  misc_feature 1..24: note = Description of Artificial Sequence: Syntheticoligonucleotide
  source 1..24: mol_type = other DNA
ctgggactcgttaacgagtcccag

SEQ ID NO: 1251 - DNA, 24 bp, synthetic construct
  misc_feature 1..24: note = Description of Artificial Sequence: Syntheticoligonucleotide
  source 1..24: mol_type = other DNA
cctggactcgttaacgagtccagg

SEQ ID NO: 1252 - DNA, 24 bp, synthetic construct
  misc_feature 1..24: note = Description of Artificial Sequence: Syntheticoligonucleotide
  source 1..24: mol_type = other DNA
ccgtgactcgttaacgagtcacgg

SEQ ID NO: 1253 - DNA, 24 bp, synthetic construct
  misc_feature 1..24: note = Description of Artificial Sequence: Syntheticoligonucleotide
  source 1..24: mol_type = other DNA
cggcgactcgttaacgagtcgccg

SEQ ID NO: 1254 - DNA, 24 bp, synthetic construct
  misc_feature 1..24: note = Description of Artificial Sequence: Syntheticoligonucleotide
  source 1..24: mol_type = other DNA
cagcgactcgttaacgagtcgctg

SEQ ID NO: 1255 - DNA, 24 bp, synthetic construct
  misc_feature 1..24: note = Description of Artificial Sequence: Syntheticoligonucleotide
  source 1..24: mol_type = other DNA
cgacgactcgttaacgagtcgtcg

SEQ ID NO: 1256 - DNA, 24 bp, synthetic construct
  misc_feature 1..24: note = Description of Artificial Sequence: Syntheticoligonucleotide
  source 1..24: mol_type = other DNA
cggagactcgttaacgagtctccg

SEQ ID NO: 1257 - DNA, 24 bp, synthetic construct
  misc_feature 1..24: note = Description of Artificial Sequence: Syntheticoligonucleotide
  source 1..24: mol_type = other DNA
ctgcgactcgttaacgagtcgcag

SEQ ID NO: 1258 - DNA, 24 bp, synthetic construct
  misc_feature 1..24: note = Description of Artificial Sequence: Syntheticoligonucleotide
  source 1..24: mol_type = other DNA
cggtgactcgttaacgagtcaccg

SEQ ID NO: 1259 - DNA, 24 bp, synthetic construct
  misc_feature 1..24: note = Description of Artificial Sequence: Syntheticoligonucleotide
  source 1..24: mol_type = other DNA
cacggactcgttaacgagtccgtg

SEQ ID NO: 1260 - DNA, 24 bp, synthetic construct
  misc_feature 1..24: note = Description of Artificial Sequence: Syntheticoligonucleotide
  source 1..24: mol_type = other DNA
cccagactcgttaacgagtctggg

SEQ ID NO: 1261 - DNA, 24 bp, synthetic construct
  misc_feature 1..24: note = Description of Artificial Sequence: Syntheticoligonucleotide
  source 1..24: mol_type = other DNA
ctcggactcgttaacgagtccgag

SEQ ID NO: 1262 - DNA, 24 bp, synthetic construct
  misc_feature 1..24: note = Description of Artificial Sequence: Syntheticoligonucleotide
  source 1..24: mol_type = other DNA
ccctgactcgttaacgagtcaggg

SEQ ID NO: 1263 - DNA, 24 bp, synthetic construct
  misc_feature 1..24: note = Description of Artificial Sequence: Syntheticoligonucleotide
  source 1..24: mol_type = other DNA
ccacgactcgttaacgagtcgtgg

SEQ ID NO: 1264 - DNA, 24 bp, synthetic construct
  misc_feature 1..24: note = Description of Artificial Sequence: Syntheticoligonucleotide
  source 1..24: mol_type = other DNA
agccgactcgttaacgagtcggct

SEQ ID NO: 1265 - DNA, 24 bp, synthetic construct
  misc_feature 1..24: note = Description of Artificial Sequence: Syntheticoligonucleotide
  source 1..24: mol_type = other DNA
tgccgactcgttaacgagtcggca

SEQ ID NO: 1266 - DNA, 24 bp, synthetic construct
  misc_feature 1..24: note = Description of Artificial Sequence: Syntheticoligonucleotide
  source 1..24: mol_type = other DNA
gcgagactcgttaacgagtctcgc

SEQ ID NO: 1267 - DNA, 24 bp, synthetic construct
  misc_feature 1..24: note = Description of Artificial Sequence: Syntheticoligonucleotide
  source 1..24: mol_type = other DNA
gcgtgactcgttaacgagtcacgc

SEQ ID NO: 1268 - DNA, 24 bp, synthetic construct
  misc_feature 1..24: note = Description of Artificial Sequence: Syntheticoligonucleotide
  source 1..24: mol_type = other DNA
gcaggactcgttaacgagtcctgc

SEQ ID NO: 1269 - DNA, 24 bp, synthetic construct
  misc_feature 1..24: note = Description of Artificial Sequence: Syntheticoligonucleotide
  source 1..24: mol_type = other DNA
gctggactcgttaacgagtccagc

SEQ ID NO: 1270 - DNA, 24 bp, synthetic construct
  misc_feature 1..24: note = Description of Artificial Sequence: Syntheticoligonucleotide
  source 1..24: mol_type = other DNA
cgaggactcgttaacgagtcctcg

SEQ ID NO: 1271 - DNA, 24 bp, synthetic construct
  misc_feature 1..24: note = Description of Artificial Sequence: Syntheticoligonucleotide
  source 1..24: mol_type = other DNA
cgtggactcgttaacgagtccacg

SEQ ID NO: 1272 - DNA, 24 bp, synthetic construct
  misc_feature 1..24: note = Description of Artificial Sequence: Syntheticoligonucleotide
  source 1..24: mol_type = other DNA
caccgactcgttaacgagtcggtg

SEQ ID NO: 1273 - DNA, 24 bp, synthetic construct
  misc_feature 1..24: note = Description of Artificial Sequence: Syntheticoligonucleotide
  source 1..24: mol_type = other DNA
ctccgactcgttaacgagtcggag

SEQ ID NO: 1274 - DNA, 24 bp, synthetic construct
  misc_feature 1..24: note = Description of Artificial Sequence: Syntheticoligonucleotide
  source 1..24: mol_type = other DNA
gcgggactcgttaacgagtcccgc

SEQ ID NO: 1275 - DNA, 24 bp, synthetic construct
  misc_feature 1..24: note = Description of Artificial Sequence: Syntheticoligonucleotide
  source 1..24: mol_type = other DNA
gagggactcgttaacgagtccctc

SEQ ID NO: 1276 - DNA, 24 bp, synthetic construct
  misc_feature 1..24: note = Description of Artificial Sequence: Syntheticoligonucleotide
  source 1..24: mol_type = other DNA
gtgggactcgttaacgagtcccac

SEQ ID NO: 1277 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcgtgcacgagtcnnnn

SEQ ID NO: 1278 - DNA, 24 bp, synthetic construct
  misc_feature 1..24: note = Description of Artificial Sequence: Syntheticoligonucleotide
  source 1..24: mol_type = other DNA
ggcggactcgtgcacgagtccgcc

SEQ ID NO: 1279 - DNA, 24 bp, synthetic construct
  misc_feature 1..24: note = Description of Artificial Sequence: Syntheticoligonucleotide
  source 1..24: mol_type = other DNA
agcggactcgtgcacgagtccgct

SEQ ID NO: 1280 - DNA, 24 bp, synthetic construct
  misc_feature 1..24: note = Description of Artificial Sequence: Syntheticoligonucleotide
  source 1..24: mol_type = other DNA
gacggactcgtgcacgagtccgtc

SEQ ID NO: 1281 - DNA, 24 bp, synthetic construct
  misc_feature 1..24: note = Description of Artificial Sequence: Syntheticoligonucleotide
  source 1..24: mol_type = other DNA
ggaggactcgtgcacgagtcctcc

SEQ ID NO: 1282 - DNA, 24 bp, synthetic construct
  misc_feature 1..24: note = Description of Artificial Sequence: Syntheticoligonucleotide
  source 1..24: mol_type = other DNA
ggcagactcgtgcacgagtctgcc

SEQ ID NO: 1283 - DNA, 24 bp, synthetic construct
  misc_feature 1..24: note = Description of Artificial Sequence: Syntheticoligonucleotide
  source 1..24: mol_type = other DNA
tgcggactcgtgcacgagtccgca

SEQ ID NO: 1284 - DNA, 24 bp, synthetic construct
  misc_feature 1..24: note = Description of Artificial Sequence: Syntheticoligonucleotide
  source 1..24: mol_type = other DNA
gtcggactcgtgcacgagtccgac

SEQ ID NO: 1285 - DNA, 24 bp, synthetic construct
  misc_feature 1..24: note = Description of Artificial Sequence: Syntheticoligonucleotide
  source 1..24: mol_type = other DNA
ggtggactcgtgcacgagtccacc

SEQ ID NO: 1286 - DNA, 24 bp, synthetic construct
  misc_feature 1..24: note = Description of Artificial Sequence: Syntheticoligonucleotide
  source 1..24: mol_type = other DNA
ggctgactcgtgcacgagtcagcc

SEQ ID NO: 1287 - DNA, 24 bp, synthetic construct
  misc_feature 1..24: note = Description of Artificial Sequence: Syntheticoligonucleotide
  source 1..24: mol_type = other DNA
gcccgactcgtgcacgagtcgggc

SEQ ID NO: 1288 - DNA, 24 bp, synthetic construct
  misc_feature 1..24: note = Description of Artificial Sequence: Syntheticoligonucleotide
  source 1..24: mol_type = other DNA
acccgactcgtgcacgagtcgggt

SEQ ID NO: 1289 - DNA, 24 bp, synthetic construct
  misc_feature 1..24: note = Description of Artificial Sequence: Syntheticoligonucleotide
  source 1..24: mol_type = other DNA
gaccgactcgtgcacgagtcggtc

SEQ ID NO: 1290 - DNA, 24 bp, synthetic construct
  misc_feature 1..24: note = Description of Artificial Sequence: Syntheticoligonucleotide
  source 1..24: mol_type = other DNA
gcacgactcgtgcacgagtcgtgc

SEQ ID NO: 1291 - DNA, 24 bp, synthetic construct
  misc_feature 1..24: note = Description of Artificial Sequence: Syntheticoligonucleotide
  source 1..24: mol_type = other DNA
gccagactcgtgcacgagtctggc

SEQ ID NO: 1292 - DNA, 24 bp, synthetic construct
  misc_feature 1..24: note = Description of Artificial Sequence: Syntheticoligonucleotide
  source 1..24: mol_type = other DNA
tcccgactcgtgcacgagtcggga

SEQ ID NO: 1293 - DNA, 24 bp, synthetic construct
  misc_feature 1..24: note = Description of Artificial Sequence: Syntheticoligonucleotide
  source 1..24: mol_type = other DNA
gtccgactcgtgcacgagtcggac

SEQ ID NO: 1294 - DNA, 24 bp, synthetic construct
  misc_feature 1..24: note = Description of Artificial Sequence: Syntheticoligonucleotide
  source 1..24: mol_type = other DNA
gcctgactcgtgcacgagtcaggc

SEQ ID NO: 1295 - DNA, 24 bp, synthetic construct
  misc_feature 1..24: note = Description of Artificial Sequence: Syntheticoligonucleotide
  source 1..24: mol_type = other DNA
gggcgactcgtgcacgagtcgccc

SEQ ID NO: 1296 - DNA, 24 bp, synthetic construct
  misc_feature 1..24: note = Description of Artificial Sequence: Syntheticoligonucleotide
  source 1..24: mol_type = other DNA
aggcgactcgtgcacgagtcgcct

SEQ ID NO: 1297 - DNA, 24 bp, synthetic construct
  misc_feature 1..24: note = Description of Artificial Sequence: Syntheticoligonucleotide
  source 1..24: mol_type = other DNA
gagcgactcgtgcacgagtcgctc

SEQ ID NO: 1298 - DNA, 24 bp, synthetic construct
  misc_feature 1..24: note = Description of Artificial Sequence: Syntheticoligonucleotide
  source 1..24: mol_type = other DNA
ggacgactcgtgcacgagtcgtcc

SEQ ID NO: 1299 - DNA, 24 bp, synthetic construct
  misc_feature 1..24: note = Description of Artificial Sequence: Syntheticoligonucleotide
  source 1..24: mol_type = other DNA
gggagactcgtgcacgagtctccc

SEQ ID NO: 1300 - DNA, 24 bp, synthetic construct
  misc_feature 1..24: note = Description of Artificial Sequence: Syntheticoligonucleotide
  source 1..24: mol_type = other DNA
tggcgactcgtgcacgagtcgcca

SEQ ID NO: 1301 - DNA, 24 bp, synthetic construct
  misc_feature 1..24: note = Description of Artificial Sequence: Syntheticoligonucleotide
  source 1..24: mol_type = other DNA
gtgcgactcgtgcacgagtcgcac

SEQ ID NO: 1302 - DNA, 24 bp, synthetic construct
  misc_feature 1..24: note = Description of Artificial Sequence: Syntheticoligonucleotide
  source 1..24: mol_type = other DNA
gggtgactcgtgcacgagtcaccc

SEQ ID NO: 1303 - DNA, 24 bp, synthetic construct
  misc_feature 1..24: note = Description of Artificial Sequence: Syntheticoligonucleotide
  source 1..24: mol_type = other DNA
acgggactcgtgcacgagtcccgt

SEQ ID NO: 1304 - DNA, 24 bp, synthetic construct
  misc_feature 1..24: note = Description of Artificial Sequence: Syntheticoligonucleotide
  source 1..24: mol_type = other DNA
cagggactcgtgcacgagtccctg

SEQ ID NO: 1305 - DNA, 24 bp, synthetic construct
  misc_feature 1..24: note = Description of Artificial Sequence: Syntheticoligonucleotide
  source 1..24: mol_type = other DNA
ccaggactcgtgcacgagtcctgg

SEQ ID NO: 1306 - DNA, 24 bp, synthetic construct
  misc_feature 1..24: note = Description of Artificial Sequence: Syntheticoligonucleotide
  source 1..24: mol_type = other DNA
ccgagactcgtgcacgagtctcgg

SEQ ID NO: 1307 - DNA, 24 bp, synthetic construct
  misc_feature 1..24: note = Description of Artificial Sequence: Syntheticoligonucleotide
  source 1..24: mol_type = other DNA
tcgggactcgtgcacgagtcccga

SEQ ID NO: 1308 - DNA, 24 bp, synthetic construct
  misc_feature 1..24: note = Description of Artificial Sequence: Syntheticoligonucleotide
  source 1..24: mol_type = other DNA
ctgggactcgtgcacgagtcccag

SEQ ID NO: 1309 - DNA, 24 bp, synthetic construct
  misc_feature 1..24: note = Description of Artificial Sequence: Syntheticoligonucleotide
  source 1..24: mol_type = other DNA
cctggactcgtgcacgagtccagg

SEQ ID NO: 1310 - DNA, 24 bp, synthetic construct
  misc_feature 1..24: note = Description of Artificial Sequence: Syntheticoligonucleotide
  source 1..24: mol_type = other DNA
ccgtgactcgtgcacgagtcacgg

SEQ ID NO: 1311 - DNA, 24 bp, synthetic construct
  misc_feature 1..24: note = Description of Artificial Sequence: Syntheticoligonucleotide
  source 1..24: mol_type = other DNA
cggcgactcgtgcacgagtcgccg

SEQ ID NO: 1312 - DNA, 24 bp, synthetic construct
  misc_feature 1..24: note = Description of Artificial Sequence: Syntheticoligonucleotide
  source 1..24: mol_type = other DNA
cagcgactcgtgcacgagtcgctg

SEQ ID NO: 1313 - DNA, 24 bp, synthetic construct
  misc_feature 1..24: note = Description of Artificial Sequence: Syntheticoligonucleotide
  source 1..24: mol_type = other DNA
cgacgactcgtgcacgagtcgtcg

SEQ ID NO: 1314 - DNA, 24 bp, synthetic construct
  misc_feature 1..24: note = Description of Artificial Sequence: Syntheticoligonucleotide
  source 1..24: mol_type = other DNA
cggagactcgtgcacgagtctccg

SEQ ID NO: 1315 - DNA, 24 bp, synthetic construct
  misc_feature 1..24: note = Description of Artificial Sequence: Syntheticoligonucleotide
  source 1..24: mol_type = other DNA
ctgcgactcgtgcacgagtcgcag

SEQ ID NO: 1316 - DNA, 24 bp, synthetic construct
  misc_feature 1..24: note = Description of Artificial Sequence: Syntheticoligonucleotide
  source 1..24: mol_type = other DNA
cggtgactcgtgcacgagtcaccg

SEQ ID NO: 1317 - DNA, 24 bp, synthetic construct
  misc_feature 1..24: note = Description of Artificial Sequence: Syntheticoligonucleotide
  source 1..24: mol_type = other DNA
cacggactcgtgcacgagtccgtg

SEQ ID NO: 1318 - DNA, 24 bp, synthetic construct
  misc_feature 1..24: note = Description of Artificial Sequence: Syntheticoligonucleotide
  source 1..24: mol_type = other DNA
cccagactcgtgcacgagtctggg

SEQ ID NO: 1319 - DNA, 24 bp, synthetic construct
  misc_feature 1..24: note = Description of Artificial Sequence: Syntheticoligonucleotide
  source 1..24: mol_type = other DNA
ctcggactcgtgcacgagtccgag

SEQ ID NO: 1320 - DNA, 24 bp, synthetic construct
  misc_feature 1..24: note = Description of Artificial Sequence: Syntheticoligonucleotide
  source 1..24: mol_type = other DNA
ccctgactcgtgcacgagtcaggg

SEQ ID NO: 1321 - DNA, 24 bp, synthetic construct
  misc_feature 1..24: note = Description of Artificial Sequence: Syntheticoligonucleotide
  source 1..24: mol_type = other DNA
ccacgactcgtgcacgagtcgtgg

SEQ ID NO: 1322 - DNA, 24 bp, synthetic construct
  misc_feature 1..24: note = Description of Artificial Sequence: Syntheticoligonucleotide
  source 1..24: mol_type = other DNA
agccgactcgtgcacgagtcggct

SEQ ID NO: 1323 - DNA, 24 bp, synthetic construct
  misc_feature 1..24: note = Description of Artificial Sequence: Syntheticoligonucleotide
  source 1..24: mol_type = other DNA
tgccgactcgtgcacgagtcggca

SEQ ID NO: 1324 - DNA, 24 bp, synthetic construct
  misc_feature 1..24: note = Description of Artificial Sequence: Syntheticoligonucleotide
  source 1..24: mol_type = other DNA
gcgagactcgtgcacgagtctcgc

SEQ ID NO: 1325 - DNA, 24 bp, synthetic construct
  misc_feature 1..24: note = Description of Artificial Sequence: Syntheticoligonucleotide
  source 1..24: mol_type = other DNA
gcgtgactcgtgcacgagtcacgc

SEQ ID NO: 1326 - DNA, 24 bp, synthetic construct
  misc_feature 1..24: note = Description of Artificial Sequence: Syntheticoligonucleotide
  source 1..24: mol_type = other DNA
gcaggactcgtgcacgagtcctgc

SEQ ID NO: 1327 - DNA, 24 bp, synthetic construct
  misc_feature 1..24: note = Description of Artificial Sequence: Syntheticoligonucleotide
  source 1..24: mol_type = other DNA
gctggactcgtgcacgagtccagc

SEQ ID NO: 1328 - DNA, 24 bp, synthetic construct
  misc_feature 1..24: note = Description of Artificial Sequence: Syntheticoligonucleotide
  source 1..24: mol_type = other DNA
cgaggactcgtgcacgagtcctcg

SEQ ID NO: 1329 - DNA, 24 bp, synthetic construct
  misc_feature 1..24: note = Description of Artificial Sequence: Syntheticoligonucleotide
  source 1..24: mol_type = other DNA
cgtggactcgtgcacgagtccacg

SEQ ID NO: 1330 - DNA, 24 bp, synthetic construct
  misc_feature 1..24: note = Description of Artificial Sequence: Syntheticoligonucleotide
  source 1..24: mol_type = other DNA
caccgactcgtgcacgagtcggtg

SEQ ID NO: 1331 - DNA, 24 bp, synthetic construct
  misc_feature 1..24: note = Description of Artificial Sequence: Syntheticoligonucleotide
  source 1..24: mol_type = other DNA
ctccgactcgtgcacgagtcggag

SEQ ID NO: 1332 - DNA, 24 bp, synthetic construct
  misc_feature 1..24: note = Description of Artificial Sequence: Syntheticoligonucleotide
  source 1..24: mol_type = other DNA
gcgggactcgtgcacgagtcccgc

SEQ ID NO: 1333 - DNA, 24 bp, synthetic construct
  misc_feature 1..24: note = Description of Artificial Sequence: Syntheticoligonucleotide
  source 1..24: mol_type = other DNA
gagggactcgtgcacgagtccctc

SEQ ID NO: 1334 - DNA, 24 bp, synthetic construct
  misc_feature 1..24: note = Description of Artificial Sequence: Syntheticoligonucleotide
  source 1..24: mol_type = other DNA
gtgggactcgtgcacgagtcccac

SEQ ID NO: 1335 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcgtcgacgagtcnnnn

SEQ ID NO: 1336 - DNA, 24 bp, synthetic construct
  misc_feature 1..24: note = Description of Artificial Sequence: Syntheticoligonucleotide
  source 1..24: mol_type = other DNA
ggcggactcgtcgacgagtccgcc

SEQ ID NO: 1337 - DNA, 24 bp, synthetic construct
  misc_feature 1..24: note = Description of Artificial Sequence: Syntheticoligonucleotide
  source 1..24: mol_type = other DNA
agcggactcgtcgacgagtccgct

SEQ ID NO: 1338 - DNA, 24 bp, synthetic construct
  misc_feature 1..24: note = Description of Artificial Sequence: Syntheticoligonucleotide
  source 1..24: mol_type = other DNA
gacggactcgtcgacgagtccgtc

SEQ ID NO: 1339 - DNA, 24 bp, synthetic construct
  misc_feature 1..24: note = Description of Artificial Sequence: Syntheticoligonucleotide
  source 1..24: mol_type = other DNA
ggaggactcgtcgacgagtcctcc

SEQ ID NO: 1340 - DNA, 24 bp, synthetic construct
  misc_feature 1..24: note = Description of Artificial Sequence: Syntheticoligonucleotide
  source 1..24: mol_type = other DNA
ggcagactcgtcgacgagtctgcc

SEQ ID NO: 1341 - DNA, 24 bp, synthetic construct
  misc_feature 1..24: note = Description of Artificial Sequence: Syntheticoligonucleotide
  source 1..24: mol_type = other DNA
tgcggactcgtcgacgagtccgca

SEQ ID NO: 1342 - DNA, 24 bp, synthetic construct
  misc_feature 1..24: note = Description of Artificial Sequence: Syntheticoligonucleotide
  source 1..24: mol_type = other DNA
gtcggactcgtcgacgagtccgac

SEQ ID NO: 1343 - DNA, 24 bp, synthetic construct
  misc_feature 1..24: note = Description of Artificial Sequence: Syntheticoligonucleotide
  source 1..24: mol_type = other DNA
ggtggactcgtcgacgagtccacc

SEQ ID NO: 1344 - DNA, 24 bp, synthetic construct
  misc_feature 1..24: note = Description of Artificial Sequence: Syntheticoligonucleotide
  source 1..24: mol_type = other DNA
ggctgactcgtcgacgagtcagcc

SEQ ID NO: 1345 - DNA, 24 bp, synthetic construct
  misc_feature 1..24: note = Description of Artificial Sequence: Syntheticoligonucleotide
  source 1..24: mol_type = other DNA
gcccgactcgtcgacgagtcgggc

SEQ ID NO: 1346 - DNA, 24 bp, synthetic construct
  misc_feature 1..24: note = Description of Artificial Sequence: Syntheticoligonucleotide
  source 1..24: mol_type = other DNA
acccgactcgtcgacgagtcgggt

SEQ ID NO: 1347 - DNA, 24 bp, synthetic construct
  misc_feature 1..24: note = Description of Artificial Sequence: Syntheticoligonucleotide
  source 1..24: mol_type = other DNA
gaccgactcgtcgacgagtcggtc

SEQ ID NO: 1348 - DNA, 24 bp, synthetic construct
  misc_feature 1..24: note = Description of Artificial Sequence: Syntheticoligonucleotide
  source 1..24: mol_type = other DNA
gcacgactcgtcgacgagtcgtgc

SEQ ID NO: 1349 - DNA, 24 bp, synthetic construct
  misc_feature 1..24: note = Description of Artificial Sequence: Syntheticoligonucleotide
  source 1..24: mol_type = other DNA
gccagactcgtcgacgagtctggc

SEQ ID NO: 1350 - DNA, 24 bp, synthetic construct
  misc_feature 1..24: note = Description of Artificial Sequence: Syntheticoligonucleotide
  source 1..24: mol_type = other DNA
tcccgactcgtcgacgagtcggga

SEQ ID NO: 1351 - DNA, 24 bp, synthetic construct
  misc_feature 1..24: note = Description of Artificial Sequence: Syntheticoligonucleotide
  source 1..24: mol_type = other DNA
gtccgactcgtcgacgagtcggac

SEQ ID NO: 1352 - DNA, 24 bp, synthetic construct
  misc_feature 1..24: note = Description of Artificial Sequence: Syntheticoligonucleotide
  source 1..24: mol_type = other DNA
gcctgactcgtcgacgagtcaggc

SEQ ID NO: 1353 - DNA, 24 bp, synthetic construct
  misc_feature 1..24: note = Description of Artificial Sequence: Syntheticoligonucleotide
  source 1..24: mol_type = other DNA
gggcgactcgtcgacgagtcgccc

SEQ ID NO: 1354 - DNA, 24 bp, synthetic construct
  misc_feature 1..24: note = Description of Artificial Sequence: Syntheticoligonucleotide
  source 1..24: mol_type = other DNA
aggcgactcgtcgacgagtcgcct

SEQ ID NO: 1355 - DNA, 24 bp, synthetic construct
  misc_feature 1..24: note = Description of Artificial Sequence: Syntheticoligonucleotide
  source 1..24: mol_type = other DNA
gagcgactcgtcgacgagtcgctc

SEQ ID NO: 1356 - DNA, 24 bp, synthetic construct
  misc_feature 1..24: note = Description of Artificial Sequence: Syntheticoligonucleotide
  source 1..24: mol_type = other DNA
ggacgactcgtcgacgagtcgtcc

SEQ ID NO: 1357 - DNA, 24 bp, synthetic construct
  misc_feature 1..24: note = Description of Artificial Sequence: Syntheticoligonucleotide
  source 1..24: mol_type = other DNA
gggagactcgtcgacgagtctccc

SEQ ID NO: 1358 - DNA, 24 bp, synthetic construct
  misc_feature 1..24: note = Description of Artificial Sequence: Syntheticoligonucleotide
  source 1..24: mol_type = other DNA
tggcgactcgtcgacgagtcgcca

SEQ ID NO: 1359 - DNA, 24 bp, synthetic construct
  misc_feature 1..24: note = Description of Artificial Sequence: Syntheticoligonucleotide
  source 1..24: mol_type = other DNA
gtgcgactcgtcgacgagtcgcac

SEQ ID NO: 1360 - DNA, 24 bp, synthetic construct
  misc_feature 1..24: note = Description of Artificial Sequence: Syntheticoligonucleotide
  source 1..24: mol_type = other DNA
gggtgactcgtcgacgagtcaccc

SEQ ID NO: 1361 - DNA, 24 bp, synthetic construct
  misc_feature 1..24: note = Description of Artificial Sequence: Syntheticoligonucleotide
  source 1..24: mol_type = other DNA
acgggactcgtcgacgagtcccgt

SEQ ID NO: 1362 - DNA, 24 bp, synthetic construct
  misc_feature 1..24: note = Description of Artificial Sequence: Syntheticoligonucleotide
  source 1..24: mol_type = other DNA
cagggactcgtcgacgagtccctg

SEQ ID NO: 1363 - DNA, 24 bp, synthetic construct
  misc_feature 1..24: note = Description of Artificial Sequence: Syntheticoligonucleotide
  source 1..24: mol_type = other DNA
ccaggactcgtcgacgagtcctgg

SEQ ID NO: 1364 - DNA, 24 bp, synthetic construct
  misc_feature 1..24: note = Description of Artificial Sequence: Syntheticoligonucleotide
  source 1..24: mol_type = other DNA
ccgagactcgtcgacgagtctcgg

SEQ ID NO: 1365 - DNA, 24 bp, synthetic construct
  misc_feature 1..24: note = Description of Artificial Sequence: Syntheticoligonucleotide
  source 1..24: mol_type = other DNA
tcgggactcgtcgacgagtcccga

SEQ ID NO: 1366 - DNA, 24 bp, synthetic construct
  misc_feature 1..24: note = Description of Artificial Sequence: Syntheticoligonucleotide
  source 1..24: mol_type = other DNA
ctgggactcgtcgacgagtcccag

SEQ ID NO: 1367 - DNA, 24 bp, synthetic construct
  misc_feature 1..24: note = Description of Artificial Sequence: Syntheticoligonucleotide
  source 1..24: mol_type = other DNA
cctggactcgtcgacgagtccagg

SEQ ID NO: 1368 - DNA, 24 bp, synthetic construct
  misc_feature 1..24: note = Description of Artificial Sequence: Syntheticoligonucleotide
  source 1..24: mol_type = other DNA
ccgtgactcgtcgacgagtcacgg

SEQ ID NO: 1369 - DNA, 24 bp, synthetic construct
  misc_feature 1..24: note = Description of Artificial Sequence: Syntheticoligonucleotide
  source 1..24: mol_type = other DNA
cggcgactcgtcgacgagtcgccg

SEQ ID NO: 1370 - DNA, 24 bp, synthetic construct
  misc_feature 1..24: note = Description of Artificial Sequence: Syntheticoligonucleotide
  source 1..24: mol_type = other DNA
cagcgactcgtcgacgagtcgctg

SEQ ID NO: 1371 - DNA, 24 bp, synthetic construct
  misc_feature 1..24: note = Description of Artificial Sequence: Syntheticoligonucleotide
  source 1..24: mol_type = other DNA
cgacgactcgtcgacgagtcgtcg

SEQ ID NO: 1372 - DNA, 24 bp, synthetic construct
  misc_feature 1..24: note = Description of Artificial Sequence: Syntheticoligonucleotide
  source 1..24: mol_type = other DNA
cggagactcgtcgacgagtctccg

SEQ ID NO: 1373 - DNA, 24 bp, synthetic construct
  misc_feature 1..24: note = Description of Artificial Sequence: Syntheticoligonucleotide
  source 1..24: mol_type = other DNA
ctgcgactcgtcgacgagtcgcag

SEQ ID NO: 1374 - DNA, 24 bp, synthetic construct
  misc_feature 1..24: note = Description of Artificial Sequence: Syntheticoligonucleotide
  source 1..24: mol_type = other DNA
cggtgactcgtcgacgagtcaccg

SEQ ID NO: 1375 - DNA, 24 bp, synthetic construct
  misc_feature 1..24: note = Description of Artificial Sequence: Syntheticoligonucleotide
  source 1..24: mol_type = other DNA
cacggactcgtcgacgagtccgtg

SEQ ID NO: 1376 - DNA, 24 bp, synthetic construct
  misc_feature 1..24: note = Description of Artificial Sequence: Syntheticoligonucleotide
  source 1..24: mol_type = other DNA
cccagactcgtcgacgagtctggg

SEQ ID NO: 1377 - DNA, 24 bp, synthetic construct
  misc_feature 1..24: note = Description of Artificial Sequence: Syntheticoligonucleotide
  source 1..24: mol_type = other DNA
ctcggactcgtcgacgagtccgag

SEQ ID NO: 1378 - DNA, 24 bp, synthetic construct
  misc_feature 1..24: note = Description of Artificial Sequence: Syntheticoligonucleotide
  source 1..24: mol_type = other DNA
ccctgactcgtcgacgagtcaggg

SEQ ID NO: 1379 - DNA, 24 bp, synthetic construct
  misc_feature 1..24: note = Description of Artificial Sequence: Syntheticoligonucleotide
  source 1..24: mol_type = other DNA
ccacgactcgtcgacgagtcgtgg

SEQ ID NO: 1380 - DNA, 24 bp, synthetic construct
  misc_feature 1..24: note = Description of Artificial Sequence: Syntheticoligonucleotide
  source 1..24: mol_type = other DNA
agccgactcgtcgacgagtcggct

SEQ ID NO: 1381 - DNA, 24 bp, synthetic construct
  misc_feature 1..24: note = Description of Artificial Sequence: Syntheticoligonucleotide
  source 1..24: mol_type = other DNA
tgccgactcgtcgacgagtcggca

SEQ ID NO: 1382 - DNA, 24 bp, synthetic construct
  misc_feature 1..24: note = Description of Artificial Sequence: Syntheticoligonucleotide
  source 1..24: mol_type = other DNA
gcgagactcgtcgacgagtctcgc

SEQ ID NO: 1383 - DNA, 24 bp, synthetic construct
  misc_feature 1..24: note = Description of Artificial Sequence: Syntheticoligonucleotide
  source 1..24: mol_type = other DNA
gcgtgactcgtcgacgagtcacgc

SEQ ID NO: 1384 - DNA, 24 bp, synthetic construct
  misc_feature 1..24: note = Description of Artificial Sequence: Syntheticoligonucleotide
  source 1..24: mol_type = other DNA
gcaggactcgtcgacgagtcctgc

SEQ ID NO: 1385 - DNA, 24 bp, synthetic construct
  misc_feature 1..24: note = Description of Artificial Sequence: Syntheticoligonucleotide
  source 1..24: mol_type = other DNA
gctggactcgtcgacgagtccagc

SEQ ID NO: 1386 - DNA, 24 bp, synthetic construct
  misc_feature 1..24: note = Description of Artificial Sequence: Syntheticoligonucleotide
  source 1..24: mol_type = other DNA
cgaggactcgtcgacgagtcctcg

SEQ ID NO: 1387 - DNA, 24 bp, synthetic construct
  misc_feature 1..24: note = Description of Artificial Sequence: Syntheticoligonucleotide
  source 1..24: mol_type = other DNA
cgtggactcgtcgacgagtccacg

SEQ ID NO: 1388 - DNA, 24 bp, synthetic construct
  misc_feature 1..24: note = Description of Artificial Sequence: Syntheticoligonucleotide
  source 1..24: mol_type = other DNA
caccgactcgtcgacgagtcggtg

SEQ ID NO: 1389 - DNA, 24 bp, synthetic construct
  misc_feature 1..24: note = Description of Artificial Sequence: Syntheticoligonucleotide
  source 1..24: mol_type = other DNA
ctccgactcgtcgacgagtcggag

SEQ ID NO: 1390 - DNA, 24 bp, synthetic construct
  misc_feature 1..24: note = Description of Artificial Sequence: Syntheticoligonucleotide
  source 1..24: mol_type = other DNA
gcgggactcgtcgacgagtcccgc

SEQ ID NO: 1391 - DNA, 24 bp, synthetic construct
  misc_feature 1..24: note = Description of Artificial Sequence: Syntheticoligonucleotide
  source 1..24: mol_type = other DNA
gagggactcgtcgacgagtccctc

SEQ ID NO: 1392 - DNA, 24 bp, synthetic construct
  misc_feature 1..24: note = Description of Artificial Sequence: Syntheticoligonucleotide
  source 1..24: mol_type = other DNA
gtgggactcgtcgacgagtcccac

SEQ ID NO: 1393 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcctataggagtcnnnn

SEQ ID NO: 1394 - DNA, 24 bp, synthetic construct
  misc_feature 1..24: note = Description of Artificial Sequence: Syntheticoligonucleotide
  source 1..24: mol_type = other DNA
ggcggactcctataggagtccgcc

SEQ ID NO: 1395 - DNA, 24 bp, synthetic construct
  misc_feature 1..24: note = Description of Artificial Sequence: Syntheticoligonucleotide
  source 1..24: mol_type = other DNA
agcggactcctataggagtccgct

SEQ ID NO: 1396 - DNA, 24 bp, synthetic construct
  misc_feature 1..24: note = Description of Artificial Sequence: Syntheticoligonucleotide
  source 1..24: mol_type = other DNA
gacggactcctataggagtccgtc

SEQ ID NO: 1397 - DNA, 24 bp, synthetic construct
  misc_feature 1..24: note = Description of Artificial Sequence: Syntheticoligonucleotide
  source 1..24: mol_type = other DNA
ggaggactcctataggagtcctcc

SEQ ID NO: 1398 - DNA, 24 bp, synthetic construct
  misc_feature 1..24: note = Description of Artificial Sequence: Syntheticoligonucleotide
  source 1..24: mol_type = other DNA
ggcagactcctataggagtctgcc

SEQ ID NO: 1399 - DNA, 24 bp, synthetic construct
  misc_feature 1..24: note = Description of Artificial Sequence: Syntheticoligonucleotide
  source 1..24: mol_type = other DNA
tgcggactcctataggagtccgca

SEQ ID NO: 1400 - DNA, 24 bp, synthetic construct
  misc_feature 1..24: note = Description of Artificial Sequence: Syntheticoligonucleotide
  source 1..24: mol_type = other DNA
gtcggactcctataggagtccgac

SEQ ID NO: 1401 - DNA, 24 bp, synthetic construct
  misc_feature 1..24: note = Description of Artificial Sequence: Syntheticoligonucleotide
  source 1..24: mol_type = other DNA
ggtggactcctataggagtccacc

SEQ ID NO: 1402 - DNA, 24 bp, synthetic construct
  misc_feature 1..24: note = Description of Artificial Sequence: Syntheticoligonucleotide
  source 1..24: mol_type = other DNA
ggctgactcctataggagtcagcc

SEQ ID NO: 1403 - DNA, 24 bp, synthetic construct
  misc_feature 1..24: note = Description of Artificial Sequence: Syntheticoligonucleotide
  source 1..24: mol_type = other DNA
gcccgactcctataggagtcgggc

SEQ ID NO: 1404 - DNA, 24 bp, synthetic construct
  misc_feature 1..24: note = Description of Artificial Sequence: Syntheticoligonucleotide
  source 1..24: mol_type = other DNA
acccgactcctataggagtcgggt

SEQ ID NO: 1405 - DNA, 24 bp, synthetic construct
  misc_feature 1..24: note = Description of Artificial Sequence: Syntheticoligonucleotide
  source 1..24: mol_type = other DNA
gaccgactcctataggagtcggtc

SEQ ID NO: 1406 - DNA, 24 bp, synthetic construct
  misc_feature 1..24: note = Description of Artificial Sequence: Syntheticoligonucleotide
  source 1..24: mol_type = other DNA
gcacgactcctataggagtcgtgc

SEQ ID NO: 1407 - DNA, 24 bp, synthetic construct
  misc_feature 1..24: note = Description of Artificial Sequence: Syntheticoligonucleotide
  source 1..24: mol_type = other DNA
gccagactcctataggagtctggc

SEQ ID NO: 1408 - DNA, 24 bp, synthetic construct
  misc_feature 1..24: note = Description of Artificial Sequence: Syntheticoligonucleotide
  source 1..24: mol_type = other DNA
tcccgactcctataggagtcggga

SEQ ID NO: 1409 - DNA, 24 bp, synthetic construct
  misc_feature 1..24: note = Description of Artificial Sequence: Syntheticoligonucleotide
  source 1..24: mol_type = other DNA
gtccgactcctataggagtcggac

SEQ ID NO: 1410 - DNA, 24 bp, synthetic construct
  misc_feature 1..24: note = Description of Artificial Sequence: Syntheticoligonucleotide
  source 1..24: mol_type = other DNA
gcctgactcctataggagtcaggc

SEQ ID NO: 1411 - DNA, 24 bp, synthetic construct
  misc_feature 1..24: note = Description of Artificial Sequence: Syntheticoligonucleotide
  source 1..24: mol_type = other DNA
gggcgactcctataggagtcgccc

SEQ ID NO: 1412 - DNA, 24 bp, synthetic construct
  misc_feature 1..24: note = Description of Artificial Sequence: Syntheticoligonucleotide
  source 1..24: mol_type = other DNA
aggcgactcctataggagtcgcct

SEQ ID NO: 1413 - DNA, 24 bp, synthetic construct
  misc_feature 1..24: note = Description of Artificial Sequence: Syntheticoligonucleotide
  source 1..24: mol_type = other DNA
gagcgactcctataggagtcgctc

SEQ ID NO: 1414 - DNA, 24 bp, synthetic construct
  misc_feature 1..24: note = Description of Artificial Sequence: Syntheticoligonucleotide
  source 1..24: mol_type = other DNA
ggacgactcctataggagtcgtcc

SEQ ID NO: 1415 - DNA, 24 bp, synthetic construct
  misc_feature 1..24: note = Description of Artificial Sequence: Syntheticoligonucleotide
  source 1..24: mol_type = other DNA
gggagactcctataggagtctccc

SEQ ID NO: 1416 - DNA, 24 bp, synthetic construct
  misc_feature 1..24: note = Description of Artificial Sequence: Syntheticoligonucleotide
  source 1..24: mol_type = other DNA
tggcgactcctataggagtcgcca

SEQ ID NO: 1417 - DNA, 24 bp, synthetic construct
  misc_feature 1..24: note = Description of Artificial Sequence: Syntheticoligonucleotide
  source 1..24: mol_type = other DNA
gtgcgactcctataggagtcgcac

SEQ ID NO: 1418 - DNA, 24 bp, synthetic construct
  misc_feature 1..24: note = Description of Artificial Sequence: Syntheticoligonucleotide
  source 1..24: mol_type = other DNA
gggtgactcctataggagtcaccc

SEQ ID NO: 1419 - DNA, 24 bp, synthetic construct
  misc_feature 1..24: note = Description of Artificial Sequence: Syntheticoligonucleotide
  source 1..24: mol_type = other DNA
acgggactcctataggagtcccgt

SEQ ID NO: 1420 - DNA, 24 bp, synthetic construct
  misc_feature 1..24: note = Description of Artificial Sequence: Syntheticoligonucleotide
  source 1..24: mol_type = other DNA
cagggactcctataggagtccctg

SEQ ID NO: 1421 - DNA, 24 bp, synthetic construct
  misc_feature 1..24: note = Description of Artificial Sequence: Syntheticoligonucleotide
  source 1..24: mol_type = other DNA
ccaggactcctataggagtcctgg

SEQ ID NO: 1422 - DNA, 24 bp, synthetic construct
  misc_feature 1..24: note = Description of Artificial Sequence: Syntheticoligonucleotide
  source 1..24: mol_type = other DNA
ccgagactcctataggagtctcgg

SEQ ID NO: 1423 - DNA, 24 bp, synthetic construct
  misc_feature 1..24: note = Description of Artificial Sequence: Syntheticoligonucleotide
  source 1..24: mol_type = other DNA
tcgggactcctataggagtcccga

SEQ ID NO: 1424 - DNA, 24 bp, synthetic construct
  misc_feature 1..24: note = Description of Artificial Sequence: Syntheticoligonucleotide
  source 1..24: mol_type = other DNA
ctgggactcctataggagtcccag

SEQ ID NO: 1425 - DNA, 24 bp, synthetic construct
  misc_feature 1..24: note = Description of Artificial Sequence: Syntheticoligonucleotide
  source 1..24: mol_type = other DNA
cctggactcctataggagtccagg

SEQ ID NO: 1426 - DNA, 24 bp, synthetic construct
  misc_feature 1..24: note = Description of Artificial Sequence: Syntheticoligonucleotide
  source 1..24: mol_type = other DNA
ccgtgactcctataggagtcacgg

SEQ ID NO: 1427 - DNA, 24 bp, synthetic construct
  misc_feature 1..24: note = Description of Artificial Sequence: Syntheticoligonucleotide
  source 1..24: mol_type = other DNA
cggcgactcctataggagtcgccg

SEQ ID NO: 1428 - DNA, 24 bp, synthetic construct
  misc_feature 1..24: note = Description of Artificial Sequence: Syntheticoligonucleotide
  source 1..24: mol_type = other DNA
cagcgactcctataggagtcgctg

SEQ ID NO: 1429 - DNA, 24 bp, synthetic construct
  misc_feature 1..24: note = Description of Artificial Sequence: Syntheticoligonucleotide
  source 1..24: mol_type = other DNA
cgacgactcctataggagtcgtcg

SEQ ID NO: 1430 - DNA, 24 bp, synthetic construct
  misc_feature 1..24: note = Description of Artificial Sequence: Syntheticoligonucleotide
  source 1..24: mol_type = other DNA
cggagactcctataggagtctccg

SEQ ID NO: 1431 - DNA, 24 bp, synthetic construct
  misc_feature 1..24: note = Description of Artificial Sequence: Syntheticoligonucleotide
  source 1..24: mol_type = other DNA
ctgcgactcctataggagtcgcag

SEQ ID NO: 1432 - DNA, 24 bp, synthetic construct
  misc_feature 1..24: note = Description of Artificial Sequence: Syntheticoligonucleotide
  source 1..24: mol_type = other DNA
cggtgactcctataggagtcaccg

SEQ ID NO: 1433 - DNA, 24 bp, synthetic construct
  misc_feature 1..24: note = Description of Artificial Sequence: Syntheticoligonucleotide
  source 1..24: mol_type = other DNA
cacggactcctataggagtccgtg

SEQ ID NO: 1434 - DNA, 24 bp, synthetic construct
  misc_feature 1..24: note = Description of Artificial Sequence: Syntheticoligonucleotide
  source 1..24: mol_type = other DNA
cccagactcctataggagtctggg

SEQ ID NO: 1435 - DNA, 24 bp, synthetic construct
  misc_feature 1..24: note = Description of Artificial Sequence: Syntheticoligonucleotide
  source 1..24: mol_type = other DNA
ctcggactcctataggagtccgag

SEQ ID NO: 1436 - DNA, 24 bp, synthetic construct
  misc_feature 1..24: note = Description of Artificial Sequence: Syntheticoligonucleotide
  source 1..24: mol_type = other DNA
ccctgactcctataggagtcaggg

SEQ ID NO: 1437 - DNA, 24 bp, synthetic construct
  misc_feature 1..24: note = Description of Artificial Sequence: Syntheticoligonucleotide
  source 1..24: mol_type = other DNA
ccacgactcctataggagtcgtgg

SEQ ID NO: 1438 - DNA, 24 bp, synthetic construct
  misc_feature 1..24: note = Description of Artificial Sequence: Syntheticoligonucleotide
  source 1..24: mol_type = other DNA
agccgactcctataggagtcggct

SEQ ID NO: 1439 - DNA, 24 bp, synthetic construct
  misc_feature 1..24: note = Description of Artificial Sequence: Syntheticoligonucleotide
  source 1..24: mol_type = other DNA
tgccgactcctataggagtcggca

SEQ ID NO: 1440 - DNA, 24 bp, synthetic construct
  misc_feature 1..24: note = Description of Artificial Sequence: Syntheticoligonucleotide
  source 1..24: mol_type = other DNA
gcgagactcctataggagtctcgc

SEQ ID NO: 1441 - DNA, 24 bp, synthetic construct
  misc_feature 1..24: note = Description of Artificial Sequence: Syntheticoligonucleotide
  source 1..24: mol_type = other DNA
gcgtgactcctataggagtcacgc

SEQ ID NO: 1442 - DNA, 24 bp, synthetic construct
  misc_feature 1..24: note = Description of Artificial Sequence: Syntheticoligonucleotide
  source 1..24: mol_type = other DNA
gcaggactcctataggagtcctgc

SEQ ID NO: 1443 - DNA, 24 bp, synthetic construct
  misc_feature 1..24: note = Description of Artificial Sequence: Syntheticoligonucleotide
  source 1..24: mol_type = other DNA
gctggactcctataggagtccagc

SEQ ID NO: 1444 - DNA, 24 bp, synthetic construct
  misc_feature 1..24: note = Description of Artificial Sequence: Syntheticoligonucleotide
  source 1..24: mol_type = other DNA
cgaggactcctataggagtcctcg

SEQ ID NO: 1445 - DNA, 24 bp, synthetic construct
  misc_feature 1..24: note = Description of Artificial Sequence: Syntheticoligonucleotide
  source 1..24: mol_type = other DNA
cgtggactcctataggagtccacg

SEQ ID NO: 1446 - DNA, 24 bp, synthetic construct
  misc_feature 1..24: note = Description of Artificial Sequence: Syntheticoligonucleotide
  source 1..24: mol_type = other DNA
caccgactcctataggagtcggtg

SEQ ID NO: 1447 - DNA, 24 bp, synthetic construct
  misc_feature 1..24: note = Description of Artificial Sequence: Syntheticoligonucleotide
  source 1..24: mol_type = other DNA
ctccgactcctataggagtcggag

SEQ ID NO: 1448 - DNA, 24 bp, synthetic construct
  misc_feature 1..24: note = Description of Artificial Sequence: Syntheticoligonucleotide
  source 1..24: mol_type = other DNA
gcgggactcctataggagtcccgc

SEQ ID NO: 1449 - DNA, 24 bp, synthetic construct
  misc_feature 1..24: note = Description of Artificial Sequence: Syntheticoligonucleotide
  source 1..24: mol_type = other DNA
gagggactcctataggagtccctc

SEQ ID NO: 1450 - DNA, 24 bp, synthetic construct
  misc_feature 1..24: note = Description of Artificial Sequence: Syntheticoligonucleotide
  source 1..24: mol_type = other DNA
gtgggactcctataggagtcccac

SEQ ID NO: 1451 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactccttaaggagtcnnnn

SEQ ID NO: 1452 - DNA, 24 bp, synthetic construct
  misc_feature 1..24: note = Description of Artificial Sequence: Syntheticoligonucleotide
  source 1..24: mol_type = other DNA
ggcggactccttaaggagtccgcc

SEQ ID NO: 1453 - DNA, 24 bp, synthetic construct
  misc_feature 1..24: note = Description of Artificial Sequence: Syntheticoligonucleotide
  source 1..24: mol_type = other DNA
agcggactccttaaggagtccgct

SEQ ID NO: 1454 - DNA, 24 bp, synthetic construct
  misc_feature 1..24: note = Description of Artificial Sequence: Syntheticoligonucleotide
  source 1..24: mol_type = other DNA
gacggactccttaaggagtccgtc

SEQ ID NO: 1455 - DNA, 24 bp, synthetic construct
  misc_feature 1..24: note = Description of Artificial Sequence: Syntheticoligonucleotide
  source 1..24: mol_type = other DNA
ggaggactccttaaggagtcctcc

SEQ ID NO: 1456 - DNA, 24 bp, synthetic construct
  misc_feature 1..24: note = Description of Artificial Sequence: Syntheticoligonucleotide
  source 1..24: mol_type = other DNA
ggcagactccttaaggagtctgcc

SEQ ID NO: 1457 - DNA, 24 bp, synthetic construct
  misc_feature 1..24: note = Description of Artificial Sequence: Syntheticoligonucleotide
  source 1..24: mol_type = other DNA
tgcggactccttaaggagtccgca

SEQ ID NO: 1458 - DNA, 24 bp, synthetic construct
  misc_feature 1..24: note = Description of Artificial Sequence: Syntheticoligonucleotide
  source 1..24: mol_type = other DNA
gtcggactccttaaggagtccgac

SEQ ID NO: 1459 - DNA, 24 bp, synthetic construct
  misc_feature 1..24: note = Description of Artificial Sequence: Syntheticoligonucleotide
  source 1..24: mol_type = other DNA
ggtggactccttaaggagtccacc

SEQ ID NO: 1460 - DNA, 24 bp, synthetic construct
  misc_feature 1..24: note = Description of Artificial Sequence: Syntheticoligonucleotide
  source 1..24: mol_type = other DNA
ggctgactccttaaggagtcagcc

SEQ ID NO: 1461 - DNA, 24 bp, synthetic construct
  misc_feature 1..24: note = Description of Artificial Sequence: Syntheticoligonucleotide
  source 1..24: mol_type = other DNA
gcccgactccttaaggagtcgggc

SEQ ID NO: 1462 - DNA, 24 bp, synthetic construct
  misc_feature 1..24: note = Description of Artificial Sequence: Syntheticoligonucleotide
  source 1..24: mol_type = other DNA
acccgactccttaaggagtcgggt

SEQ ID NO: 1463 - DNA, 24 bp, synthetic construct
  misc_feature 1..24: note = Description of Artificial Sequence: Syntheticoligonucleotide
  source 1..24: mol_type = other DNA
gaccgactccttaaggagtcggtc

SEQ ID NO: 1464 - DNA, 24 bp, synthetic construct
  misc_feature 1..24: note = Description of Artificial Sequence: Syntheticoligonucleotide
  source 1..24: mol_type = other DNA
gcacgactccttaaggagtcgtgc

SEQ ID NO: 1465 - DNA, 24 bp, synthetic construct
  misc_feature 1..24: note = Description of Artificial Sequence: Syntheticoligonucleotide
  source 1..24: mol_type = other DNA
gccagactccttaaggagtctggc

SEQ ID NO: 1466 - DNA, 24 bp, synthetic construct
  misc_feature 1..24: note = Description of Artificial Sequence: Syntheticoligonucleotide
  source 1..24: mol_type = other DNA
tcccgactccttaaggagtcggga

SEQ ID NO: 1467 - DNA, 24 bp, synthetic construct
  misc_feature 1..24: note = Description of Artificial Sequence: Syntheticoligonucleotide
  source 1..24: mol_type = other DNA
gtccgactccttaaggagtcggac

SEQ ID NO: 1468 - DNA, 24 bp, synthetic construct
  misc_feature 1..24: note = Description of Artificial Sequence: Syntheticoligonucleotide
  source 1..24: mol_type = other DNA
gcctgactccttaaggagtcaggc

SEQ ID NO: 1469 - DNA, 24 bp, synthetic construct
  misc_feature 1..24: note = Description of Artificial Sequence: Syntheticoligonucleotide
  source 1..24: mol_type = other DNA
gggcgactccttaaggagtcgccc

SEQ ID NO: 1470 - DNA, 24 bp, synthetic construct
  misc_feature 1..24: note = Description of Artificial Sequence: Syntheticoligonucleotide
  source 1..24: mol_type = other DNA
aggcgactccttaaggagtcgcct

SEQ ID NO: 1471 - DNA, 24 bp, synthetic construct
  misc_feature 1..24: note = Description of Artificial Sequence: Syntheticoligonucleotide
  source 1..24: mol_type = other DNA
gagcgactccttaaggagtcgctc

SEQ ID NO: 1472 - DNA, 24 bp, synthetic construct
  misc_feature 1..24: note = Description of Artificial Sequence: Syntheticoligonucleotide
  source 1..24: mol_type = other DNA
ggacgactccttaaggagtcgtcc

SEQ ID NO: 1473 - DNA, 24 bp, synthetic construct
  misc_feature 1..24: note = Description of Artificial Sequence: Syntheticoligonucleotide
  source 1..24: mol_type = other DNA
gggagactccttaaggagtctccc

SEQ ID NO: 1474 - DNA, 24 bp, synthetic construct
  misc_feature 1..24: note = Description of Artificial Sequence: Syntheticoligonucleotide
  source 1..24: mol_type = other DNA
tggcgactccttaaggagtcgcca

SEQ ID NO: 1475 - DNA, 24 bp, synthetic construct
  misc_feature 1..24: note = Description of Artificial Sequence: Syntheticoligonucleotide
  source 1..24: mol_type = other DNA
gtgcgactccttaaggagtcgcac

SEQ ID NO: 1476 - DNA, 24 bp, synthetic construct
  misc_feature 1..24: note = Description of Artificial Sequence: Syntheticoligonucleotide
  source 1..24: mol_type = other DNA
gggtgactccttaaggagtcaccc

SEQ ID NO: 1477 - DNA, 24 bp, synthetic construct
  misc_feature 1..24: note = Description of Artificial Sequence: Syntheticoligonucleotide
  source 1..24: mol_type = other DNA
acgggactccttaaggagtcccgt

SEQ ID NO: 1478 - DNA, 24 bp, synthetic construct
  misc_feature 1..24: note = Description of Artificial Sequence: Syntheticoligonucleotide
  source 1..24: mol_type = other DNA
cagggactccttaaggagtccctg

SEQ ID NO: 1479 - DNA, 24 bp, synthetic construct
  misc_feature 1..24: note = Description of Artificial Sequence: Syntheticoligonucleotide
  source 1..24: mol_type = other DNA
ccaggactccttaaggagtcctgg

SEQ ID NO: 1480 - DNA, 24 bp, synthetic construct
  misc_feature 1..24: note = Description of Artificial Sequence: Syntheticoligonucleotide
  source 1..24: mol_type = other DNA
ccgagactccttaaggagtctcgg

SEQ ID NO: 1481 - DNA, 24 bp, synthetic construct
  misc_feature 1..24: note = Description of Artificial Sequence: Syntheticoligonucleotide
  source 1..24: mol_type = other DNA
tcgggactccttaaggagtcccga

SEQ ID NO: 1482 - DNA, 24 bp, synthetic construct
  misc_feature 1..24: note = Description of Artificial Sequence: Syntheticoligonucleotide
  source 1..24: mol_type = other DNA
ctgggactccttaaggagtcccag

SEQ ID NO: 1483 - DNA, 24 bp, synthetic construct
  misc_feature 1..24: note = Description of Artificial Sequence: Syntheticoligonucleotide
  source 1..24: mol_type = other DNA
cctggactccttaaggagtccagg

SEQ ID NO: 1484 - DNA, 24 bp, synthetic construct
  misc_feature 1..24: note = Description of Artificial Sequence: Syntheticoligonucleotide
  source 1..24: mol_type = other DNA
ccgtgactccttaaggagtcacgg

SEQ ID NO: 1485 - DNA, 24 bp, synthetic construct
  misc_feature 1..24: note = Description of Artificial Sequence: Syntheticoligonucleotide
  source 1..24: mol_type = other DNA
cggcgactccttaaggagtcgccg

SEQ ID NO: 1486 - DNA, 24 bp, synthetic construct
  misc_feature 1..24: note = Description of Artificial Sequence: Syntheticoligonucleotide
  source 1..24: mol_type = other DNA
cagcgactccttaaggagtcgctg

SEQ ID NO: 1487 - DNA, 24 bp, synthetic construct
  misc_feature 1..24: note = Description of Artificial Sequence: Syntheticoligonucleotide
  source 1..24: mol_type = other DNA
cgacgactccttaaggagtcgtcg

SEQ ID NO: 1488 - DNA, 24 bp, synthetic construct
  misc_feature 1..24: note = Description of Artificial Sequence: Syntheticoligonucleotide
  source 1..24: mol_type = other DNA
cggagactccttaaggagtctccg

SEQ ID NO: 1489 - DNA, 24 bp, synthetic construct
  misc_feature 1..24: note = Description of Artificial Sequence: Syntheticoligonucleotide
  source 1..24: mol_type = other DNA
ctgcgactccttaaggagtcgcag

SEQ ID NO: 1490 - DNA, 24 bp, synthetic construct
  misc_feature 1..24: note = Description of Artificial Sequence: Syntheticoligonucleotide
  source 1..24: mol_type = other DNA
cggtgactccttaaggagtcaccg

SEQ ID NO: 1491 - DNA, 24 bp, synthetic construct
  misc_feature 1..24: note = Description of Artificial Sequence: Syntheticoligonucleotide
  source 1..24: mol_type = other DNA
cacggactccttaaggagtccgtg

SEQ ID NO: 1492 - DNA, 24 bp, synthetic construct
  misc_feature 1..24: note = Description of Artificial Sequence: Syntheticoligonucleotide
  source 1..24: mol_type = other DNA
cccagactccttaaggagtctggg

SEQ ID NO: 1493 - DNA, 24 bp, synthetic construct
  misc_feature 1..24: note = Description of Artificial Sequence: Syntheticoligonucleotide
  source 1..24: mol_type = other DNA
ctcggactccttaaggagtccgag

SEQ ID NO: 1494 - DNA, 24 bp, synthetic construct
  misc_feature 1..24: note = Description of Artificial Sequence: Syntheticoligonucleotide
  source 1..24: mol_type = other DNA
ccctgactccttaaggagtcaggg

SEQ ID NO: 1495 - DNA, 24 bp, synthetic construct
  misc_feature 1..24: note = Description of Artificial Sequence: Syntheticoligonucleotide
  source 1..24: mol_type = other DNA
ccacgactccttaaggagtcgtgg

SEQ ID NO: 1496 - DNA, 24 bp, synthetic construct
  misc_feature 1..24: note = Description of Artificial Sequence: Syntheticoligonucleotide
  source 1..24: mol_type = other DNA
agccgactccttaaggagtcggct

SEQ ID NO: 1497 - DNA, 24 bp, synthetic construct
  misc_feature 1..24: note = Description of Artificial Sequence: Syntheticoligonucleotide
  source 1..24: mol_type = other DNA
tgccgactccttaaggagtcggca

SEQ ID NO: 1498 - DNA, 24 bp, synthetic construct
  misc_feature 1..24: note = Description of Artificial Sequence: Syntheticoligonucleotide
  source 1..24: mol_type = other DNA
gcgagactccttaaggagtctcgc

SEQ ID NO: 1499 - DNA, 24 bp, synthetic construct
  misc_feature 1..24: note = Description of Artificial Sequence: Syntheticoligonucleotide
  source 1..24: mol_type = other DNA
gcgtgactccttaaggagtcacgc

SEQ ID NO: 1500 - DNA, 24 bp, synthetic construct
  misc_feature 1..24: note = Description of Artificial Sequence: Syntheticoligonucleotide
  source 1..24: mol_type = other DNA
gcaggactccttaaggagtcctgc

SEQ ID NO: 1501 - DNA, 24 bp, synthetic construct
  misc_feature 1..24: note = Description of Artificial Sequence: Syntheticoligonucleotide
  source 1..24: mol_type = other DNA
gctggactccttaaggagtccagc

SEQ ID NO: 1502 - DNA, 24 bp, synthetic construct
  misc_feature 1..24: note = Description of Artificial Sequence: Syntheticoligonucleotide
  source 1..24: mol_type = other DNA
cgaggactccttaaggagtcctcg

SEQ ID NO: 1503 - DNA, 24 bp, synthetic construct
  misc_feature 1..24: note = Description of Artificial Sequence: Syntheticoligonucleotide
  source 1..24: mol_type = other DNA
cgtggactccttaaggagtccacg

SEQ ID NO: 1504 - DNA, 24 bp, synthetic construct
  misc_feature 1..24: note = Description of Artificial Sequence: Syntheticoligonucleotide
  source 1..24: mol_type = other DNA
caccgactccttaaggagtcggtg

SEQ ID NO: 1505 - DNA, 24 bp, synthetic construct
  misc_feature 1..24: note = Description of Artificial Sequence: Syntheticoligonucleotide
  source 1..24: mol_type = other DNA
ctccgactccttaaggagtcggag

SEQ ID NO: 1506 - DNA, 24 bp, synthetic construct
  misc_feature 1..24: note = Description of Artificial Sequence: Syntheticoligonucleotide
  source 1..24: mol_type = other DNA
gcgggactccttaaggagtcccgc

SEQ ID NO: 1507 - DNA, 24 bp, synthetic construct
  misc_feature 1..24: note = Description of Artificial Sequence: Syntheticoligonucleotide
  source 1..24: mol_type = other DNA
gagggactccttaaggagtccctc

SEQ ID NO: 1508 - DNA, 24 bp, synthetic construct
  misc_feature 1..24: note = Description of Artificial Sequence: Syntheticoligonucleotide
  source 1..24: mol_type = other DNA
gtgggactccttaaggagtcccac

SEQ ID NO: 1509 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcctgcaggagtcnnnn

SEQ ID NO: 1510 - DNA, 24 bp, synthetic construct
  misc_feature 1..24: note = Description of Artificial Sequence: Syntheticoligonucleotide
  source 1..24: mol_type = other DNA
ggcggactcctgcaggagtccgcc

SEQ ID NO: 1511 - DNA, 24 bp, synthetic construct
  misc_feature 1..24: note = Description of Artificial Sequence: Syntheticoligonucleotide
  source 1..24: mol_type = other DNA
agcggactcctgcaggagtccgct

SEQ ID NO: 1512 - DNA, 24 bp, synthetic construct
  misc_feature 1..24: note = Description of Artificial Sequence: Syntheticoligonucleotide
  source 1..24: mol_type = other DNA
gacggactcctgcaggagtccgtc

SEQ ID NO: 1513 - DNA, 24 bp, synthetic construct
  misc_feature 1..24: note = Description of Artificial Sequence: Syntheticoligonucleotide
  source 1..24: mol_type = other DNA
ggaggactcctgcaggagtcctcc

SEQ ID NO: 1514 - DNA, 24 bp, synthetic construct
  misc_feature 1..24: note = Description of Artificial Sequence: Syntheticoligonucleotide
  source 1..24: mol_type = other DNA
ggcagactcctgcaggagtctgcc

SEQ ID NO: 1515 - DNA, 24 bp, synthetic construct
  misc_feature 1..24: note = Description of Artificial Sequence: Syntheticoligonucleotide
  source 1..24: mol_type = other DNA
tgcggactcctgcaggagtccgca

SEQ ID NO: 1516 - DNA, 24 bp, synthetic construct
  misc_feature 1..24: note = Description of Artificial Sequence: Syntheticoligonucleotide
  source 1..24: mol_type = other DNA
gtcggactcctgcaggagtccgac

SEQ ID NO: 1517 - DNA, 24 bp, synthetic construct
  misc_feature 1..24: note = Description of Artificial Sequence: Syntheticoligonucleotide
  source 1..24: mol_type = other DNA
ggtggactcctgcaggagtccacc

SEQ ID NO: 1518 - DNA, 24 bp, synthetic construct
  misc_feature 1..24: note = Description of Artificial Sequence: Syntheticoligonucleotide
  source 1..24: mol_type = other DNA
ggctgactcctgcaggagtcagcc

SEQ ID NO: 1519 - DNA, 24 bp, synthetic construct
  misc_feature 1..24: note = Description of Artificial Sequence: Syntheticoligonucleotide
  source 1..24: mol_type = other DNA
gcccgactcctgcaggagtcgggc

SEQ ID NO: 1520 - DNA, 24 bp, synthetic construct
  misc_feature 1..24: note = Description of Artificial Sequence: Syntheticoligonucleotide
  source 1..24: mol_type = other DNA
acccgactcctgcaggagtcgggt

SEQ ID NO: 1521 - DNA, 24 bp, synthetic construct
  misc_feature 1..24: note = Description of Artificial Sequence: Syntheticoligonucleotide
  source 1..24: mol_type = other DNA
gaccgactcctgcaggagtcggtc

SEQ ID NO: 1522 - DNA, 24 bp, synthetic construct
  misc_feature 1..24: note = Description of Artificial Sequence: Syntheticoligonucleotide
  source 1..24: mol_type = other DNA
gcacgactcctgcaggagtcgtgc

SEQ ID NO: 1523 - DNA, 24 bp, synthetic construct
  misc_feature 1..24: note = Description of Artificial Sequence: Syntheticoligonucleotide
  source 1..24: mol_type = other DNA
gccagactcctgcaggagtctggc

SEQ ID NO: 1524 - DNA, 24 bp, synthetic construct
  misc_feature 1..24: note = Description of Artificial Sequence: Syntheticoligonucleotide
  source 1..24: mol_type = other DNA
tcccgactcctgcaggagtcggga

SEQ ID NO: 1525 - DNA, 24 bp, synthetic construct
  misc_feature 1..24: note = Description of Artificial Sequence: Syntheticoligonucleotide
  source 1..24: mol_type = other DNA
gtccgactcctgcaggagtcggac

SEQ ID NO: 1526 - DNA, 24 bp, synthetic construct
  misc_feature 1..24: note = Description of Artificial Sequence: Syntheticoligonucleotide
  source 1..24: mol_type = other DNA
gcctgactcctgcaggagtcaggc

SEQ ID NO: 1527 - DNA, 24 bp, synthetic construct
  misc_feature 1..24: note = Description of Artificial Sequence: Syntheticoligonucleotide
  source 1..24: mol_type = other DNA
gggcgactcctgcaggagtcgccc

SEQ ID NO: 1528 - DNA, 24 bp, synthetic construct
  misc_feature 1..24: note = Description of Artificial Sequence: Syntheticoligonucleotide
  source 1..24: mol_type = other DNA
aggcgactcctgcaggagtcgcct

SEQ ID NO: 1529 - DNA, 24 bp, synthetic construct
  misc_feature 1..24: note = Description of Artificial Sequence: Syntheticoligonucleotide
  source 1..24: mol_type = other DNA
gagcgactcctgcaggagtcgctc

SEQ ID NO: 1530 - DNA, 24 bp, synthetic construct
  misc_feature 1..24: note = Description of Artificial Sequence: Syntheticoligonucleotide
  source 1..24: mol_type = other DNA
ggacgactcctgcaggagtcgtcc

SEQ ID NO: 1531 - DNA, 24 bp, synthetic construct
  misc_feature 1..24: note = Description of Artificial Sequence: Syntheticoligonucleotide
  source 1..24: mol_type = other DNA
gggagactcctgcaggagtctccc

SEQ ID NO: 1532 - DNA, 24 bp, synthetic construct
  misc_feature 1..24: note = Description of Artificial Sequence: Syntheticoligonucleotide
  source 1..24: mol_type = other DNA
tggcgactcctgcaggagtcgcca

SEQ ID NO: 1533 - DNA, 24 bp, synthetic construct
  misc_feature 1..24: note = Description of Artificial Sequence: Syntheticoligonucleotide
  source 1..24: mol_type = other DNA
gtgcgactcctgcaggagtcgcac

SEQ ID NO: 1534 - DNA, 24 bp, synthetic construct
  misc_feature 1..24: note = Description of Artificial Sequence: Syntheticoligonucleotide
  source 1..24: mol_type = other DNA
gggtgactcctgcaggagtcaccc

SEQ ID NO: 1535 - DNA, 24 bp, synthetic construct
  misc_feature 1..24: note = Description of Artificial Sequence: Syntheticoligonucleotide
  source 1..24: mol_type = other DNA
acgggactcctgcaggagtcccgt

SEQ ID NO: 1536 - DNA, 24 bp, synthetic construct
  misc_feature 1..24: note = Description of Artificial Sequence: Syntheticoligonucleotide
  source 1..24: mol_type = other DNA
cagggactcctgcaggagtccctg

SEQ ID NO: 1537 - DNA, 24 bp, synthetic construct
  misc_feature 1..24: note = Description of Artificial Sequence: Syntheticoligonucleotide
  source 1..24: mol_type = other DNA
ccaggactcctgcaggagtcctgg

SEQ ID NO: 1538 - DNA, 24 bp, synthetic construct
  misc_feature 1..24: note = Description of Artificial Sequence: Syntheticoligonucleotide
  source 1..24: mol_type = other DNA
ccgagactcctgcaggagtctcgg

SEQ ID NO: 1539 - DNA, 24 bp, synthetic construct
  misc_feature 1..24: note = Description of Artificial Sequence: Syntheticoligonucleotide
  source 1..24: mol_type = other DNA
tcgggactcctgcaggagtcccga

SEQ ID NO: 1540 - DNA, 24 bp, synthetic construct
  misc_feature 1..24: note = Description of Artificial Sequence: Syntheticoligonucleotide
  source 1..24: mol_type = other DNA
ctgggactcctgcaggagtcccag

SEQ ID NO: 1541 - DNA, 24 bp, synthetic construct
  misc_feature 1..24: note = Description of Artificial Sequence: Syntheticoligonucleotide
  source 1..24: mol_type = other DNA
cctggactcctgcaggagtccagg

SEQ ID NO: 1542 - DNA, 24 bp, synthetic construct
  misc_feature 1..24: note = Description of Artificial Sequence: Syntheticoligonucleotide
  source 1..24: mol_type = other DNA
ccgtgactcctgcaggagtcacgg

SEQ ID NO: 1543 - DNA, 24 bp, synthetic construct
  misc_feature 1..24: note = Description of Artificial Sequence: Syntheticoligonucleotide
  source 1..24: mol_type = other DNA
cggcgactcctgcaggagtcgccg

SEQ ID NO: 1544 - DNA, 24 bp, synthetic construct
  misc_feature 1..24: note = Description of Artificial Sequence: Syntheticoligonucleotide
  source 1..24: mol_type = other DNA
cagcgactcctgcaggagtcgctg

SEQ ID NO: 1545 - DNA, 24 bp, synthetic construct
  misc_feature 1..24: note = Description of Artificial Sequence: Syntheticoligonucleotide
  source 1..24: mol_type = other DNA
cgacgactcctgcaggagtcgtcg

SEQ ID NO: 1546 - DNA, 24 bp, synthetic construct
  misc_feature 1..24: note = Description of Artificial Sequence: Syntheticoligonucleotide
  source 1..24: mol_type = other DNA
cggagactcctgcaggagtctccg

SEQ ID NO: 1547 - DNA, 24 bp, synthetic construct
  misc_feature 1..24: note = Description of Artificial Sequence: Syntheticoligonucleotide
  source 1..24: mol_type = other DNA
ctgcgactcctgcaggagtcgcag

SEQ ID NO: 1548 - DNA, 24 bp, synthetic construct
  misc_feature 1..24: note = Description of Artificial Sequence: Syntheticoligonucleotide
  source 1..24: mol_type = other DNA
cggtgactcctgcaggagtcaccg

SEQ ID NO: 1549 - DNA, 24 bp, synthetic construct
  misc_feature 1..24: note = Description of Artificial Sequence: Syntheticoligonucleotide
  source 1..24: mol_type = other DNA
cacggactcctgcaggagtccgtg

SEQ ID NO: 1550 - DNA, 24 bp, synthetic construct
  misc_feature 1..24: note = Description of Artificial Sequence: Syntheticoligonucleotide
  source 1..24: mol_type = other DNA
cccagactcctgcaggagtctggg

SEQ ID NO: 1551 - DNA, 24 bp, synthetic construct
  misc_feature 1..24: note = Description of Artificial Sequence: Syntheticoligonucleotide
  source 1..24: mol_type = other DNA
ctcggactcctgcaggagtccgag

SEQ ID NO: 1552 - DNA, 24 bp, synthetic construct
  misc_feature 1..24: note = Description of Artificial Sequence: Syntheticoligonucleotide
  source 1..24: mol_type = other DNA
ccctgactcctgcaggagtcaggg

SEQ ID NO: 1553 - DNA, 24 bp, synthetic construct
  misc_feature 1..24: note = Description of Artificial Sequence: Syntheticoligonucleotide
  source 1..24: mol_type = other DNA
ccacgactcctgcaggagtcgtgg

SEQ ID NO: 1554 - DNA, 24 bp, synthetic construct
  misc_feature 1..24: note = Description of Artificial Sequence: Syntheticoligonucleotide
  source 1..24: mol_type = other DNA
agccgactcctgcaggagtcggct

SEQ ID NO: 1555 - DNA, 24 bp, synthetic construct
  misc_feature 1..24: note = Description of Artificial Sequence: Syntheticoligonucleotide
  source 1..24: mol_type = other DNA
tgccgactcctgcaggagtcggca

SEQ ID NO: 1556 - DNA, 24 bp, synthetic construct
  misc_feature 1..24: note = Description of Artificial Sequence: Syntheticoligonucleotide
  source 1..24: mol_type = other DNA
gcgagactcctgcaggagtctcgc

SEQ ID NO: 1557 - DNA, 24 bp, synthetic construct
  misc_feature 1..24: note = Description of Artificial Sequence: Syntheticoligonucleotide
  source 1..24: mol_type = other DNA
gcgtgactcctgcaggagtcacgc

SEQ ID NO: 1558 - DNA, 24 bp, synthetic construct
  misc_feature 1..24: note = Description of Artificial Sequence: Syntheticoligonucleotide
  source 1..24: mol_type = other DNA
gcaggactcctgcaggagtcctgc

SEQ ID NO: 1559 - DNA, 24 bp, synthetic construct
  misc_feature 1..24: note = Description of Artificial Sequence: Syntheticoligonucleotide
  source 1..24: mol_type = other DNA
gctggactcctgcaggagtccagc

SEQ ID NO: 1560 - DNA, 24 bp, synthetic construct
  misc_feature 1..24: note = Description of Artificial Sequence: Syntheticoligonucleotide
  source 1..24: mol_type = other DNA
cgaggactcctgcaggagtcctcg

SEQ ID NO: 1561 - DNA, 24 bp, synthetic construct
  misc_feature 1..24: note = Description of Artificial Sequence: Syntheticoligonucleotide
  source 1..24: mol_type = other DNA
cgtggactcctgcaggagtccacg

SEQ ID NO: 1562 - DNA, 24 bp, synthetic construct
  misc_feature 1..24: note = Description of Artificial Sequence: Syntheticoligonucleotide
  source 1..24: mol_type = other DNA
caccgactcctgcaggagtcggtg

SEQ ID NO: 1563 - DNA, 24 bp, synthetic construct
  misc_feature 1..24: note = Description of Artificial Sequence: Syntheticoligonucleotide
  source 1..24: mol_type = other DNA
ctccgactcctgcaggagtcggag

SEQ ID NO: 1564 - DNA, 24 bp, synthetic construct
  misc_feature 1..24: note = Description of Artificial Sequence: Syntheticoligonucleotide
  source 1..24: mol_type = other DNA
gcgggactcctgcaggagtcccgc

SEQ ID NO: 1565 - DNA, 24 bp, synthetic construct
  misc_feature 1..24: note = Description of Artificial Sequence: Syntheticoligonucleotide
  source 1..24: mol_type = other DNA
gagggactcctgcaggagtccctc

SEQ ID NO: 1566 - DNA, 24 bp, synthetic construct
  misc_feature 1..24: note = Description of Artificial Sequence: Syntheticoligonucleotide
  source 1..24: mol_type = other DNA
gtgggactcctgcaggagtcccac

SEQ ID NO: 1567 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcctcgaggagtcnnnn

SEQ ID NO: 1568 - DNA, 24 bp, synthetic construct
  misc_feature 1..24: note = Description of Artificial Sequence: Syntheticoligonucleotide
  source 1..24: mol_type = other DNA
ggcggactcctcgaggagtccgcc

SEQ ID NO: 1569 - DNA, 24 bp, synthetic construct
  misc_feature 1..24: note = Description of Artificial Sequence: Syntheticoligonucleotide
  source 1..24: mol_type = other DNA
agcggactcctcgaggagtccgct

SEQ ID NO: 1570 - DNA, 24 bp, synthetic construct
  misc_feature 1..24: note = Description of Artificial Sequence: Syntheticoligonucleotide
  source 1..24: mol_type = other DNA
gacggactcctcgaggagtccgtc

SEQ ID NO: 1571 - DNA, 24 bp, synthetic construct
  misc_feature 1..24: note = Description of Artificial Sequence: Syntheticoligonucleotide
  source 1..24: mol_type = other DNA
ggaggactcctcgaggagtcctcc

SEQ ID NO: 1572 - DNA, 24 bp, synthetic construct
  misc_feature 1..24: note = Description of Artificial Sequence: Syntheticoligonucleotide
  source 1..24: mol_type = other DNA
ggcagactcctcgaggagtctgcc

SEQ ID NO: 1573 - DNA, 24 bp, synthetic construct
  misc_feature 1..24: note = Description of Artificial Sequence: Syntheticoligonucleotide
  source 1..24: mol_type = other DNA
tgcggactcctcgaggagtccgca

SEQ ID NO: 1574 - DNA, 24 bp, synthetic construct
  misc_feature 1..24: note = Description of Artificial Sequence: Syntheticoligonucleotide
  source 1..24: mol_type = other DNA
gtcggactcctcgaggagtccgac

SEQ ID NO: 1575 - DNA, 24 bp, synthetic construct
  misc_feature 1..24: note = Description of Artificial Sequence: Syntheticoligonucleotide
  source 1..24: mol_type = other DNA
ggtggactcctcgaggagtccacc

SEQ ID NO: 1576 - DNA, 24 bp, synthetic construct
  misc_feature 1..24: note = Description of Artificial Sequence: Syntheticoligonucleotide
  source 1..24: mol_type = other DNA
ggctgactcctcgaggagtcagcc

SEQ ID NO: 1577 - DNA, 24 bp, synthetic construct
  misc_feature 1..24: note = Description of Artificial Sequence: Syntheticoligonucleotide
  source 1..24: mol_type = other DNA
gcccgactcctcgaggagtcgggc

SEQ ID NO: 1578 - DNA, 24 bp, synthetic construct
  misc_feature 1..24: note = Description of Artificial Sequence: Syntheticoligonucleotide
  source 1..24: mol_type = other DNA
acccgactcctcgaggagtcgggt

SEQ ID NO: 1579 - DNA, 24 bp, synthetic construct
  misc_feature 1..24: note = Description of Artificial Sequence: Syntheticoligonucleotide
  source 1..24: mol_type = other DNA
gaccgactcctcgaggagtcggtc

SEQ ID NO: 1580 - DNA, 24 bp, synthetic construct
  misc_feature 1..24: note = Description of Artificial Sequence: Syntheticoligonucleotide
  source 1..24: mol_type = other DNA
gcacgactcctcgaggagtcgtgc

SEQ ID NO: 1581 - DNA, 24 bp, synthetic construct
  misc_feature 1..24: note = Description of Artificial Sequence: Syntheticoligonucleotide
  source 1..24: mol_type = other DNA
gccagactcctcgaggagtctggc

SEQ ID NO: 1582 - DNA, 24 bp, synthetic construct
  misc_feature 1..24: note = Description of Artificial Sequence: Syntheticoligonucleotide
  source 1..24: mol_type = other DNA
tcccgactcctcgaggagtcggga

SEQ ID NO: 1583 - DNA, 24 bp, synthetic construct
  misc_feature 1..24: note = Description of Artificial Sequence: Syntheticoligonucleotide
  source 1..24: mol_type = other DNA
gtccgactcctcgaggagtcggac

SEQ ID NO: 1584 - DNA, 24 bp, synthetic construct
  misc_feature 1..24: note = Description of Artificial Sequence: Syntheticoligonucleotide
  source 1..24: mol_type = other DNA
gcctgactcctcgaggagtcaggc

SEQ ID NO: 1585 - DNA, 24 bp, synthetic construct
  misc_feature 1..24: note = Description of Artificial Sequence: Syntheticoligonucleotide
  source 1..24: mol_type = other DNA
gggcgactcctcgaggagtcgccc

SEQ ID NO: 1586 - DNA, 24 bp, synthetic construct
  misc_feature 1..24: note = Description of Artificial Sequence: Syntheticoligonucleotide
  source 1..24: mol_type = other DNA
aggcgactcctcgaggagtcgcct

SEQ ID NO: 1587 - DNA, 24 bp, synthetic construct
  misc_feature 1..24: note = Description of Artificial Sequence: Syntheticoligonucleotide
  source 1..24: mol_type = other DNA
gagcgactcctcgaggagtcgctc

SEQ ID NO: 1588 - DNA, 24 bp, synthetic construct
  misc_feature 1..24: note = Description of Artificial Sequence: Syntheticoligonucleotide
  source 1..24: mol_type = other DNA
ggacgactcctcgaggagtcgtcc

SEQ ID NO: 1589 - DNA, 24 bp, synthetic construct
  misc_feature 1..24: note = Description of Artificial Sequence: Syntheticoligonucleotide
  source 1..24: mol_type = other DNA
gggagactcctcgaggagtctccc

SEQ ID NO: 1590 - DNA, 24 bp, synthetic construct
  misc_feature 1..24: note = Description of Artificial Sequence: Syntheticoligonucleotide
  source 1..24: mol_type = other DNA
tggcgactcctcgaggagtcgcca

SEQ ID NO: 1591 - DNA, 24 bp, synthetic construct
  misc_feature 1..24: note = Description of Artificial Sequence: Syntheticoligonucleotide
  source 1..24: mol_type = other DNA
gtgcgactcctcgaggagtcgcac

SEQ ID NO: 1592 - DNA, 24 bp, synthetic construct
  misc_feature 1..24: note = Description of Artificial Sequence: Syntheticoligonucleotide
  source 1..24: mol_type = other DNA
gggtgactcctcgaggagtcaccc

SEQ ID NO: 1593 - DNA, 24 bp, synthetic construct
  misc_feature 1..24: note = Description of Artificial Sequence: Syntheticoligonucleotide
  source 1..24: mol_type = other DNA
acgggactcctcgaggagtcccgt

SEQ ID NO: 1594 - DNA, 24 bp, synthetic construct
  misc_feature 1..24: note = Description of Artificial Sequence: Syntheticoligonucleotide
  source 1..24: mol_type = other DNA
cagggactcctcgaggagtccctg

SEQ ID NO: 1595 - DNA, 24 bp, synthetic construct
  misc_feature 1..24: note = Description of Artificial Sequence: Syntheticoligonucleotide
  source 1..24: mol_type = other DNA
ccaggactcctcgaggagtcctgg

SEQ ID NO: 1596 - DNA, 24 bp, synthetic construct
  misc_feature 1..24: note = Description of Artificial Sequence: Syntheticoligonucleotide
  source 1..24: mol_type = other DNA
ccgagactcctcgaggagtctcgg

SEQ ID NO: 1597 - DNA, 24 bp, synthetic construct
  misc_feature 1..24: note = Description of Artificial Sequence: Syntheticoligonucleotide
  source 1..24: mol_type = other DNA
tcgggactcctcgaggagtcccga

SEQ ID NO: 1598 - DNA, 24 bp, synthetic construct
  misc_feature 1..24: note = Description of Artificial Sequence: Syntheticoligonucleotide
  source 1..24: mol_type = other DNA
ctgggactcctcgaggagtcccag

SEQ ID NO: 1599 - DNA, 24 bp, synthetic construct
  misc_feature 1..24: note = Description of Artificial Sequence: Syntheticoligonucleotide
  source 1..24: mol_type = other DNA
cctggactcctcgaggagtccagg

SEQ ID NO: 1600 - DNA, 24 bp, synthetic construct
  misc_feature 1..24: note = Description of Artificial Sequence: Syntheticoligonucleotide
  source 1..24: mol_type = other DNA
ccgtgactcctcgaggagtcacgg

SEQ ID NO: 1601 - DNA, 24 bp, synthetic construct
  misc_feature 1..24: note = Description of Artificial Sequence: Syntheticoligonucleotide
  source 1..24: mol_type = other DNA
cggcgactcctcgaggagtcgccg

SEQ ID NO: 1602 - DNA, 24 bp, synthetic construct
  misc_feature 1..24: note = Description of Artificial Sequence: Syntheticoligonucleotide
  source 1..24: mol_type = other DNA
cagcgactcctcgaggagtcgctg

SEQ ID NO: 1603 - DNA, 24 bp, synthetic construct
  misc_feature 1..24: note = Description of Artificial Sequence: Syntheticoligonucleotide
  source 1..24: mol_type = other DNA
cgacgactcctcgaggagtcgtcg

SEQ ID NO: 1604 - DNA, 24 bp, synthetic construct
  misc_feature 1..24: note = Description of Artificial Sequence: Syntheticoligonucleotide
  source 1..24: mol_type = other DNA
cggagactcctcgaggagtctccg

SEQ ID NO: 1605 - DNA, 24 bp, synthetic construct
  misc_feature 1..24: note = Description of Artificial Sequence: Syntheticoligonucleotide
  source 1..24: mol_type = other DNA
ctgcgactcctcgaggagtcgcag

SEQ ID NO: 1606 - DNA, 24 bp, synthetic construct
  misc_feature 1..24: note = Description of Artificial Sequence: Syntheticoligonucleotide
  source 1..24: mol_type = other DNA
cggtgactcctcgaggagtcaccg

SEQ ID NO: 1607 - DNA, 24 bp, synthetic construct
  misc_feature 1..24: note = Description of Artificial Sequence: Syntheticoligonucleotide
  source 1..24: mol_type = other DNA
cacggactcctcgaggagtccgtg

SEQ ID NO: 1608 - DNA, 24 bp, synthetic construct
  misc_feature 1..24: note = Description of Artificial Sequence: Syntheticoligonucleotide
  source 1..24: mol_type = other DNA
cccagactcctcgaggagtctggg

SEQ ID NO: 1609 - DNA, 24 bp, synthetic construct
  misc_feature 1..24: note = Description of Artificial Sequence: Syntheticoligonucleotide
  source 1..24: mol_type = other DNA
ctcggactcctcgaggagtccgag

SEQ ID NO: 1610 - DNA, 24 bp, synthetic construct
  misc_feature 1..24: note = Description of Artificial Sequence: Syntheticoligonucleotide
  source 1..24: mol_type = other DNA
ccctgactcctcgaggagtcaggg

SEQ ID NO: 1611 - DNA, 24 bp, synthetic construct
  misc_feature 1..24: note = Description of Artificial Sequence: Syntheticoligonucleotide
  source 1..24: mol_type = other DNA
ccacgactcctcgaggagtcgtgg

SEQ ID NO: 1612 - DNA, 24 bp, synthetic construct
  misc_feature 1..24: note = Description of Artificial Sequence: Syntheticoligonucleotide
  source 1..24: mol_type = other DNA
agccgactcctcgaggagtcggct

SEQ ID NO: 1613 - DNA, 24 bp, synthetic construct
  misc_feature 1..24: note = Description of Artificial Sequence: Syntheticoligonucleotide
  source 1..24: mol_type = other DNA
tgccgactcctcgaggagtcggca

SEQ ID NO: 1614 - DNA, 24 bp, synthetic construct
  misc_feature 1..24: note = Description of Artificial Sequence: Syntheticoligonucleotide
  source 1..24: mol_type = other DNA
gcgagactcctcgaggagtctcgc

SEQ ID NO: 1615 - DNA, 24 bp, synthetic construct
  misc_feature 1..24: note = Description of Artificial Sequence: Syntheticoligonucleotide
  source 1..24: mol_type = other DNA
gcgtgactcctcgaggagtcacgc

SEQ ID NO: 1616 - DNA, 24 bp, synthetic construct
  misc_feature 1..24: note = Description of Artificial Sequence: Syntheticoligonucleotide
  source 1..24: mol_type = other DNA
gcaggactcctcgaggagtcctgc

SEQ ID NO: 1617 - DNA, 24 bp, synthetic construct
  misc_feature 1..24: note = Description of Artificial Sequence: Syntheticoligonucleotide
  source 1..24: mol_type = other DNA
gctggactcctcgaggagtccagc

SEQ ID NO: 1618 - DNA, 24 bp, synthetic construct
  misc_feature 1..24: note = Description of Artificial Sequence: Syntheticoligonucleotide
  source 1..24: mol_type = other DNA
cgaggactcctcgaggagtcctcg

SEQ ID NO: 1619 - DNA, 24 bp, synthetic construct
  misc_feature 1..24: note = Description of Artificial Sequence: Syntheticoligonucleotide
  source 1..24: mol_type = other DNA
cgtggactcctcgaggagtccacg

SEQ ID NO: 1620 - DNA, 24 bp, synthetic construct
  misc_feature 1..24: note = Description of Artificial Sequence: Syntheticoligonucleotide
  source 1..24: mol_type = other DNA
caccgactcctcgaggagtcggtg

SEQ ID NO: 1621 - DNA, 24 bp, synthetic construct
  misc_feature 1..24: note = Description of Artificial Sequence: Syntheticoligonucleotide
  source 1..24: mol_type = other DNA
ctccgactcctcgaggagtcggag

SEQ ID NO: 1622 - DNA, 24 bp, synthetic construct
  misc_feature 1..24: note = Description of Artificial Sequence: Syntheticoligonucleotide
  source 1..24: mol_type = other DNA
gcgggactcctcgaggagtcccgc

SEQ ID NO: 1623 - DNA, 24 bp, synthetic construct
  misc_feature 1..24: note = Description of Artificial Sequence: Syntheticoligonucleotide
  source 1..24: mol_type = other DNA
gagggactcctcgaggagtccctc

SEQ ID NO: 1624 - DNA, 24 bp, synthetic construct
  misc_feature 1..24: note = Description of Artificial Sequence: Syntheticoligonucleotide
  source 1..24: mol_type = other DNA
gtgggactcctcgaggagtcccac

SEQ ID NO: 1625 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactccaattggagtcnnnn

SEQ ID NO: 1626 - DNA, 24 bp, synthetic construct
  misc_feature 1..24: note = Description of Artificial Sequence: Syntheticoligonucleotide
  source 1..24: mol_type = other DNA
ggcggactccaattggagtccgcc

SEQ ID NO: 1627 - DNA, 24 bp, synthetic construct
  misc_feature 1..24: note = Description of Artificial Sequence: Syntheticoligonucleotide
  source 1..24: mol_type = other DNA
agcggactccaattggagtccgct

SEQ ID NO: 1628 - DNA, 24 bp, synthetic construct
  misc_feature 1..24: note = Description of Artificial Sequence: Syntheticoligonucleotide
  source 1..24: mol_type = other DNA
gacggactccaattggagtccgtc

SEQ ID NO: 1629 - DNA, 24 bp, synthetic construct
  misc_feature 1..24: note = Description of Artificial Sequence: Syntheticoligonucleotide
  source 1..24: mol_type = other DNA
ggaggactccaattggagtcctcc

SEQ ID NO: 1630 - DNA, 24 bp, synthetic construct
  misc_feature 1..24: note = Description of Artificial Sequence: Syntheticoligonucleotide
  source 1..24: mol_type = other DNA
ggcagactccaattggagtctgcc

SEQ ID NO: 1631 - DNA, 24 bp, synthetic construct
  misc_feature 1..24: note = Description of Artificial Sequence: Syntheticoligonucleotide
  source 1..24: mol_type = other DNA
tgcggactccaattggagtccgca

SEQ ID NO: 1632 - DNA, 24 bp, synthetic construct
  misc_feature 1..24: note = Description of Artificial Sequence: Syntheticoligonucleotide
  source 1..24: mol_type = other DNA
gtcggactccaattggagtccgac

SEQ ID NO: 1633 - DNA, 24 bp, synthetic construct
  misc_feature 1..24: note = Description of Artificial Sequence: Syntheticoligonucleotide
  source 1..24: mol_type = other DNA
ggtggactccaattggagtccacc

SEQ ID NO: 1634 - DNA, 24 bp, synthetic construct
  misc_feature 1..24: note = Description of Artificial Sequence: Syntheticoligonucleotide
  source 1..24: mol_type = other DNA
ggctgactccaattggagtcagcc

SEQ ID NO: 1635 - DNA, 24 bp, synthetic construct
  misc_feature 1..24: note = Description of Artificial Sequence: Syntheticoligonucleotide
  source 1..24: mol_type = other DNA
gcccgactccaattggagtcgggc

SEQ ID NO: 1636 - DNA, 24 bp, synthetic construct
  misc_feature 1..24: note = Description of Artificial Sequence: Syntheticoligonucleotide
  source 1..24: mol_type = other DNA
acccgactccaattggagtcgggt

SEQ ID NO: 1637 - DNA, 24 bp, synthetic construct
  misc_feature 1..24: note = Description of Artificial Sequence: Syntheticoligonucleotide
  source 1..24: mol_type = other DNA
gaccgactccaattggagtcggtc

SEQ ID NO: 1638 - DNA, 24 bp, synthetic construct
  misc_feature 1..24: note = Description of Artificial Sequence: Syntheticoligonucleotide
  source 1..24: mol_type = other DNA
gcacgactccaattggagtcgtgc

SEQ ID NO: 1639 - DNA, 24 bp, synthetic construct
  misc_feature 1..24: note = Description of Artificial Sequence: Syntheticoligonucleotide
  source 1..24: mol_type = other DNA
gccagactccaattggagtctggc

SEQ ID NO: 1640 - DNA, 24 bp, synthetic construct
  misc_feature 1..24: note = Description of Artificial Sequence: Syntheticoligonucleotide
  source 1..24: mol_type = other DNA
tcccgactccaattggagtcggga

SEQ ID NO: 1641 - DNA, 24 bp, synthetic construct
  misc_feature 1..24: note = Description of Artificial Sequence: Syntheticoligonucleotide
  source 1..24: mol_type = other DNA
gtccgactccaattggagtcggac

SEQ ID NO: 1642 - DNA, 24 bp, synthetic construct
  misc_feature 1..24: note = Description of Artificial Sequence: Syntheticoligonucleotide
  source 1..24: mol_type = other DNA
gcctgactccaattggagtcaggc

SEQ ID NO: 1643 - DNA, 24 bp, synthetic construct
  misc_feature 1..24: note = Description of Artificial Sequence: Syntheticoligonucleotide
  source 1..24: mol_type = other DNA
gggcgactccaattggagtcgccc

SEQ ID NO: 1644 - DNA, 24 bp, synthetic construct
  misc_feature 1..24: note = Description of Artificial Sequence: Syntheticoligonucleotide
  source 1..24: mol_type = other DNA
aggcgactccaattggagtcgcct

SEQ ID NO: 1645 - DNA, 24 bp, synthetic construct
  misc_feature 1..24: note = Description of Artificial Sequence: Syntheticoligonucleotide
  source 1..24: mol_type = other DNA
gagcgactccaattggagtcgctc

SEQ ID NO: 1646 - DNA, 24 bp, synthetic construct
  misc_feature 1..24: note = Description of Artificial Sequence: Syntheticoligonucleotide
  source 1..24: mol_type = other DNA
ggacgactccaattggagtcgtcc

SEQ ID NO: 1647 - DNA, 24 bp, synthetic construct
  misc_feature 1..24: note = Description of Artificial Sequence: Syntheticoligonucleotide
  source 1..24: mol_type = other DNA
gggagactccaattggagtctccc

SEQ ID NO: 1648 - DNA, 24 bp, synthetic construct
  misc_feature 1..24: note = Description of Artificial Sequence: Syntheticoligonucleotide
  source 1..24: mol_type = other DNA
tggcgactccaattggagtcgcca

SEQ ID NO: 1649 - DNA, 24 bp, synthetic construct
  misc_feature 1..24: note = Description of Artificial Sequence: Syntheticoligonucleotide
  source 1..24: mol_type = other DNA
gtgcgactccaattggagtcgcac

SEQ ID NO: 1650 - DNA, 24 bp, synthetic construct
  misc_feature 1..24: note = Description of Artificial Sequence: Syntheticoligonucleotide
  source 1..24: mol_type = other DNA
gggtgactccaattggagtcaccc

SEQ ID NO: 1651 - DNA, 24 bp, synthetic construct
  misc_feature 1..24: note = Description of Artificial Sequence: Syntheticoligonucleotide
  source 1..24: mol_type = other DNA
acgggactccaattggagtcccgt

SEQ ID NO: 1652 - DNA, 24 bp, synthetic construct
  misc_feature 1..24: note = Description of Artificial Sequence: Syntheticoligonucleotide
  source 1..24: mol_type = other DNA
cagggactccaattggagtccctg

SEQ ID NO: 1653 - DNA, 24 bp, synthetic construct
  misc_feature 1..24: note = Description of Artificial Sequence: Syntheticoligonucleotide
  source 1..24: mol_type = other DNA
ccaggactccaattggagtcctgg

SEQ ID NO: 1654 - DNA, 24 bp, synthetic construct
  misc_feature 1..24: note = Description of Artificial Sequence: Syntheticoligonucleotide
  source 1..24: mol_type = other DNA
ccgagactccaattggagtctcgg

SEQ ID NO: 1655 - DNA, 24 bp, synthetic construct
  misc_feature 1..24: note = Description of Artificial Sequence: Syntheticoligonucleotide
  source 1..24: mol_type = other DNA
tcgggactccaattggagtcccga

SEQ ID NO: 1656 - DNA, 24 bp, synthetic construct
  misc_feature 1..24: note = Description of Artificial Sequence: Syntheticoligonucleotide
  source 1..24: mol_type = other DNA
ctgggactccaattggagtcccag

SEQ ID NO: 1657 - DNA, 24 bp, synthetic construct
  misc_feature 1..24: note = Description of Artificial Sequence: Syntheticoligonucleotide
  source 1..24: mol_type = other DNA
cctggactccaattggagtccagg

SEQ ID NO: 1658 - DNA, 24 bp, synthetic construct
  misc_feature 1..24: note = Description of Artificial Sequence: Syntheticoligonucleotide
  source 1..24: mol_type = other DNA
ccgtgactccaattggagtcacgg

SEQ ID NO: 1659 - DNA, 24 bp, synthetic construct
  misc_feature 1..24: note = Description of Artificial Sequence: Syntheticoligonucleotide
  source 1..24: mol_type = other DNA
cggcgactccaattggagtcgccg

SEQ ID NO: 1660 - DNA, 24 bp, synthetic construct
  misc_feature 1..24: note = Description of Artificial Sequence: Syntheticoligonucleotide
  source 1..24: mol_type = other DNA
cagcgactccaattggagtcgctg

SEQ ID NO: 1661 - DNA, 24 bp, synthetic construct
  misc_feature 1..24: note = Description of Artificial Sequence: Syntheticoligonucleotide
  source 1..24: mol_type = other DNA
cgacgactccaattggagtcgtcg

SEQ ID NO: 1662 - DNA, 24 bp, synthetic construct
  misc_feature 1..24: note = Description of Artificial Sequence: Syntheticoligonucleotide
  source 1..24: mol_type = other DNA
cggagactccaattggagtctccg

SEQ ID NO: 1663 - DNA, 24 bp, synthetic construct
  misc_feature 1..24: note = Description of Artificial Sequence: Syntheticoligonucleotide
  source 1..24: mol_type = other DNA
ctgcgactccaattggagtcgcag

SEQ ID NO: 1664 - DNA, 24 bp, synthetic construct
  misc_feature 1..24: note = Description of Artificial Sequence: Syntheticoligonucleotide
  source 1..24: mol_type = other DNA
cggtgactccaattggagtcaccg

SEQ ID NO: 1665 - DNA, 24 bp, synthetic construct
  misc_feature 1..24: note = Description of Artificial Sequence: Syntheticoligonucleotide
  source 1..24: mol_type = other DNA
cacggactccaattggagtccgtg

SEQ ID NO: 1666 - DNA, 24 bp, synthetic construct
  misc_feature 1..24: note = Description of Artificial Sequence: Syntheticoligonucleotide
  source 1..24: mol_type = other DNA
cccagactccaattggagtctggg

SEQ ID NO: 1667 - DNA, 24 bp, synthetic construct
  misc_feature 1..24: note = Description of Artificial Sequence: Syntheticoligonucleotide
  source 1..24: mol_type = other DNA
ctcggactccaattggagtccgag

SEQ ID NO: 1668 - DNA, 24 bp, synthetic construct
  misc_feature 1..24: note = Description of Artificial Sequence: Syntheticoligonucleotide
  source 1..24: mol_type = other DNA
ccctgactccaattggagtcaggg

SEQ ID NO: 1669 - DNA, 24 bp, synthetic construct
  misc_feature 1..24: note = Description of Artificial Sequence: Syntheticoligonucleotide
  source 1..24: mol_type = other DNA
ccacgactccaattggagtcgtgg

SEQ ID NO: 1670 - DNA, 24 bp, synthetic construct
  misc_feature 1..24: note = Description of Artificial Sequence: Syntheticoligonucleotide
  source 1..24: mol_type = other DNA
agccgactccaattggagtcggct

SEQ ID NO: 1671 - DNA, 24 bp, synthetic construct
  misc_feature 1..24: note = Description of Artificial Sequence: Syntheticoligonucleotide
  source 1..24: mol_type = other DNA
tgccgactccaattggagtcggca

SEQ ID NO: 1672 - DNA, 24 bp, synthetic construct
  misc_feature 1..24: note = Description of Artificial Sequence: Syntheticoligonucleotide
  source 1..24: mol_type = other DNA
gcgagactccaattggagtctcgc

SEQ ID NO: 1673 - DNA, 24 bp, synthetic construct
  misc_feature 1..24: note = Description of Artificial Sequence: Syntheticoligonucleotide
  source 1..24: mol_type = other DNA
gcgtgactccaattggagtcacgc

SEQ ID NO: 1674 - DNA, 24 bp, synthetic construct
  misc_feature 1..24: note = Description of Artificial Sequence: Syntheticoligonucleotide
  source 1..24: mol_type = other DNA
gcaggactccaattggagtcctgc

SEQ ID NO: 1675 - DNA, 24 bp, synthetic construct
  misc_feature 1..24: note = Description of Artificial Sequence: Syntheticoligonucleotide
  source 1..24: mol_type = other DNA
gctggactccaattggagtccagc

SEQ ID NO: 1676 - DNA, 24 bp, synthetic construct
  misc_feature 1..24: note = Description of Artificial Sequence: Syntheticoligonucleotide
  source 1..24: mol_type = other DNA
cgaggactccaattggagtcctcg

SEQ ID NO: 1677 - DNA, 24 bp, synthetic construct
  misc_feature 1..24: note = Description of Artificial Sequence: Syntheticoligonucleotide
  source 1..24: mol_type = other DNA
cgtggactccaattggagtccacg

SEQ ID NO: 1678 - DNA, 24 bp, synthetic construct
  misc_feature 1..24: note = Description of Artificial Sequence: Syntheticoligonucleotide
  source 1..24: mol_type = other DNA
caccgactccaattggagtcggtg

SEQ ID NO: 1679 - DNA, 24 bp, synthetic construct
  misc_feature 1..24: note = Description of Artificial Sequence: Syntheticoligonucleotide
  source 1..24: mol_type = other DNA
ctccgactccaattggagtcggag

SEQ ID NO: 1680 - DNA, 24 bp, synthetic construct
  misc_feature 1..24: note = Description of Artificial Sequence: Syntheticoligonucleotide
  source 1..24: mol_type = other DNA
gcgggactccaattggagtcccgc

SEQ ID NO: 1681 - DNA, 24 bp, synthetic construct
  misc_feature 1..24: note = Description of Artificial Sequence: Syntheticoligonucleotide
  source 1..24: mol_type = other DNA
gagggactccaattggagtccctc

SEQ ID NO: 1682 - DNA, 24 bp, synthetic construct
  misc_feature 1..24: note = Description of Artificial Sequence: Syntheticoligonucleotide
  source 1..24: mol_type = other DNA
gtgggactccaattggagtcccac

SEQ ID NO: 1683 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactccatatggagtcnnnn

SEQ ID NO: 1684 - DNA, 24 bp, synthetic construct
  misc_feature 1..24: note = Description of Artificial Sequence: Syntheticoligonucleotide
  source 1..24: mol_type = other DNA
ggcggactccatatggagtccgcc

SEQ ID NO: 1685 - DNA, 24 bp, synthetic construct
  misc_feature 1..24: note = Description of Artificial Sequence: Syntheticoligonucleotide
  source 1..24: mol_type = other DNA
agcggactccatatggagtccgct

SEQ ID NO: 1686 - DNA, 24 bp, synthetic construct
  misc_feature 1..24: note = Description of Artificial Sequence: Syntheticoligonucleotide
  source 1..24: mol_type = other DNA
gacggactccatatggagtccgtc

SEQ ID NO: 1687 - DNA, 24 bp, synthetic construct
  misc_feature 1..24: note = Description of Artificial Sequence: Syntheticoligonucleotide
  source 1..24: mol_type = other DNA
ggaggactccatatggagtcctcc

SEQ ID NO: 1688 - DNA, 24 bp, synthetic construct
  misc_feature 1..24: note = Description of Artificial Sequence: Syntheticoligonucleotide
  source 1..24: mol_type = other DNA
ggcagactccatatggagtctgcc

SEQ ID NO: 1689 - DNA, 24 bp, synthetic construct
  misc_feature 1..24: note = Description of Artificial Sequence: Syntheticoligonucleotide
  source 1..24: mol_type = other DNA
tgcggactccatatggagtccgca

SEQ ID NO: 1690 - DNA, 24 bp, synthetic construct
  misc_feature 1..24: note = Description of Artificial Sequence: Syntheticoligonucleotide
  source 1..24: mol_type = other DNA
gtcggactccatatggagtccgac

SEQ ID NO: 1691 - DNA, 24 bp, synthetic construct
  misc_feature 1..24: note = Description of Artificial Sequence: Syntheticoligonucleotide
  source 1..24: mol_type = other DNA
ggtggactccatatggagtccacc

SEQ ID NO: 1692 - DNA, 24 bp, synthetic construct
  misc_feature 1..24: note = Description of Artificial Sequence: Syntheticoligonucleotide
  source 1..24: mol_type = other DNA
ggctgactccatatggagtcagcc

SEQ ID NO: 1693 - DNA, 24 bp, synthetic construct
  misc_feature 1..24: note = Description of Artificial Sequence: Syntheticoligonucleotide
  source 1..24: mol_type = other DNA
gcccgactccatatggagtcgggc

SEQ ID NO: 1694 - DNA, 24 bp, synthetic construct
  misc_feature 1..24: note = Description of Artificial Sequence: Syntheticoligonucleotide
  source 1..24: mol_type = other DNA
acccgactccatatggagtcgggt

SEQ ID NO: 1695 - DNA, 24 bp, synthetic construct
  misc_feature 1..24: note = Description of Artificial Sequence: Syntheticoligonucleotide
  source 1..24: mol_type = other DNA
gaccgactccatatggagtcggtc

SEQ ID NO: 1696 - DNA, 24 bp, synthetic construct
  misc_feature 1..24: note = Description of Artificial Sequence: Syntheticoligonucleotide
  source 1..24: mol_type = other DNA
gcacgactccatatggagtcgtgc

SEQ ID NO: 1697 - DNA, 24 bp, synthetic construct
  misc_feature 1..24: note = Description of Artificial Sequence: Syntheticoligonucleotide
  source 1..24: mol_type = other DNA
gccagactccatatggagtctggc

SEQ ID NO: 1698 - DNA, 24 bp, synthetic construct
  misc_feature 1..24: note = Description of Artificial Sequence: Syntheticoligonucleotide
  source 1..24: mol_type = other DNA
tcccgactccatatggagtcggga

SEQ ID NO: 1699 - DNA, 24 bp, synthetic construct
  misc_feature 1..24: note = Description of Artificial Sequence: Syntheticoligonucleotide
  source 1..24: mol_type = other DNA
gtccgactccatatggagtcggac

SEQ ID NO: 1700 - DNA, 24 bp, synthetic construct
  misc_feature 1..24: note = Description of Artificial Sequence: Syntheticoligonucleotide
  source 1..24: mol_type = other DNA
gcctgactccatatggagtcaggc

SEQ ID NO: 1701 - DNA, 24 bp, synthetic construct
  misc_feature 1..24: note = Description of Artificial Sequence: Syntheticoligonucleotide
  source 1..24: mol_type = other DNA
gggcgactccatatggagtcgccc

SEQ ID NO: 1702 - DNA, 24 bp, synthetic construct
  misc_feature 1..24: note = Description of Artificial Sequence: Syntheticoligonucleotide
  source 1..24: mol_type = other DNA
aggcgactccatatggagtcgcct

SEQ ID NO: 1703 - DNA, 24 bp, synthetic construct
  misc_feature 1..24: note = Description of Artificial Sequence: Syntheticoligonucleotide
  source 1..24: mol_type = other DNA
gagcgactccatatggagtcgctc

SEQ ID NO: 1704 - DNA, 24 bp, synthetic construct
  misc_feature 1..24: note = Description of Artificial Sequence: Syntheticoligonucleotide
  source 1..24: mol_type = other DNA
ggacgactccatatggagtcgtcc

SEQ ID NO: 1705 - DNA, 24 bp, synthetic construct
  misc_feature 1..24: note = Description of Artificial Sequence: Syntheticoligonucleotide
  source 1..24: mol_type = other DNA
gggagactccatatggagtctccc

SEQ ID NO: 1706 - DNA, 24 bp, synthetic construct
  misc_feature 1..24: note = Description of Artificial Sequence: Syntheticoligonucleotide
  source 1..24: mol_type = other DNA
tggcgactccatatggagtcgcca

SEQ ID NO: 1707 - DNA, 24 bp, synthetic construct
  misc_feature 1..24: note = Description of Artificial Sequence: Syntheticoligonucleotide
  source 1..24: mol_type = other DNA
gtgcgactccatatggagtcgcac

SEQ ID NO: 1708 - DNA, 24 bp, synthetic construct
  misc_feature 1..24: note = Description of Artificial Sequence: Syntheticoligonucleotide
  source 1..24: mol_type = other DNA
gggtgactccatatggagtcaccc

SEQ ID NO: 1709 - DNA, 24 bp, synthetic construct
  misc_feature 1..24: note = Description of Artificial Sequence: Syntheticoligonucleotide
  source 1..24: mol_type = other DNA
acgggactccatatggagtcccgt

SEQ ID NO: 1710 - DNA, 24 bp, synthetic construct
  misc_feature 1..24: note = Description of Artificial Sequence: Syntheticoligonucleotide
  source 1..24: mol_type = other DNA
cagggactccatatggagtccctg

SEQ ID NO: 1711 - DNA, 24 bp, synthetic construct
  misc_feature 1..24: note = Description of Artificial Sequence: Syntheticoligonucleotide
  source 1..24: mol_type = other DNA
ccaggactccatatggagtcctgg

SEQ ID NO: 1712 - DNA, 24 bp, synthetic construct
  misc_feature 1..24: note = Description of Artificial Sequence: Syntheticoligonucleotide
  source 1..24: mol_type = other DNA
ccgagactccatatggagtctcgg

SEQ ID NO: 1713 - DNA, 24 bp, synthetic construct
  misc_feature 1..24: note = Description of Artificial Sequence: Syntheticoligonucleotide
  source 1..24: mol_type = other DNA
tcgggactccatatggagtcccga

SEQ ID NO: 1714 - DNA, 24 bp, synthetic construct
  misc_feature 1..24: note = Description of Artificial Sequence: Syntheticoligonucleotide
  source 1..24: mol_type = other DNA
ctgggactccatatggagtcccag

SEQ ID NO: 1715 - DNA, 24 bp, synthetic construct
  misc_feature 1..24: note = Description of Artificial Sequence: Syntheticoligonucleotide
  source 1..24: mol_type = other DNA
cctggactccatatggagtccagg

SEQ ID NO: 1716 - DNA, 24 bp, synthetic construct
  misc_feature 1..24: note = Description of Artificial Sequence: Syntheticoligonucleotide
  source 1..24: mol_type = other DNA
ccgtgactccatatggagtcacgg

SEQ ID NO: 1717 - DNA, 24 bp, synthetic construct
  misc_feature 1..24: note = Description of Artificial Sequence: Syntheticoligonucleotide
  source 1..24: mol_type = other DNA
cggcgactccatatggagtcgccg

SEQ ID NO: 1718 - DNA, 24 bp, synthetic construct
  misc_feature 1..24: note = Description of Artificial Sequence: Syntheticoligonucleotide
  source 1..24: mol_type = other DNA
cagcgactccatatggagtcgctg

SEQ ID NO: 1719 - DNA, 24 bp, synthetic construct
  misc_feature 1..24: note = Description of Artificial Sequence: Syntheticoligonucleotide
  source 1..24: mol_type = other DNA
cgacgactccatatggagtcgtcg

SEQ ID NO: 1720 - DNA, 24 bp, synthetic construct
  misc_feature 1..24: note = Description of Artificial Sequence: Syntheticoligonucleotide
  source 1..24: mol_type = other DNA
cggagactccatatggagtctccg

SEQ ID NO: 1721 - DNA, 24 bp, synthetic construct
  misc_feature 1..24: note = Description of Artificial Sequence: Syntheticoligonucleotide
  source 1..24: mol_type = other DNA
ctgcgactccatatggagtcgcag

SEQ ID NO: 1722 - DNA, 24 bp, synthetic construct
  misc_feature 1..24: note = Description of Artificial Sequence: Syntheticoligonucleotide
  source 1..24: mol_type = other DNA
cggtgactccatatggagtcaccg

SEQ ID NO: 1723 - DNA, 24 bp, synthetic construct
  misc_feature 1..24: note = Description of Artificial Sequence: Syntheticoligonucleotide
  source 1..24: mol_type = other DNA
cacggactccatatggagtccgtg

SEQ ID NO: 1724 - DNA, 24 bp, synthetic construct
  misc_feature 1..24: note = Description of Artificial Sequence: Syntheticoligonucleotide
  source 1..24: mol_type = other DNA
cccagactccatatggagtctggg

SEQ ID NO: 1725 - DNA, 24 bp, synthetic construct
  misc_feature 1..24: note = Description of Artificial Sequence: Syntheticoligonucleotide
  source 1..24: mol_type = other DNA
ctcggactccatatggagtccgag

SEQ ID NO: 1726 - DNA, 24 bp, synthetic construct
  misc_feature 1..24: note = Description of Artificial Sequence: Syntheticoligonucleotide
  source 1..24: mol_type = other DNA
ccctgactccatatggagtcaggg

SEQ ID NO: 1727 - DNA, 24 bp, synthetic construct
  misc_feature 1..24: note = Description of Artificial Sequence: Syntheticoligonucleotide
  source 1..24: mol_type = other DNA
ccacgactccatatggagtcgtgg

SEQ ID NO: 1728 - DNA, 24 bp, synthetic construct
  misc_feature 1..24: note = Description of Artificial Sequence: Syntheticoligonucleotide
  source 1..24: mol_type = other DNA
agccgactccatatggagtcggct

SEQ ID NO: 1729 - DNA, 24 bp, synthetic construct
  misc_feature 1..24: note = Description of Artificial Sequence: Syntheticoligonucleotide
  source 1..24: mol_type = other DNA
tgccgactccatatggagtcggca

SEQ ID NO: 1730 - DNA, 24 bp, synthetic construct
  misc_feature 1..24: note = Description of Artificial Sequence: Syntheticoligonucleotide
  source 1..24: mol_type = other DNA
gcgagactccatatggagtctcgc

SEQ ID NO: 1731 - DNA, 24 bp, synthetic construct
  misc_feature 1..24: note = Description of Artificial Sequence: Syntheticoligonucleotide
  source 1..24: mol_type = other DNA
gcgtgactccatatggagtcacgc

SEQ ID NO: 1732 - DNA, 24 bp, synthetic construct
  misc_feature 1..24: note = Description of Artificial Sequence: Syntheticoligonucleotide
  source 1..24: mol_type = other DNA
gcaggactccatatggagtcctgc

SEQ ID NO: 1733 - DNA, 24 bp, synthetic construct
  misc_feature 1..24: note = Description of Artificial Sequence: Syntheticoligonucleotide
  source 1..24: mol_type = other DNA
gctggactccatatggagtccagc

SEQ ID NO: 1734 - DNA, 24 bp, synthetic construct
  misc_feature 1..24: note = Description of Artificial Sequence: Syntheticoligonucleotide
  source 1..24: mol_type = other DNA
cgaggactccatatggagtcctcg

SEQ ID NO: 1735 - DNA, 24 bp, synthetic construct
  misc_feature 1..24: note = Description of Artificial Sequence: Syntheticoligonucleotide
  source 1..24: mol_type = other DNA
cgtggactccatatggagtccacg

SEQ ID NO: 1736 - DNA, 24 bp, synthetic construct
  misc_feature 1..24: note = Description of Artificial Sequence: Syntheticoligonucleotide
  source 1..24: mol_type = other DNA
caccgactccatatggagtcggtg

SEQ ID NO: 1737 - DNA, 24 bp, synthetic construct
  misc_feature 1..24: note = Description of Artificial Sequence: Syntheticoligonucleotide
  source 1..24: mol_type = other DNA
ctccgactccatatggagtcggag

SEQ ID NO: 1738 - DNA, 24 bp, synthetic construct
  misc_feature 1..24: note = Description of Artificial Sequence: Syntheticoligonucleotide
  source 1..24: mol_type = other DNA
gcgggactccatatggagtcccgc

SEQ ID NO: 1739 - DNA, 24 bp, synthetic construct
  misc_feature 1..24: note = Description of Artificial Sequence: Syntheticoligonucleotide
  source 1..24: mol_type = other DNA
gagggactccatatggagtccctc

SEQ ID NO: 1740 - DNA, 24 bp, synthetic construct
  misc_feature 1..24: note = Description of Artificial Sequence: Syntheticoligonucleotide
  source 1..24: mol_type = other DNA
gtgggactccatatggagtcccac

SEQ ID NO: 1741 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactccagctggagtcnnnn

SEQ ID NO: 1742 - DNA, 24 bp, synthetic construct
  misc_feature 1..24: note = Description of Artificial Sequence: Syntheticoligonucleotide
  source 1..24: mol_type = other DNA
ggcggactccagctggagtccgcc

SEQ ID NO: 1743 - DNA, 24 bp, synthetic construct
  misc_feature 1..24: note = Description of Artificial Sequence: Syntheticoligonucleotide
  source 1..24: mol_type = other DNA
agcggactccagctggagtccgct

SEQ ID NO: 1744 - DNA, 24 bp, synthetic construct
  misc_feature 1..24: note = Description of Artificial Sequence: Syntheticoligonucleotide
  source 1..24: mol_type = other DNA
gacggactccagctggagtccgtc

SEQ ID NO: 1745 - DNA, 24 bp, synthetic construct
  misc_feature 1..24: note = Description of Artificial Sequence: Syntheticoligonucleotide
  source 1..24: mol_type = other DNA
ggaggactccagctggagtcctcc

SEQ ID NO: 1746 - DNA, 24 bp, synthetic construct
  misc_feature 1..24: note = Description of Artificial Sequence: Syntheticoligonucleotide
  source 1..24: mol_type = other DNA
ggcagactccagctggagtctgcc

SEQ ID NO: 1747 - DNA, 24 bp, synthetic construct
  misc_feature 1..24: note = Description of Artificial Sequence: Syntheticoligonucleotide
  source 1..24: mol_type = other DNA
tgcggactccagctggagtccgca

SEQ ID NO: 1748 - DNA, 24 bp, synthetic construct
  misc_feature 1..24: note = Description of Artificial Sequence: Syntheticoligonucleotide
  source 1..24: mol_type = other DNA
gtcggactccagctggagtccgac

SEQ ID NO: 1749 - DNA, 24 bp, synthetic construct
  misc_feature 1..24: note = Description of Artificial Sequence: Syntheticoligonucleotide
  source 1..24: mol_type = other DNA
ggtggactccagctggagtccacc

SEQ ID NO: 1750 - DNA, 24 bp, synthetic construct
  misc_feature 1..24: note = Description of Artificial Sequence: Syntheticoligonucleotide
  source 1..24: mol_type = other DNA
ggctgactccagctggagtcagcc

SEQ ID NO: 1751 - DNA, 24 bp, synthetic construct
  misc_feature 1..24: note = Description of Artificial Sequence: Syntheticoligonucleotide
  source 1..24: mol_type = other DNA
gcccgactccagctggagtcgggc

SEQ ID NO: 1752 - DNA, 24 bp, synthetic construct
  misc_feature 1..24: note = Description of Artificial Sequence: Syntheticoligonucleotide
  source 1..24: mol_type = other DNA
acccgactccagctggagtcgggt

SEQ ID NO: 1753 - DNA, 24 bp, synthetic construct
  misc_feature 1..24: note = Description of Artificial Sequence: Syntheticoligonucleotide
  source 1..24: mol_type = other DNA
gaccgactccagctggagtcggtc

SEQ ID NO: 1754 - DNA, 24 bp, synthetic construct
  misc_feature 1..24: note = Description of Artificial Sequence: Syntheticoligonucleotide
  source 1..24: mol_type = other DNA
gcacgactccagctggagtcgtgc

SEQ ID NO: 1755 - DNA, 24 bp, synthetic construct
  misc_feature 1..24: note = Description of Artificial Sequence: Syntheticoligonucleotide
  source 1..24: mol_type = other DNA
gccagactccagctggagtctggc

SEQ ID NO: 1756 - DNA, 24 bp, synthetic construct
  misc_feature 1..24: note = Description of Artificial Sequence: Syntheticoligonucleotide
  source 1..24: mol_type = other DNA
tcccgactccagctggagtcggga

SEQ ID NO: 1757 - DNA, 24 bp, synthetic construct
  misc_feature 1..24: note = Description of Artificial Sequence: Syntheticoligonucleotide
  source 1..24: mol_type = other DNA
gtccgactccagctggagtcggac

SEQ ID NO: 1758 - DNA, 24 bp, synthetic construct
  misc_feature 1..24: note = Description of Artificial Sequence: Syntheticoligonucleotide
  source 1..24: mol_type = other DNA
gcctgactccagctggagtcaggc

SEQ ID NO: 1759 - DNA, 24 bp, synthetic construct
  misc_feature 1..24: note = Description of Artificial Sequence: Syntheticoligonucleotide
  source 1..24: mol_type = other DNA
gggcgactccagctggagtcgccc

SEQ ID NO: 1760 - DNA, 24 bp, synthetic construct
  misc_feature 1..24: note = Description of Artificial Sequence: Syntheticoligonucleotide
  source 1..24: mol_type = other DNA
aggcgactccagctggagtcgcct

SEQ ID NO: 1761 - DNA, 24 bp, synthetic construct
  misc_feature 1..24: note = Description of Artificial Sequence: Syntheticoligonucleotide
  source 1..24: mol_type = other DNA
gagcgactccagctggagtcgctc

SEQ ID NO: 1762 - DNA, 24 bp, synthetic construct
  misc_feature 1..24: note = Description of Artificial Sequence: Syntheticoligonucleotide
  source 1..24: mol_type = other DNA
ggacgactccagctggagtcgtcc

SEQ ID NO: 1763 - DNA, 24 bp, synthetic construct
  misc_feature 1..24: note = Description of Artificial Sequence: Syntheticoligonucleotide
  source 1..24: mol_type = other DNA
gggagactccagctggagtctccc

SEQ ID NO: 1764 - DNA, 24 bp, synthetic construct
  misc_feature 1..24: note = Description of Artificial Sequence: Syntheticoligonucleotide
  source 1..24: mol_type = other DNA
tggcgactccagctggagtcgcca

SEQ ID NO: 1765 - DNA, 24 bp, synthetic construct
  misc_feature 1..24: note = Description of Artificial Sequence: Syntheticoligonucleotide
  source 1..24: mol_type = other DNA
gtgcgactccagctggagtcgcac

SEQ ID NO: 1766 - DNA, 24 bp, synthetic construct
  misc_feature 1..24: note = Description of Artificial Sequence: Syntheticoligonucleotide
  source 1..24: mol_type = other DNA
gggtgactccagctggagtcaccc

SEQ ID NO: 1767 - DNA, 24 bp, synthetic construct
  misc_feature 1..24: note = Description of Artificial Sequence: Syntheticoligonucleotide
  source 1..24: mol_type = other DNA
acgggactccagctggagtcccgt

SEQ ID NO: 1768 - DNA, 24 bp, synthetic construct
  misc_feature 1..24: note = Description of Artificial Sequence: Syntheticoligonucleotide
  source 1..24: mol_type = other DNA
cagggactccagctggagtccctg

SEQ ID NO: 1769 - DNA, 24 bp, synthetic construct
  misc_feature 1..24: note = Description of Artificial Sequence: Syntheticoligonucleotide
  source 1..24: mol_type = other DNA
ccaggactccagctggagtcctgg

SEQ ID NO: 1770 - DNA, 24 bp, synthetic construct
  misc_feature 1..24: note = Description of Artificial Sequence: Syntheticoligonucleotide
  source 1..24: mol_type = other DNA
ccgagactccagctggagtctcgg

SEQ ID NO: 1771 - DNA, 24 bp, synthetic construct
  misc_feature 1..24: note = Description of Artificial Sequence: Syntheticoligonucleotide
  source 1..24: mol_type = other DNA
tcgggactccagctggagtcccga

SEQ ID NO: 1772 - DNA, 24 bp, synthetic construct
  misc_feature 1..24: note = Description of Artificial Sequence: Syntheticoligonucleotide
  source 1..24: mol_type = other DNA
ctgggactccagctggagtcccag

SEQ ID NO: 1773 - DNA, 24 bp, synthetic construct
  misc_feature 1..24: note = Description of Artificial Sequence: Syntheticoligonucleotide
  source 1..24: mol_type = other DNA
cctggactccagctggagtccagg

SEQ ID NO: 1774 - DNA, 24 bp, synthetic construct
  misc_feature 1..24: note = Description of Artificial Sequence: Syntheticoligonucleotide
  source 1..24: mol_type = other DNA
ccgtgactccagctggagtcacgg

SEQ ID NO: 1775 - DNA, 24 bp, synthetic construct
  misc_feature 1..24: note = Description of Artificial Sequence: Syntheticoligonucleotide
  source 1..24: mol_type = other DNA
cggcgactccagctggagtcgccg

SEQ ID NO: 1776 - DNA, 24 bp, synthetic construct
  misc_feature 1..24: note = Description of Artificial Sequence: Syntheticoligonucleotide
  source 1..24: mol_type = other DNA
cagcgactccagctggagtcgctg

SEQ ID NO: 1777 - DNA, 24 bp, synthetic construct
  misc_feature 1..24: note = Description of Artificial Sequence: Syntheticoligonucleotide
  source 1..24: mol_type = other DNA
cgacgactccagctggagtcgtcg

SEQ ID NO: 1778 - DNA, 24 bp, synthetic construct
  misc_feature 1..24: note = Description of Artificial Sequence: Syntheticoligonucleotide
  source 1..24: mol_type = other DNA
cggagactccagctggagtctccg

SEQ ID NO: 1779 - DNA, 24 bp, synthetic construct
  misc_feature 1..24: note = Description of Artificial Sequence: Syntheticoligonucleotide
  source 1..24: mol_type = other DNA
ctgcgactccagctggagtcgcag

SEQ ID NO: 1780 - DNA, 24 bp, synthetic construct
  misc_feature 1..24: note = Description of Artificial Sequence: Syntheticoligonucleotide
  source 1..24: mol_type = other DNA
cggtgactccagctggagtcaccg

SEQ ID NO: 1781 - DNA, 24 bp, synthetic construct
  misc_feature 1..24: note = Description of Artificial Sequence: Syntheticoligonucleotide
  source 1..24: mol_type = other DNA
cacggactccagctggagtccgtg

SEQ ID NO: 1782 - DNA, 24 bp, synthetic construct
  misc_feature 1..24: note = Description of Artificial Sequence: Syntheticoligonucleotide
  source 1..24: mol_type = other DNA
cccagactccagctggagtctggg

SEQ ID NO: 1783 - DNA, 24 bp, synthetic construct
  misc_feature 1..24: note = Description of Artificial Sequence: Syntheticoligonucleotide
  source 1..24: mol_type = other DNA
ctcggactccagctggagtccgag

SEQ ID NO: 1784 - DNA, 24 bp, synthetic construct
  misc_feature 1..24: note = Description of Artificial Sequence: Syntheticoligonucleotide
  source 1..24: mol_type = other DNA
ccctgactccagctggagtcaggg

SEQ ID NO: 1785 - DNA, 24 bp, synthetic construct
  misc_feature 1..24: note = Description of Artificial Sequence: Syntheticoligonucleotide
  source 1..24: mol_type = other DNA
ccacgactccagctggagtcgtgg

SEQ ID NO: 1786 - DNA, 24 bp, synthetic construct
  misc_feature 1..24: note = Description of Artificial Sequence: Syntheticoligonucleotide
  source 1..24: mol_type = other DNA
agccgactccagctggagtcggct

SEQ ID NO: 1787 - DNA, 24 bp, synthetic construct
  misc_feature 1..24: note = Description of Artificial Sequence: Syntheticoligonucleotide
  source 1..24: mol_type = other DNA
tgccgactccagctggagtcggca

SEQ ID NO: 1788 - DNA, 24 bp, synthetic construct
  misc_feature 1..24: note = Description of Artificial Sequence: Syntheticoligonucleotide
  source 1..24: mol_type = other DNA
gcgagactccagctggagtctcgc

SEQ ID NO: 1789 - DNA, 24 bp, synthetic construct
  misc_feature 1..24: note = Description of Artificial Sequence: Syntheticoligonucleotide
  source 1..24: mol_type = other DNA
gcgtgactccagctggagtcacgc

SEQ ID NO: 1790 - DNA, 24 bp, synthetic construct
  misc_feature 1..24: note = Description of Artificial Sequence: Syntheticoligonucleotide
  source 1..24: mol_type = other DNA
gcaggactccagctggagtcctgc

SEQ ID NO: 1791 - DNA, 24 bp, synthetic construct
  misc_feature 1..24: note = Description of Artificial Sequence: Syntheticoligonucleotide
  source 1..24: mol_type = other DNA
gctggactccagctggagtccagc

SEQ ID NO: 1792 - DNA, 24 bp, synthetic construct
  misc_feature 1..24: note = Description of Artificial Sequence: Syntheticoligonucleotide
  source 1..24: mol_type = other DNA
cgaggactccagctggagtcctcg

SEQ ID NO: 1793 - DNA, 24 bp, synthetic construct
  misc_feature 1..24: note = Description of Artificial Sequence: Syntheticoligonucleotide
  source 1..24: mol_type = other DNA
cgtggactccagctggagtccacg

SEQ ID NO: 1794 - DNA, 24 bp, synthetic construct
  misc_feature 1..24: note = Description of Artificial Sequence: Syntheticoligonucleotide
  source 1..24: mol_type = other DNA
caccgactccagctggagtcggtg

SEQ ID NO: 1795 - DNA, 24 bp, synthetic construct
  misc_feature 1..24: note = Description of Artificial Sequence: Syntheticoligonucleotide
  source 1..24: mol_type = other DNA
ctccgactccagctggagtcggag

SEQ ID NO: 1796 - DNA, 24 bp, synthetic construct
  misc_feature 1..24: note = Description of Artificial Sequence: Syntheticoligonucleotide
  source 1..24: mol_type = other DNA
gcgggactccagctggagtcccgc

SEQ ID NO: 1797 - DNA, 24 bp, synthetic construct
  misc_feature 1..24: note = Description of Artificial Sequence: Syntheticoligonucleotide
  source 1..24: mol_type = other DNA
gagggactccagctggagtccctc

SEQ ID NO: 1798 - DNA, 24 bp, synthetic construct
  misc_feature 1..24: note = Description of Artificial Sequence: Syntheticoligonucleotide
  source 1..24: mol_type = other DNA
gtgggactccagctggagtcccac

SEQ ID NO: 1799 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactccacgtggagtcnnnn

SEQ ID NO: 1800 - DNA, 24 bp, synthetic construct
  misc_feature 1..24: note = Description of Artificial Sequence: Syntheticoligonucleotide
  source 1..24: mol_type = other DNA
ggcggactccacgtggagtccgcc

SEQ ID NO: 1801 - DNA, 24 bp, synthetic construct
  misc_feature 1..24: note = Description of Artificial Sequence: Syntheticoligonucleotide
  source 1..24: mol_type = other DNA
agcggactccacgtggagtccgct

SEQ ID NO: 1802 - DNA, 24 bp, synthetic construct
  misc_feature 1..24: note = Description of Artificial Sequence: Syntheticoligonucleotide
  source 1..24: mol_type = other DNA
gacggactccacgtggagtccgtc

SEQ ID NO: 1803 - DNA, 24 bp, synthetic construct
  misc_feature 1..24: note = Description of Artificial Sequence: Syntheticoligonucleotide
  source 1..24: mol_type = other DNA
ggaggactccacgtggagtcctcc

SEQ ID NO: 1804 - DNA, 24 bp, synthetic construct
  misc_feature 1..24: note = Description of Artificial Sequence: Syntheticoligonucleotide
  source 1..24: mol_type = other DNA
ggcagactccacgtggagtctgcc

SEQ ID NO: 1805 - DNA, 24 bp, synthetic construct
  misc_feature 1..24: note = Description of Artificial Sequence: Syntheticoligonucleotide
  source 1..24: mol_type = other DNA
tgcggactccacgtggagtccgca

SEQ ID NO: 1806 - DNA, 24 bp, synthetic construct
  misc_feature 1..24: note = Description of Artificial Sequence: Syntheticoligonucleotide
  source 1..24: mol_type = other DNA
gtcggactccacgtggagtccgac

SEQ ID NO: 1807 - DNA, 24 bp, synthetic construct
  misc_feature 1..24: note = Description of Artificial Sequence: Syntheticoligonucleotide
  source 1..24: mol_type = other DNA
ggtggactccacgtggagtccacc

SEQ ID NO: 1808 - DNA, 24 bp, synthetic construct
  misc_feature 1..24: note = Description of Artificial Sequence: Syntheticoligonucleotide
  source 1..24: mol_type = other DNA
ggctgactccacgtggagtcagcc

SEQ ID NO: 1809 - DNA, 24 bp, synthetic construct
  misc_feature 1..24: note = Description of Artificial Sequence: Syntheticoligonucleotide
  source 1..24: mol_type = other DNA
gcccgactccacgtggagtcgggc

SEQ ID NO: 1810 - DNA, 24 bp, synthetic construct
  misc_feature 1..24: note = Description of Artificial Sequence: Syntheticoligonucleotide
  source 1..24: mol_type = other DNA
acccgactccacgtggagtcgggt

SEQ ID NO: 1811 - DNA, 24 bp, synthetic construct
  misc_feature 1..24: note = Description of Artificial Sequence: Syntheticoligonucleotide
  source 1..24: mol_type = other DNA
gaccgactccacgtggagtcggtc

SEQ ID NO: 1812 - DNA, 24 bp, synthetic construct
  misc_feature 1..24: note = Description of Artificial Sequence: Syntheticoligonucleotide
  source 1..24: mol_type = other DNA
gcacgactccacgtggagtcgtgc

SEQ ID NO: 1813 - DNA, 24 bp, synthetic construct
  misc_feature 1..24: note = Description of Artificial Sequence: Syntheticoligonucleotide
  source 1..24: mol_type = other DNA
gccagactccacgtggagtctggc

SEQ ID NO: 1814 - DNA, 24 bp, synthetic construct
  misc_feature 1..24: note = Description of Artificial Sequence: Syntheticoligonucleotide
  source 1..24: mol_type = other DNA
tcccgactccacgtggagtcggga

SEQ ID NO: 1815 - DNA, 24 bp, synthetic construct
  misc_feature 1..24: note = Description of Artificial Sequence: Syntheticoligonucleotide
  source 1..24: mol_type = other DNA
gtccgactccacgtggagtcggac

SEQ ID NO: 1816 - DNA, 24 bp, synthetic construct
  misc_feature 1..24: note = Description of Artificial Sequence: Syntheticoligonucleotide
  source 1..24: mol_type = other DNA
gcctgactccacgtggagtcaggc

SEQ ID NO: 1817 - DNA, 24 bp, synthetic construct
  misc_feature 1..24: note = Description of Artificial Sequence: Syntheticoligonucleotide
  source 1..24: mol_type = other DNA
gggcgactccacgtggagtcgccc

SEQ ID NO: 1818 - DNA, 24 bp, synthetic construct
  misc_feature 1..24: note = Description of Artificial Sequence: Syntheticoligonucleotide
  source 1..24: mol_type = other DNA
aggcgactccacgtggagtcgcct

SEQ ID NO: 1819 - DNA, 24 bp, synthetic construct
  misc_feature 1..24: note = Description of Artificial Sequence: Syntheticoligonucleotide
  source 1..24: mol_type = other DNA
gagcgactccacgtggagtcgctc

SEQ ID NO: 1820 - DNA, 24 bp, synthetic construct
  misc_feature 1..24: note = Description of Artificial Sequence: Syntheticoligonucleotide
  source 1..24: mol_type = other DNA
ggacgactccacgtggagtcgtcc

SEQ ID NO: 1821 - DNA, 24 bp, synthetic construct
  misc_feature 1..24: note = Description of Artificial Sequence: Syntheticoligonucleotide
  source 1..24: mol_type = other DNA
gggagactccacgtggagtctccc

SEQ ID NO: 1822 - DNA, 24 bp, synthetic construct
  misc_feature 1..24: note = Description of Artificial Sequence: Syntheticoligonucleotide
  source 1..24: mol_type = other DNA
tggcgactccacgtggagtcgcca

SEQ ID NO: 1823 - DNA, 24 bp, synthetic construct
  misc_feature 1..24: note = Description of Artificial Sequence: Syntheticoligonucleotide
  source 1..24: mol_type = other DNA
gtgcgactccacgtggagtcgcac

SEQ ID NO: 1824 - DNA, 24 bp, synthetic construct
  misc_feature 1..24: note = Description of Artificial Sequence: Syntheticoligonucleotide
  source 1..24: mol_type = other DNA
gggtgactccacgtggagtcaccc

SEQ ID NO: 1825 - DNA, 24 bp, synthetic construct
  misc_feature 1..24: note = Description of Artificial Sequence: Syntheticoligonucleotide
  source 1..24: mol_type = other DNA
acgggactccacgtggagtcccgt

SEQ ID NO: 1826 - DNA, 24 bp, synthetic construct
  misc_feature 1..24: note = Description of Artificial Sequence: Syntheticoligonucleotide
  source 1..24: mol_type = other DNA
cagggactccacgtggagtccctg

SEQ ID NO: 1827 - DNA, 24 bp, synthetic construct
  misc_feature 1..24: note = Description of Artificial Sequence: Syntheticoligonucleotide
  source 1..24: mol_type = other DNA
ccaggactccacgtggagtcctgg

SEQ ID NO: 1828 - DNA, 24 bp, synthetic construct
  misc_feature 1..24: note = Description of Artificial Sequence: Syntheticoligonucleotide
  source 1..24: mol_type = other DNA
ccgagactccacgtggagtctcgg

SEQ ID NO: 1829 - DNA, 24 bp, synthetic construct
  misc_feature 1..24: note = Description of Artificial Sequence: Syntheticoligonucleotide
  source 1..24: mol_type = other DNA
tcgggactccacgtggagtcccga

SEQ ID NO: 1830 - DNA, 24 bp, synthetic construct
  misc_feature 1..24: note = Description of Artificial Sequence: Syntheticoligonucleotide
  source 1..24: mol_type = other DNA
ctgggactccacgtggagtcccag

SEQ ID NO: 1831 - DNA, 24 bp, synthetic construct
  misc_feature 1..24: note = Description of Artificial Sequence: Syntheticoligonucleotide
  source 1..24: mol_type = other DNA
cctggactccacgtggagtccagg

SEQ ID NO: 1832 - DNA, 24 bp, synthetic construct
  misc_feature 1..24: note = Description of Artificial Sequence: Syntheticoligonucleotide
  source 1..24: mol_type = other DNA
ccgtgactccacgtggagtcacgg

SEQ ID NO: 1833 - DNA, 24 bp, synthetic construct
  misc_feature 1..24: note = Description of Artificial Sequence: Syntheticoligonucleotide
  source 1..24: mol_type = other DNA
cggcgactccacgtggagtcgccg

SEQ ID NO: 1834 - DNA, 24 bp, synthetic construct
  misc_feature 1..24: note = Description of Artificial Sequence: Syntheticoligonucleotide
  source 1..24: mol_type = other DNA
cagcgactccacgtggagtcgctg

SEQ ID NO: 1835 - DNA, 24 bp, synthetic construct
  misc_feature 1..24: note = Description of Artificial Sequence: Syntheticoligonucleotide
  source 1..24: mol_type = other DNA
cgacgactccacgtggagtcgtcg

SEQ ID NO: 1836 - DNA, 24 bp, synthetic construct
  misc_feature 1..24: note = Description of Artificial Sequence: Syntheticoligonucleotide
  source 1..24: mol_type = other DNA
cggagactccacgtggagtctccg

SEQ ID NO: 1837 - DNA, 24 bp, synthetic construct
  misc_feature 1..24: note = Description of Artificial Sequence: Syntheticoligonucleotide
  source 1..24: mol_type = other DNA
ctgcgactccacgtggagtcgcag

SEQ ID NO: 1838 - DNA, 24 bp, synthetic construct
  misc_feature 1..24: note = Description of Artificial Sequence: Syntheticoligonucleotide
  source 1..24: mol_type = other DNA
cggtgactccacgtggagtcaccg

SEQ ID NO: 1839 - DNA, 24 bp, synthetic construct
  misc_feature 1..24: note = Description of Artificial Sequence: Syntheticoligonucleotide
  source 1..24: mol_type = other DNA
cacggactccacgtggagtccgtg

SEQ ID NO: 1840 - DNA, 24 bp, synthetic construct
  misc_feature 1..24: note = Description of Artificial Sequence: Syntheticoligonucleotide
  source 1..24: mol_type = other DNA
cccagactccacgtggagtctggg

SEQ ID NO: 1841 - DNA, 24 bp, synthetic construct
  misc_feature 1..24: note = Description of Artificial Sequence: Syntheticoligonucleotide
  source 1..24: mol_type = other DNA
ctcggactccacgtggagtccgag

SEQ ID NO: 1842 - DNA, 24 bp, synthetic construct
  misc_feature 1..24: note = Description of Artificial Sequence: Syntheticoligonucleotide
  source 1..24: mol_type = other DNA
ccctgactccacgtggagtcaggg

SEQ ID NO: 1843 - DNA, 24 bp, synthetic construct
  misc_feature 1..24: note = Description of Artificial Sequence: Syntheticoligonucleotide
  source 1..24: mol_type = other DNA
ccacgactccacgtggagtcgtgg

SEQ ID NO: 1844 - DNA, 24 bp, synthetic construct
  misc_feature 1..24: note = Description of Artificial Sequence: Syntheticoligonucleotide
  source 1..24: mol_type = other DNA
agccgactccacgtggagtcggct

SEQ ID NO: 1845 - DNA, 24 bp, synthetic construct
  misc_feature 1..24: note = Description of Artificial Sequence: Syntheticoligonucleotide
  source 1..24: mol_type = other DNA
tgccgactccacgtggagtcggca

SEQ ID NO: 1846 - DNA, 24 bp, synthetic construct
  misc_feature 1..24: note = Description of Artificial Sequence: Syntheticoligonucleotide
  source 1..24: mol_type = other DNA
gcgagactccacgtggagtctcgc

SEQ ID NO: 1847 - DNA, 24 bp, synthetic construct
  misc_feature 1..24: note = Description of Artificial Sequence: Syntheticoligonucleotide
  source 1..24: mol_type = other DNA
gcgtgactccacgtggagtcacgc

SEQ ID NO: 1848 - DNA, 24 bp, synthetic construct
  misc_feature 1..24: note = Description of Artificial Sequence: Syntheticoligonucleotide
  source 1..24: mol_type = other DNA
gcaggactccacgtggagtcctgc

SEQ ID NO: 1849 - DNA, 24 bp, synthetic construct
  misc_feature 1..24: note = Description of Artificial Sequence: Syntheticoligonucleotide
  source 1..24: mol_type = other DNA
gctggactccacgtggagtccagc

SEQ ID NO: 1850 - DNA, 24 bp, synthetic construct
  misc_feature 1..24: note = Description of Artificial Sequence: Syntheticoligonucleotide
  source 1..24: mol_type = other DNA
cgaggactccacgtggagtcctcg

SEQ ID NO: 1851 - DNA, 24 bp, synthetic construct
  misc_feature 1..24: note = Description of Artificial Sequence: Syntheticoligonucleotide
  source 1..24: mol_type = other DNA
cgtggactccacgtggagtccacg

SEQ ID NO: 1852 - DNA, 24 bp, synthetic construct
  misc_feature 1..24: note = Description of Artificial Sequence: Syntheticoligonucleotide
  source 1..24: mol_type = other DNA
caccgactccacgtggagtcggtg

SEQ ID NO: 1853 - DNA, 24 bp, synthetic construct
  misc_feature 1..24: note = Description of Artificial Sequence: Syntheticoligonucleotide
  source 1..24: mol_type = other DNA
ctccgactccacgtggagtcggag

SEQ ID NO: 1854 - DNA, 24 bp, synthetic construct
  misc_feature 1..24: note = Description of Artificial Sequence: Syntheticoligonucleotide
  source 1..24: mol_type = other DNA
gcgggactccacgtggagtcccgc

SEQ ID NO: 1855 - DNA, 24 bp, synthetic construct
  misc_feature 1..24: note = Description of Artificial Sequence: Syntheticoligonucleotide
  source 1..24: mol_type = other DNA
gagggactccacgtggagtccctc

SEQ ID NO: 1856 - DNA, 24 bp, synthetic construct
  misc_feature 1..24: note = Description of Artificial Sequence: Syntheticoligonucleotide
  source 1..24: mol_type = other DNA
gtgggactccacgtggagtcccac

SEQ ID NO: 1857 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactctcatgagagtcnnnn

SEQ ID NO: 1858 - DNA, 24 bp, synthetic construct
  misc_feature 1..24: note = Description of Artificial Sequence: Syntheticoligonucleotide
  source 1..24: mol_type = other DNA
ggcggactctcatgagagtccgcc

SEQ ID NO: 1859 - DNA, 24 bp, synthetic construct
  misc_feature 1..24: note = Description of Artificial Sequence: Syntheticoligonucleotide
  source 1..24: mol_type = other DNA
agcggactctcatgagagtccgct

SEQ ID NO: 1860 - DNA, 24 bp, synthetic construct
  misc_feature 1..24: note = Description of Artificial Sequence: Syntheticoligonucleotide
  source 1..24: mol_type = other DNA
gacggactctcatgagagtccgtc

SEQ ID NO: 1861 - DNA, 24 bp, synthetic construct
  misc_feature 1..24: note = Description of Artificial Sequence: Syntheticoligonucleotide
  source 1..24: mol_type = other DNA
ggaggactctcatgagagtcctcc

SEQ ID NO: 1862 - DNA, 24 bp, synthetic construct
  misc_feature 1..24: note = Description of Artificial Sequence: Syntheticoligonucleotide
  source 1..24: mol_type = other DNA
ggcagactctcatgagagtctgcc

SEQ ID NO: 1863 - DNA, 24 bp, synthetic construct
  misc_feature 1..24: note = Description of Artificial Sequence: Syntheticoligonucleotide
  source 1..24: mol_type = other DNA
tgcggactctcatgagagtccgca

SEQ ID NO: 1864 - DNA, 24 bp, synthetic construct
  misc_feature 1..24: note = Description of Artificial Sequence: Syntheticoligonucleotide
  source 1..24: mol_type = other DNA
gtcggactctcatgagagtccgac

SEQ ID NO: 1865 - DNA, 24 bp, synthetic construct
  misc_feature 1..24: note = Description of Artificial Sequence: Syntheticoligonucleotide
  source 1..24: mol_type = other DNA
ggtggactctcatgagagtccacc

SEQ ID NO: 1866 - DNA, 24 bp, synthetic construct
  misc_feature 1..24: note = Description of Artificial Sequence: Syntheticoligonucleotide
  source 1..24: mol_type = other DNA
ggctgactctcatgagagtcagcc

SEQ ID NO: 1867 - DNA, 24 bp, synthetic construct
  misc_feature 1..24: note = Description of Artificial Sequence: Syntheticoligonucleotide
  source 1..24: mol_type = other DNA
gcccgactctcatgagagtcgggc

SEQ ID NO: 1868 - DNA, 24 bp, synthetic construct
  misc_feature 1..24: note = Description of Artificial Sequence: Syntheticoligonucleotide
  source 1..24: mol_type = other DNA
acccgactctcatgagagtcgggt

SEQ ID NO: 1869 - DNA, 24 bp, synthetic construct
  misc_feature 1..24: note = Description of Artificial Sequence: Syntheticoligonucleotide
  source 1..24: mol_type = other DNA
gaccgactctcatgagagtcggtc

SEQ ID NO: 1870 - DNA, 24 bp, synthetic construct
  misc_feature 1..24: note = Description of Artificial Sequence: Syntheticoligonucleotide
  source 1..24: mol_type = other DNA
gcacgactctcatgagagtcgtgc

SEQ ID NO: 1871 - DNA, 24 bp, synthetic construct
  misc_feature 1..24: note = Description of Artificial Sequence: Syntheticoligonucleotide
  source 1..24: mol_type = other DNA
gccagactctcatgagagtctggc

SEQ ID NO: 1872 - DNA, 24 bp, synthetic construct
  misc_feature 1..24: note = Description of Artificial Sequence: Syntheticoligonucleotide
  source 1..24: mol_type = other DNA
tcccgactctcatgagagtcggga

SEQ ID NO: 1873 - DNA, 24 bp, synthetic construct
  misc_feature 1..24: note = Description of Artificial Sequence: Syntheticoligonucleotide
  source 1..24: mol_type = other DNA
gtccgactctcatgagagtcggac

SEQ ID NO: 1874 - DNA, 24 bp, synthetic construct
  misc_feature 1..24: note = Description of Artificial Sequence: Syntheticoligonucleotide
  source 1..24: mol_type = other DNA
gcctgactctcatgagagtcaggc

SEQ ID NO: 1875 - DNA, 24 bp, synthetic construct
  misc_feature 1..24: note = Description of Artificial Sequence: Syntheticoligonucleotide
  source 1..24: mol_type = other DNA
gggcgactctcatgagagtcgccc

SEQ ID NO: 1876 - DNA, 24 bp, synthetic construct
  misc_feature 1..24: note = Description of Artificial Sequence: Syntheticoligonucleotide
  source 1..24: mol_type = other DNA
aggcgactctcatgagagtcgcct

SEQ ID NO: 1877 - DNA, 24 bp, synthetic construct
  misc_feature 1..24: note = Description of Artificial Sequence: Syntheticoligonucleotide
  source 1..24: mol_type = other DNA
gagcgactctcatgagagtcgctc

SEQ ID NO: 1878 - DNA, 24 bp, synthetic construct
  misc_feature 1..24: note = Description of Artificial Sequence: Syntheticoligonucleotide
  source 1..24: mol_type = other DNA
ggacgactctcatgagagtcgtcc

SEQ ID NO: 1879 - DNA, 24 bp, synthetic construct
  misc_feature 1..24: note = Description of Artificial Sequence: Syntheticoligonucleotide
  source 1..24: mol_type = other DNA
gggagactctcatgagagtctccc

SEQ ID NO: 1880 - DNA, 24 bp, synthetic construct
  misc_feature 1..24: note = Description of Artificial Sequence: Syntheticoligonucleotide
  source 1..24: mol_type = other DNA
tggcgactctcatgagagtcgcca

SEQ ID NO: 1881 - DNA, 24 bp, synthetic construct
  misc_feature 1..24: note = Description of Artificial Sequence: Syntheticoligonucleotide
  source 1..24: mol_type = other DNA
gtgcgactctcatgagagtcgcac

SEQ ID NO: 1882 - DNA, 24 bp, synthetic construct
  misc_feature 1..24: note = Description of Artificial Sequence: Syntheticoligonucleotide
  source 1..24: mol_type = other DNA
gggtgactctcatgagagtcaccc

SEQ ID NO: 1883 - DNA, 24 bp, synthetic construct
  misc_feature 1..24: note = Description of Artificial Sequence: Syntheticoligonucleotide
  source 1..24: mol_type = other DNA
acgggactctcatgagagtcccgt

SEQ ID NO: 1884 - DNA, 24 bp, synthetic construct
  misc_feature 1..24: note = Description of Artificial Sequence: Syntheticoligonucleotide
  source 1..24: mol_type = other DNA
cagggactctcatgagagtccctg

SEQ ID NO: 1885 - DNA, 24 bp, synthetic construct
  misc_feature 1..24: note = Description of Artificial Sequence: Syntheticoligonucleotide
  source 1..24: mol_type = other DNA
ccaggactctcatgagagtcctgg

SEQ ID NO: 1886 - DNA, 24 bp, synthetic construct
  misc_feature 1..24: note = Description of Artificial Sequence: Syntheticoligonucleotide
  source 1..24: mol_type = other DNA
ccgagactctcatgagagtctcgg

SEQ ID NO: 1887 - DNA, 24 bp, synthetic construct
  misc_feature 1..24: note = Description of Artificial Sequence: Syntheticoligonucleotide
  source 1..24: mol_type = other DNA
tcgggactctcatgagagtcccga

SEQ ID NO: 1888 - DNA, 24 bp, synthetic construct
  misc_feature 1..24: note = Description of Artificial Sequence: Syntheticoligonucleotide
  source 1..24: mol_type = other DNA
ctgggactctcatgagagtcccag

SEQ ID NO: 1889 - DNA, 24 bp, synthetic construct
  misc_feature 1..24: note = Description of Artificial Sequence: Syntheticoligonucleotide
  source 1..24: mol_type = other DNA
cctggactctcatgagagtccagg

SEQ ID NO: 1890 - DNA, 24 bp, synthetic construct
  misc_feature 1..24: note = Description of Artificial Sequence: Syntheticoligonucleotide
  source 1..24: mol_type = other DNA
ccgtgactctcatgagagtcacgg

SEQ ID NO: 1891 - DNA, 24 bp, synthetic construct
  misc_feature 1..24: note = Description of Artificial Sequence: Syntheticoligonucleotide
  source 1..24: mol_type = other DNA
cggcgactctcatgagagtcgccg

SEQ ID NO: 1892 - DNA, 24 bp, synthetic construct
  misc_feature 1..24: note = Description of Artificial Sequence: Syntheticoligonucleotide
  source 1..24: mol_type = other DNA
cagcgactctcatgagagtcgctg

SEQ ID NO: 1893 - DNA, 24 bp, synthetic construct
  misc_feature 1..24: note = Description of Artificial Sequence: Syntheticoligonucleotide
  source 1..24: mol_type = other DNA
cgacgactctcatgagagtcgtcg

SEQ ID NO: 1894 - DNA, 24 bp, synthetic construct
  misc_feature 1..24: note = Description of Artificial Sequence: Syntheticoligonucleotide
  source 1..24: mol_type = other DNA
cggagactctcatgagagtctccg

SEQ ID NO: 1895 - DNA, 24 bp, synthetic construct
  misc_feature 1..24: note = Description of Artificial Sequence: Syntheticoligonucleotide
  source 1..24: mol_type = other DNA
ctgcgactctcatgagagtcgcag

SEQ ID NO: 1896 - DNA, 24 bp, synthetic construct
  misc_feature 1..24: note = Description of Artificial Sequence: Syntheticoligonucleotide
  source 1..24: mol_type = other DNA
cggtgactctcatgagagtcaccg

SEQ ID NO: 1897 - DNA, 24 bp, synthetic construct
  misc_feature 1..24: note = Description of Artificial Sequence: Syntheticoligonucleotide
  source 1..24: mol_type = other DNA
cacggactctcatgagagtccgtg

SEQ ID NO: 1898 - DNA, 24 bp, synthetic construct
  misc_feature 1..24: note = Description of Artificial Sequence: Syntheticoligonucleotide
  source 1..24: mol_type = other DNA
cccagactctcatgagagtctggg

SEQ ID NO: 1899 - DNA, 24 bp, synthetic construct
  misc_feature 1..24: note = Description of Artificial Sequence: Syntheticoligonucleotide
  source 1..24: mol_type = other DNA
ctcggactctcatgagagtccgag

SEQ ID NO: 1900 - DNA, 24 bp, synthetic construct
  misc_feature 1..24: note = Description of Artificial Sequence: Syntheticoligonucleotide
  source 1..24: mol_type = other DNA
ccctgactctcatgagagtcaggg

SEQ ID NO: 1901 - DNA, 24 bp, synthetic construct
  misc_feature 1..24: note = Description of Artificial Sequence: Syntheticoligonucleotide
  source 1..24: mol_type = other DNA
ccacgactctcatgagagtcgtgg

SEQ ID NO: 1902 - DNA, 24 bp, synthetic construct
  misc_feature 1..24: note = Description of Artificial Sequence: Syntheticoligonucleotide
  source 1..24: mol_type = other DNA
agccgactctcatgagagtcggct

SEQ ID NO: 1903 - DNA, 24 bp, synthetic construct
  misc_feature 1..24: note = Description of Artificial Sequence: Syntheticoligonucleotide
  source 1..24: mol_type = other DNA
tgccgactctcatgagagtcggca

SEQ ID NO: 1904 - DNA, 24 bp, synthetic construct
  misc_feature 1..24: note = Description of Artificial Sequence: Syntheticoligonucleotide
  source 1..24: mol_type = other DNA
gcgagactctcatgagagtctcgc

SEQ ID NO: 1905 - DNA, 24 bp, synthetic construct
  misc_feature 1..24: note = Description of Artificial Sequence: Syntheticoligonucleotide
  source 1..24: mol_type = other DNA
gcgtgactctcatgagagtcacgc

SEQ ID NO: 1906 - DNA, 24 bp, synthetic construct
  misc_feature 1..24: note = Description of Artificial Sequence: Syntheticoligonucleotide
  source 1..24: mol_type = other DNA
gcaggactctcatgagagtcctgc

SEQ ID NO: 1907 - DNA, 24 bp, synthetic construct
  misc_feature 1..24: note = Description of Artificial Sequence: Syntheticoligonucleotide
  source 1..24: mol_type = other DNA
gctggactctcatgagagtccagc

SEQ ID NO: 1908 - DNA, 24 bp, synthetic construct
  misc_feature 1..24: note = Description of Artificial Sequence: Syntheticoligonucleotide
  source 1..24: mol_type = other DNA
cgaggactctcatgagagtcctcg

SEQ ID NO: 1909 - DNA, 24 bp, synthetic construct
  misc_feature 1..24: note = Description of Artificial Sequence: Syntheticoligonucleotide
  source 1..24: mol_type = other DNA
cgtggactctcatgagagtccacg

SEQ ID NO: 1910 - DNA, 24 bp, synthetic construct
  misc_feature 1..24: note = Description of Artificial Sequence: Syntheticoligonucleotide
  source 1..24: mol_type = other DNA
caccgactctcatgagagtcggtg

SEQ ID NO: 1911 - DNA, 24 bp, synthetic construct
  misc_feature 1..24: note = Description of Artificial Sequence: Syntheticoligonucleotide
  source 1..24: mol_type = other DNA
ctccgactctcatgagagtcggag

SEQ ID NO: 1912 - DNA, 24 bp, synthetic construct
  misc_feature 1..24: note = Description of Artificial Sequence: Syntheticoligonucleotide
  source 1..24: mol_type = other DNA
gcgggactctcatgagagtcccgc

SEQ ID NO: 1913 - DNA, 24 bp, synthetic construct
  misc_feature 1..24: note = Description of Artificial Sequence: Syntheticoligonucleotide
  source 1..24: mol_type = other DNA
gagggactctcatgagagtccctc

SEQ ID NO: 1914 - DNA, 24 bp, synthetic construct
  misc_feature 1..24: note = Description of Artificial Sequence: Syntheticoligonucleotide
  source 1..24: mol_type = other DNA
gtgggactctcatgagagtcccac

SEQ ID NO: 1915 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactctctagagagtcnnnn

SEQ ID NO: 1916 - DNA, 24 bp, synthetic construct
  misc_feature 1..24: note = Description of Artificial Sequence: Syntheticoligonucleotide
  source 1..24: mol_type = other DNA
ggcggactctctagagagtccgcc

SEQ ID NO: 1917 - DNA, 24 bp, synthetic construct
  misc_feature 1..24: note = Description of Artificial Sequence: Syntheticoligonucleotide
  source 1..24: mol_type = other DNA
agcggactctctagagagtccgct

SEQ ID NO: 1918 - DNA, 24 bp, synthetic construct
  misc_feature 1..24: note = Description of Artificial Sequence: Syntheticoligonucleotide
  source 1..24: mol_type = other DNA
gacggactctctagagagtccgtc

SEQ ID NO: 1919 - DNA, 24 bp, synthetic construct
  misc_feature 1..24: note = Description of Artificial Sequence: Syntheticoligonucleotide
  source 1..24: mol_type = other DNA
ggaggactctctagagagtcctcc

SEQ ID NO: 1920 - DNA, 24 bp, synthetic construct
  misc_feature 1..24: note = Description of Artificial Sequence: Syntheticoligonucleotide
  source 1..24: mol_type = other DNA
ggcagactctctagagagtctgcc

SEQ ID NO: 1921 - DNA, 24 bp, synthetic construct
  misc_feature 1..24: note = Description of Artificial Sequence: Syntheticoligonucleotide
  source 1..24: mol_type = other DNA
tgcggactctctagagagtccgca

SEQ ID NO: 1922 - DNA, 24 bp, synthetic construct
  misc_feature 1..24: note = Description of Artificial Sequence: Syntheticoligonucleotide
  source 1..24: mol_type = other DNA
gtcggactctctagagagtccgac

SEQ ID NO: 1923 - DNA, 24 bp, synthetic construct
  misc_feature 1..24: note = Description of Artificial Sequence: Syntheticoligonucleotide
  source 1..24: mol_type = other DNA
ggtggactctctagagagtccacc

SEQ ID NO: 1924 - DNA, 24 bp, synthetic construct
  misc_feature 1..24: note = Description of Artificial Sequence: Syntheticoligonucleotide
  source 1..24: mol_type = other DNA
ggctgactctctagagagtcagcc

SEQ ID NO: 1925 - DNA, 24 bp, synthetic construct
  misc_feature 1..24: note = Description of Artificial Sequence: Syntheticoligonucleotide
  source 1..24: mol_type = other DNA
gcccgactctctagagagtcgggc

SEQ ID NO: 1926 - DNA, 24 bp, synthetic construct
  misc_feature 1..24: note = Description of Artificial Sequence: Syntheticoligonucleotide
  source 1..24: mol_type = other DNA
acccgactctctagagagtcgggt

SEQ ID NO: 1927 - DNA, 24 bp, synthetic construct
  misc_feature 1..24: note = Description of Artificial Sequence: Syntheticoligonucleotide
  source 1..24: mol_type = other DNA
gaccgactctctagagagtcggtc

SEQ ID NO: 1928 - DNA, 24 bp, synthetic construct
  misc_feature 1..24: note = Description of Artificial Sequence: Syntheticoligonucleotide
  source 1..24: mol_type = other DNA
gcacgactctctagagagtcgtgc

SEQ ID NO: 1929 - DNA, 24 bp, synthetic construct
  misc_feature 1..24: note = Description of Artificial Sequence: Syntheticoligonucleotide
  source 1..24: mol_type = other DNA
gccagactctctagagagtctggc

SEQ ID NO: 1930 - DNA, 24 bp, synthetic construct
  misc_feature 1..24: note = Description of Artificial Sequence: Syntheticoligonucleotide
  source 1..24: mol_type = other DNA
tcccgactctctagagagtcggga

SEQ ID NO: 1931 - DNA, 24 bp, synthetic construct
  misc_feature 1..24: note = Description of Artificial Sequence: Syntheticoligonucleotide
  source 1..24: mol_type = other DNA
gtccgactctctagagagtcggac

SEQ ID NO: 1932 - DNA, 24 bp, synthetic construct
  misc_feature 1..24: note = Description of Artificial Sequence: Syntheticoligonucleotide
  source 1..24: mol_type = other DNA
gcctgactctctagagagtcaggc

SEQ ID NO: 1933 - DNA, 24 bp, synthetic construct
  misc_feature 1..24: note = Description of Artificial Sequence: Syntheticoligonucleotide
  source 1..24: mol_type = other DNA
gggcgactctctagagagtcgccc

SEQ ID NO: 1934 - DNA, 24 bp, synthetic construct
  misc_feature 1..24: note = Description of Artificial Sequence: Syntheticoligonucleotide
  source 1..24: mol_type = other DNA
aggcgactctctagagagtcgcct

SEQ ID NO: 1935 - DNA, 24 bp, synthetic construct
  misc_feature 1..24: note = Description of Artificial Sequence: Syntheticoligonucleotide
  source 1..24: mol_type = other DNA
gagcgactctctagagagtcgctc

SEQ ID NO: 1936 - DNA, 24 bp, synthetic construct
  misc_feature 1..24: note = Description of Artificial Sequence: Syntheticoligonucleotide
  source 1..24: mol_type = other DNA
ggacgactctctagagagtcgtcc

SEQ ID NO: 1937 - DNA, 24 bp, synthetic construct
  misc_feature 1..24: note = Description of Artificial Sequence: Syntheticoligonucleotide
  source 1..24: mol_type = other DNA
gggagactctctagagagtctccc

SEQ ID NO: 1938 - DNA, 24 bp, synthetic construct
  misc_feature 1..24: note = Description of Artificial Sequence: Syntheticoligonucleotide
  source 1..24: mol_type = other DNA
tggcgactctctagagagtcgcca

SEQ ID NO: 1939 - DNA, 24 bp, synthetic construct
  misc_feature 1..24: note = Description of Artificial Sequence: Syntheticoligonucleotide
  source 1..24: mol_type = other DNA
gtgcgactctctagagagtcgcac

SEQ ID NO: 1940 - DNA, 24 bp, synthetic construct
  misc_feature 1..24: note = Description of Artificial Sequence: Syntheticoligonucleotide
  source 1..24: mol_type = other DNA
gggtgactctctagagagtcaccc

SEQ ID NO: 1941 - DNA, 24 bp, synthetic construct
  misc_feature 1..24: note = Description of Artificial Sequence: Syntheticoligonucleotide
  source 1..24: mol_type = other DNA
acgggactctctagagagtcccgt

SEQ ID NO: 1942 - DNA, 24 bp, synthetic construct
  misc_feature 1..24: note = Description of Artificial Sequence: Syntheticoligonucleotide
  source 1..24: mol_type = other DNA
cagggactctctagagagtccctg

SEQ ID NO: 1943 - DNA, 24 bp, synthetic construct
  misc_feature 1..24: note = Description of Artificial Sequence: Syntheticoligonucleotide
  source 1..24: mol_type = other DNA
ccaggactctctagagagtcctgg

SEQ ID NO: 1944 - DNA, 24 bp, synthetic construct
  misc_feature 1..24: note = Description of Artificial Sequence: Syntheticoligonucleotide
  source 1..24: mol_type = other DNA
ccgagactctctagagagtctcgg

SEQ ID NO: 1945 - DNA, 24 bp, synthetic construct
  misc_feature 1..24: note = Description of Artificial Sequence: Syntheticoligonucleotide
  source 1..24: mol_type = other DNA
tcgggactctctagagagtcccga

SEQ ID NO: 1946 - DNA, 24 bp, synthetic construct
  misc_feature 1..24: note = Description of Artificial Sequence: Syntheticoligonucleotide
  source 1..24: mol_type = other DNA
ctgggactctctagagagtcccag

SEQ ID NO: 1947 - DNA, 24 bp, synthetic construct
  misc_feature 1..24: note = Description of Artificial Sequence: Syntheticoligonucleotide
  source 1..24: mol_type = other DNA
cctggactctctagagagtccagg

SEQ ID NO: 1948 - DNA, 24 bp, synthetic construct
  misc_feature 1..24: note = Description of Artificial Sequence: Syntheticoligonucleotide
  source 1..24: mol_type = other DNA
ccgtgactctctagagagtcacgg

SEQ ID NO: 1949 - DNA, 24 bp, synthetic construct
  misc_feature 1..24: note = Description of Artificial Sequence: Syntheticoligonucleotide
  source 1..24: mol_type = other DNA
cggcgactctctagagagtcgccg

SEQ ID NO: 1950 - DNA, 24 bp, synthetic construct
  misc_feature 1..24: note = Description of Artificial Sequence: Syntheticoligonucleotide
  source 1..24: mol_type = other DNA
cagcgactctctagagagtcgctg

SEQ ID NO: 1951 - DNA, 24 bp, synthetic construct
  misc_feature 1..24: note = Description of Artificial Sequence: Syntheticoligonucleotide
  source 1..24: mol_type = other DNA
cgacgactctctagagagtcgtcg

SEQ ID NO: 1952 - DNA, 24 bp, synthetic construct
  misc_feature 1..24: note = Description of Artificial Sequence: Syntheticoligonucleotide
  source 1..24: mol_type = other DNA
cggagactctctagagagtctccg

SEQ ID NO: 1953 - DNA, 24 bp, synthetic construct
  misc_feature 1..24: note = Description of Artificial Sequence: Syntheticoligonucleotide
  source 1..24: mol_type = other DNA
ctgcgactctctagagagtcgcag

SEQ ID NO: 1954 - DNA, 24 bp, synthetic construct
  misc_feature 1..24: note = Description of Artificial Sequence: Syntheticoligonucleotide
  source 1..24: mol_type = other DNA
cggtgactctctagagagtcaccg

SEQ ID NO: 1955 - DNA, 24 bp, synthetic construct
  misc_feature 1..24: note = Description of Artificial Sequence: Syntheticoligonucleotide
  source 1..24: mol_type = other DNA
cacggactctctagagagtccgtg

SEQ ID NO: 1956 - DNA, 24 bp, synthetic construct
  misc_feature 1..24: note = Description of Artificial Sequence: Syntheticoligonucleotide
  source 1..24: mol_type = other DNA
cccagactctctagagagtctggg

SEQ ID NO: 1957 - DNA, 24 bp, synthetic construct
  misc_feature 1..24: note = Description of Artificial Sequence: Syntheticoligonucleotide
  source 1..24: mol_type = other DNA
ctcggactctctagagagtccgag

SEQ ID NO: 1958 - DNA, 24 bp, synthetic construct
  misc_feature 1..24: note = Description of Artificial Sequence: Syntheticoligonucleotide
  source 1..24: mol_type = other DNA
ccctgactctctagagagtcaggg

SEQ ID NO: 1959 - DNA, 24 bp, synthetic construct
  misc_feature 1..24: note = Description of Artificial Sequence: Syntheticoligonucleotide
  source 1..24: mol_type = other DNA
ccacgactctctagagagtcgtgg

SEQ ID NO: 1960 - DNA, 24 bp, synthetic construct
  misc_feature 1..24: note = Description of Artificial Sequence: Syntheticoligonucleotide
  source 1..24: mol_type = other DNA
agccgactctctagagagtcggct

SEQ ID NO: 1961 - DNA, 24 bp, synthetic construct
  misc_feature 1..24: note = Description of Artificial Sequence: Syntheticoligonucleotide
  source 1..24: mol_type = other DNA
tgccgactctctagagagtcggca

SEQ ID NO: 1962 - DNA, 24 bp, synthetic construct
  misc_feature 1..24: note = Description of Artificial Sequence: Syntheticoligonucleotide
  source 1..24: mol_type = other DNA
gcgagactctctagagagtctcgc

SEQ ID NO: 1963 - DNA, 24 bp, synthetic construct
  misc_feature 1..24: note = Description of Artificial Sequence: Syntheticoligonucleotide
  source 1..24: mol_type = other DNA
gcgtgactctctagagagtcacgc

SEQ ID NO: 1964 - DNA, 24 bp, synthetic construct
  misc_feature 1..24: note = Description of Artificial Sequence: Syntheticoligonucleotide
  source 1..24: mol_type = other DNA
gcaggactctctagagagtcctgc

SEQ ID NO: 1965 - DNA, 24 bp, synthetic construct
  misc_feature 1..24: note = Description of Artificial Sequence: Syntheticoligonucleotide
  source 1..24: mol_type = other DNA
gctggactctctagagagtccagc

SEQ ID NO: 1966 - DNA, 24 bp, synthetic construct
  misc_feature 1..24: note = Description of Artificial Sequence: Syntheticoligonucleotide
  source 1..24: mol_type = other DNA
cgaggactctctagagagtcctcg

SEQ ID NO: 1967 - DNA, 24 bp, synthetic construct
  misc_feature 1..24: note = Description of Artificial Sequence: Syntheticoligonucleotide
  source 1..24: mol_type = other DNA
cgtggactctctagagagtccacg

SEQ ID NO: 1968 - DNA, 24 bp, synthetic construct
  misc_feature 1..24: note = Description of Artificial Sequence: Syntheticoligonucleotide
  source 1..24: mol_type = other DNA
caccgactctctagagagtcggtg

SEQ ID NO: 1969 - DNA, 24 bp, synthetic construct
  misc_feature 1..24: note = Description of Artificial Sequence: Syntheticoligonucleotide
  source 1..24: mol_type = other DNA
ctccgactctctagagagtcggag

SEQ ID NO: 1970 - DNA, 24 bp, synthetic construct
  misc_feature 1..24: note = Description of Artificial Sequence: Syntheticoligonucleotide
  source 1..24: mol_type = other DNA
gcgggactctctagagagtcccgc

SEQ ID NO: 1971 - DNA, 24 bp, synthetic construct
  misc_feature 1..24: note = Description of Artificial Sequence: Syntheticoligonucleotide
  source 1..24: mol_type = other DNA
gagggactctctagagagtccctc

SEQ ID NO: 1972 - DNA, 24 bp, synthetic construct
  misc_feature 1..24: note = Description of Artificial Sequence: Syntheticoligonucleotide
  source 1..24: mol_type = other DNA
gtgggactctctagagagtcccac

SEQ ID NO: 1973 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactctcgcgagagtcnnnn

SEQ ID NO: 1974 - DNA, 24 bp, synthetic construct
  misc_feature 1..24: note = Description of Artificial Sequence: Syntheticoligonucleotide
  source 1..24: mol_type = other DNA
ggcggactctcgcgagagtccgcc

SEQ ID NO: 1975 - DNA, 24 bp, synthetic construct
  misc_feature 1..24: note = Description of Artificial Sequence: Syntheticoligonucleotide
  source 1..24: mol_type = other DNA
agcggactctcgcgagagtccgct

SEQ ID NO: 1976 - DNA, 24 bp, synthetic construct
  misc_feature 1..24: note = Description of Artificial Sequence: Syntheticoligonucleotide
  source 1..24: mol_type = other DNA
gacggactctcgcgagagtccgtc

SEQ ID NO: 1977 - DNA, 24 bp, synthetic construct
  misc_feature 1..24: note = Description of Artificial Sequence: Syntheticoligonucleotide
  source 1..24: mol_type = other DNA
ggaggactctcgcgagagtcctcc

SEQ ID NO: 1978 - DNA, 24 bp, synthetic construct
  misc_feature 1..24: note = Description of Artificial Sequence: Syntheticoligonucleotide
  source 1..24: mol_type = other DNA
ggcagactctcgcgagagtctgcc

SEQ ID NO: 1979 - DNA, 24 bp, synthetic construct
  misc_feature 1..24: note = Description of Artificial Sequence: Syntheticoligonucleotide
  source 1..24: mol_type = other DNA
tgcggactctcgcgagagtccgca

SEQ ID NO: 1980 - DNA, 24 bp, synthetic construct
  misc_feature 1..24: note = Description of Artificial Sequence: Syntheticoligonucleotide
  source 1..24: mol_type = other DNA
gtcggactctcgcgagagtccgac

SEQ ID NO: 1981 - DNA, 24 bp, synthetic construct
  misc_feature 1..24: note = Description of Artificial Sequence: Syntheticoligonucleotide
  source 1..24: mol_type = other DNA
ggtggactctcgcgagagtccacc

SEQ ID NO: 1982 - DNA, 24 bp, synthetic construct
  misc_feature 1..24: note = Description of Artificial Sequence: Syntheticoligonucleotide
  source 1..24: mol_type = other DNA
ggctgactctcgcgagagtcagcc

SEQ ID NO: 1983 - DNA, 24 bp, synthetic construct
  misc_feature 1..24: note = Description of Artificial Sequence: Syntheticoligonucleotide
  source 1..24: mol_type = other DNA
gcccgactctcgcgagagtcgggc

SEQ ID NO: 1984 - DNA, 24 bp, synthetic construct
  misc_feature 1..24: note = Description of Artificial Sequence: Syntheticoligonucleotide
  source 1..24: mol_type = other DNA
acccgactctcgcgagagtcgggt

SEQ ID NO: 1985 - DNA, 24 bp, synthetic construct
  misc_feature 1..24: note = Description of Artificial Sequence: Syntheticoligonucleotide
  source 1..24: mol_type = other DNA
gaccgactctcgcgagagtcggtc

SEQ ID NO: 1986 - DNA, 24 bp, synthetic construct
  misc_feature 1..24: note = Description of Artificial Sequence: Syntheticoligonucleotide
  source 1..24: mol_type = other DNA
gcacgactctcgcgagagtcgtgc

SEQ ID NO: 1987 - DNA, 24 bp, synthetic construct
  misc_feature 1..24: note = Description of Artificial Sequence: Syntheticoligonucleotide
  source 1..24: mol_type = other DNA
gccagactctcgcgagagtctggc

SEQ ID NO: 1988 - DNA, 24 bp, synthetic construct
  misc_feature 1..24: note = Description of Artificial Sequence: Syntheticoligonucleotide
  source 1..24: mol_type = other DNA
tcccgactctcgcgagagtcggga

SEQ ID NO: 1989 - DNA, 24 bp, synthetic construct
  misc_feature 1..24: note = Description of Artificial Sequence: Syntheticoligonucleotide
  source 1..24: mol_type = other DNA
gtccgactctcgcgagagtcggac

SEQ ID NO: 1990 - DNA, 24 bp, synthetic construct
  misc_feature 1..24: note = Description of Artificial Sequence: Syntheticoligonucleotide
  source 1..24: mol_type = other DNA
gcctgactctcgcgagagtcaggc

SEQ ID NO: 1991 - DNA, 24 bp, synthetic construct
  misc_feature 1..24: note = Description of Artificial Sequence: Syntheticoligonucleotide
  source 1..24: mol_type = other DNA
gggcgactctcgcgagagtcgccc

SEQ ID NO: 1992 - DNA, 24 bp, synthetic construct
  misc_feature 1..24: note = Description of Artificial Sequence: Syntheticoligonucleotide
  source 1..24: mol_type = other DNA
aggcgactctcgcgagagtcgcct

SEQ ID NO: 1993 - DNA, 24 bp, synthetic construct
  misc_feature 1..24: note = Description of Artificial Sequence: Syntheticoligonucleotide
  source 1..24: mol_type = other DNA
gagcgactctcgcgagagtcgctc

SEQ ID NO: 1994 - DNA, 24 bp, synthetic construct
  misc_feature 1..24: note = Description of Artificial Sequence: Syntheticoligonucleotide
  source 1..24: mol_type = other DNA
ggacgactctcgcgagagtcgtcc

SEQ ID NO: 1995 - DNA, 24 bp, synthetic construct
  misc_feature 1..24: note = Description of Artificial Sequence: Syntheticoligonucleotide
  source 1..24: mol_type = other DNA
gggagactctcgcgagagtctccc

SEQ ID NO: 1996 - DNA, 24 bp, synthetic construct
  misc_feature 1..24: note = Description of Artificial Sequence: Syntheticoligonucleotide
  source 1..24: mol_type = other DNA
tggcgactctcgcgagagtcgcca

SEQ ID NO: 1997 - DNA, 24 bp, synthetic construct
  misc_feature 1..24: note = Description of Artificial Sequence: Syntheticoligonucleotide
  source 1..24: mol_type = other DNA
gtgcgactctcgcgagagtcgcac

SEQ ID NO: 1998 - DNA, 24 bp, synthetic construct
  misc_feature 1..24: note = Description of Artificial Sequence: Syntheticoligonucleotide
  source 1..24: mol_type = other DNA
gggtgactctcgcgagagtcaccc

SEQ ID NO: 1999 - DNA, 24 bp, synthetic construct
  misc_feature 1..24: note = Description of Artificial Sequence: Syntheticoligonucleotide
  source 1..24: mol_type = other DNA
acgggactctcgcgagagtcccgt

SEQ ID NO: 2000 - DNA, 24 bp, synthetic construct
  misc_feature 1..24: note = Description of Artificial Sequence: Syntheticoligonucleotide
  source 1..24: mol_type = other DNA
cagggactctcgcgagagtccctg

SEQ ID NO: 2001 - DNA, 24 bp, synthetic construct
  misc_feature 1..24: note = Description of Artificial Sequence: Syntheticoligonucleotide
  source 1..24: mol_type = other DNA
ccaggactctcgcgagagtcctgg

SEQ ID NO: 2002 - DNA, 24 bp, synthetic construct
  misc_feature 1..24: note = Description of Artificial Sequence: Syntheticoligonucleotide
  source 1..24: mol_type = other DNA
ccgagactctcgcgagagtctcgg

SEQ ID NO: 2003 - DNA, 24 bp, synthetic construct
  misc_feature 1..24: note = Description of Artificial Sequence: Syntheticoligonucleotide
  source 1..24: mol_type = other DNA
tcgggactctcgcgagagtcccga

SEQ ID NO: 2004 - DNA, 24 bp, synthetic construct
  misc_feature 1..24: note = Description of Artificial Sequence: Syntheticoligonucleotide
  source 1..24: mol_type = other DNA
ctgggactctcgcgagagtcccag

SEQ ID NO: 2005 - DNA, 24 bp, synthetic construct
  misc_feature 1..24: note = Description of Artificial Sequence: Syntheticoligonucleotide
  source 1..24: mol_type = other DNA
cctggactctcgcgagagtccagg

SEQ ID NO: 2006 - DNA, 24 bp, synthetic construct
  misc_feature 1..24: note = Description of Artificial Sequence: Syntheticoligonucleotide
  source 1..24: mol_type = other DNA
ccgtgactctcgcgagagtcacgg

SEQ ID NO: 2007 - DNA, 24 bp, synthetic construct
  misc_feature 1..24: note = Description of Artificial Sequence: Syntheticoligonucleotide
  source 1..24: mol_type = other DNA
cggcgactctcgcgagagtcgccg

SEQ ID NO: 2008 - DNA, 24 bp, synthetic construct
  misc_feature 1..24: note = Description of Artificial Sequence: Syntheticoligonucleotide
  source 1..24: mol_type = other DNA
cagcgactctcgcgagagtcgctg

SEQ ID NO: 2009 - DNA, 24 bp, synthetic construct
  misc_feature 1..24: note = Description of Artificial Sequence: Syntheticoligonucleotide
  source 1..24: mol_type = other DNA
cgacgactctcgcgagagtcgtcg

SEQ ID NO: 2010 - DNA, 24 bp, synthetic construct
  misc_feature 1..24: note = Description of Artificial Sequence: Syntheticoligonucleotide
  source 1..24: mol_type = other DNA
cggagactctcgcgagagtctccg

SEQ ID NO: 2011 - DNA, 24 bp, synthetic construct
  misc_feature 1..24: note = Description of Artificial Sequence: Syntheticoligonucleotide
  source 1..24: mol_type = other DNA
ctgcgactctcgcgagagtcgcag

SEQ ID NO: 2012 - DNA, 24 bp, synthetic construct
  misc_feature 1..24: note = Description of Artificial Sequence: Syntheticoligonucleotide
  source 1..24: mol_type = other DNA
cggtgactctcgcgagagtcaccg

SEQ ID NO: 2013 - DNA, 24 bp, synthetic construct
  misc_feature 1..24: note = Description of Artificial Sequence: Syntheticoligonucleotide
  source 1..24: mol_type = other DNA
cacggactctcgcgagagtccgtg

SEQ ID NO: 2014 - DNA, 24 bp, synthetic construct
  misc_feature 1..24: note = Description of Artificial Sequence: Syntheticoligonucleotide
  source 1..24: mol_type = other DNA
cccagactctcgcgagagtctggg

SEQ ID NO: 2015 - DNA, 24 bp, synthetic construct
  misc_feature 1..24: note = Description of Artificial Sequence: Syntheticoligonucleotide
  source 1..24: mol_type = other DNA
ctcggactctcgcgagagtccgag

SEQ ID NO: 2016 - DNA, 24 bp, synthetic construct
  misc_feature 1..24: note = Description of Artificial Sequence: Syntheticoligonucleotide
  source 1..24: mol_type = other DNA
ccctgactctcgcgagagtcaggg

SEQ ID NO: 2017 - DNA, 24 bp, synthetic construct
  misc_feature 1..24: note = Description of Artificial Sequence: Syntheticoligonucleotide
  source 1..24: mol_type = other DNA
ccacgactctcgcgagagtcgtgg

SEQ ID NO: 2018 - DNA, 24 bp, synthetic construct
  misc_feature 1..24: note = Description of Artificial Sequence: Syntheticoligonucleotide
  source 1..24: mol_type = other DNA
agccgactctcgcgagagtcggct

SEQ ID NO: 2019 - DNA, 24 bp, synthetic construct
  misc_feature 1..24: note = Description of Artificial Sequence: Syntheticoligonucleotide
  source 1..24: mol_type = other DNA
tgccgactctcgcgagagtcggca

SEQ ID NO: 2020 - DNA, 24 bp, synthetic construct
  misc_feature 1..24: note = Description of Artificial Sequence: Syntheticoligonucleotide
  source 1..24: mol_type = other DNA
gcgagactctcgcgagagtctcgc

SEQ ID NO: 2021 - DNA, 24 bp, synthetic construct
  misc_feature 1..24: note = Description of Artificial Sequence: Syntheticoligonucleotide
  source 1..24: mol_type = other DNA
gcgtgactctcgcgagagtcacgc

SEQ ID NO: 2022 - DNA, 24 bp, synthetic construct
  misc_feature 1..24: note = Description of Artificial Sequence: Syntheticoligonucleotide
  source 1..24: mol_type = other DNA
gcaggactctcgcgagagtcctgc

SEQ ID NO: 2023 - DNA, 24 bp, synthetic construct
  misc_feature 1..24: note = Description of Artificial Sequence: Syntheticoligonucleotide
  source 1..24: mol_type = other DNA
gctggactctcgcgagagtccagc

SEQ ID NO: 2024 - DNA, 24 bp, synthetic construct
  misc_feature 1..24: note = Description of Artificial Sequence: Syntheticoligonucleotide
  source 1..24: mol_type = other DNA
cgaggactctcgcgagagtcctcg

SEQ ID NO: 2025 - DNA, 24 bp, synthetic construct
  misc_feature 1..24: note = Description of Artificial Sequence: Syntheticoligonucleotide
  source 1..24: mol_type = other DNA
cgtggactctcgcgagagtccacg

SEQ ID NO: 2026 - DNA, 24 bp, synthetic construct
  misc_feature 1..24: note = Description of Artificial Sequence: Syntheticoligonucleotide
  source 1..24: mol_type = other DNA
caccgactctcgcgagagtcggtg

SEQ ID NO: 2027 - DNA, 24 bp, synthetic construct
  misc_feature 1..24: note = Description of Artificial Sequence: Syntheticoligonucleotide
  source 1..24: mol_type = other DNA
ctccgactctcgcgagagtcggag

SEQ ID NO: 2028 - DNA, 24 bp, synthetic construct
  misc_feature 1..24: note = Description of Artificial Sequence: Syntheticoligonucleotide
  source 1..24: mol_type = other DNA
gcgggactctcgcgagagtcccgc

SEQ ID NO: 2029 - DNA, 24 bp, synthetic construct
  misc_feature 1..24: note = Description of Artificial Sequence: Syntheticoligonucleotide
  source 1..24: mol_type = other DNA
gagggactctcgcgagagtccctc

SEQ ID NO: 2030 - DNA, 24 bp, synthetic construct
  misc_feature 1..24: note = Description of Artificial Sequence: Syntheticoligonucleotide
  source 1..24: mol_type = other DNA
gtgggactctcgcgagagtcccac

SEQ ID NO: 2031 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactctccggagagtcnnnn

SEQ ID NO: 2032 - DNA, 24 bp, synthetic construct
  misc_feature 1..24: note = Description of Artificial Sequence: Syntheticoligonucleotide
  source 1..24: mol_type = other DNA
ggcggactctccggagagtccgcc

SEQ ID NO: 2033 - DNA, 24 bp, synthetic construct
  misc_feature 1..24: note = Description of Artificial Sequence: Syntheticoligonucleotide
  source 1..24: mol_type = other DNA
agcggactctccggagagtccgct

SEQ ID NO: 2034 - DNA, 24 bp, synthetic construct
  misc_feature 1..24: note = Description of Artificial Sequence: Syntheticoligonucleotide
  source 1..24: mol_type = other DNA
gacggactctccggagagtccgtc

SEQ ID NO: 2035 - DNA, 24 bp, synthetic construct
  misc_feature 1..24: note = Description of Artificial Sequence: Syntheticoligonucleotide
  source 1..24: mol_type = other DNA
ggaggactctccggagagtcctcc

SEQ ID NO: 2036 - DNA, 24 bp, synthetic construct
  misc_feature 1..24: note = Description of Artificial Sequence: Syntheticoligonucleotide
  source 1..24: mol_type = other DNA
ggcagactctccggagagtctgcc

SEQ ID NO: 2037 - DNA, 24 bp, synthetic construct
  misc_feature 1..24: note = Description of Artificial Sequence: Syntheticoligonucleotide
  source 1..24: mol_type = other DNA
tgcggactctccggagagtccgca

SEQ ID NO: 2038 - DNA, 24 bp, synthetic construct
  misc_feature 1..24: note = Description of Artificial Sequence: Syntheticoligonucleotide
  source 1..24: mol_type = other DNA
gtcggactctccggagagtccgac

SEQ ID NO: 2039 - DNA, 24 bp, synthetic construct
  misc_feature 1..24: note = Description of Artificial Sequence: Syntheticoligonucleotide
  source 1..24: mol_type = other DNA
ggtggactctccggagagtccacc

SEQ ID NO: 2040 - DNA, 24 bp, synthetic construct
  misc_feature 1..24: note = Description of Artificial Sequence: Syntheticoligonucleotide
  source 1..24: mol_type = other DNA
ggctgactctccggagagtcagcc

SEQ ID NO: 2041 - DNA, 24 bp, synthetic construct
  misc_feature 1..24: note = Description of Artificial Sequence: Syntheticoligonucleotide
  source 1..24: mol_type = other DNA
gcccgactctccggagagtcgggc

SEQ ID NO: 2042 - DNA, 24 bp, synthetic construct
  misc_feature 1..24: note = Description of Artificial Sequence: Syntheticoligonucleotide
  source 1..24: mol_type = other DNA
acccgactctccggagagtcgggt

SEQ ID NO: 2043 - DNA, 24 bp, synthetic construct
  misc_feature 1..24: note = Description of Artificial Sequence: Syntheticoligonucleotide
  source 1..24: mol_type = other DNA
gaccgactctccggagagtcggtc

SEQ ID NO: 2044 - DNA, 24 bp, synthetic construct
  misc_feature 1..24: note = Description of Artificial Sequence: Syntheticoligonucleotide
  source 1..24: mol_type = other DNA
gcacgactctccggagagtcgtgc

SEQ ID NO: 2045 - DNA, 24 bp, synthetic construct
  misc_feature 1..24: note = Description of Artificial Sequence: Syntheticoligonucleotide
  source 1..24: mol_type = other DNA
gccagactctccggagagtctggc

SEQ ID NO: 2046 - DNA, 24 bp, synthetic construct
  misc_feature 1..24: note = Description of Artificial Sequence: Syntheticoligonucleotide
  source 1..24: mol_type = other DNA
tcccgactctccggagagtcggga

SEQ ID NO: 2047 - DNA, 24 bp, synthetic construct
  misc_feature 1..24: note = Description of Artificial Sequence: Syntheticoligonucleotide
  source 1..24: mol_type = other DNA
gtccgactctccggagagtcggac

SEQ ID NO: 2048 - DNA, 24 bp, synthetic construct
  misc_feature 1..24: note = Description of Artificial Sequence: Syntheticoligonucleotide
  source 1..24: mol_type = other DNA
gcctgactctccggagagtcaggc

SEQ ID NO: 2049 - DNA, 24 bp, synthetic construct
  misc_feature 1..24: note = Description of Artificial Sequence: Syntheticoligonucleotide
  source 1..24: mol_type = other DNA
gggcgactctccggagagtcgccc

SEQ ID NO: 2050 - DNA, 24 bp, synthetic construct
  misc_feature 1..24: note = Description of Artificial Sequence: Syntheticoligonucleotide
  source 1..24: mol_type = other DNA
aggcgactctccggagagtcgcct

SEQ ID NO: 2051 - DNA, 24 bp, synthetic construct
  misc_feature 1..24: note = Description of Artificial Sequence: Syntheticoligonucleotide
  source 1..24: mol_type = other DNA
gagcgactctccggagagtcgctc

SEQ ID NO: 2052 - DNA, 24 bp, synthetic construct
  misc_feature 1..24: note = Description of Artificial Sequence: Syntheticoligonucleotide
  source 1..24: mol_type = other DNA
ggacgactctccggagagtcgtcc

SEQ ID NO: 2053 - DNA, 24 bp, synthetic construct
  misc_feature 1..24: note = Description of Artificial Sequence: Syntheticoligonucleotide
  source 1..24: mol_type = other DNA
gggagactctccggagagtctccc

SEQ ID NO: 2054 - DNA, 24 bp, synthetic construct
  misc_feature 1..24: note = Description of Artificial Sequence: Syntheticoligonucleotide
  source 1..24: mol_type = other DNA
tggcgactctccggagagtcgcca

SEQ ID NO: 2055 - DNA, 24 bp, synthetic construct
  misc_feature 1..24: note = Description of Artificial Sequence: Syntheticoligonucleotide
  source 1..24: mol_type = other DNA
gtgcgactctccggagagtcgcac

SEQ ID NO: 2056 - DNA, 24 bp, synthetic construct
  misc_feature 1..24: note = Description of Artificial Sequence: Syntheticoligonucleotide
  source 1..24: mol_type = other DNA
gggtgactctccggagagtcaccc

SEQ ID NO: 2057 - DNA, 24 bp, synthetic construct
  misc_feature 1..24: note = Description of Artificial Sequence: Syntheticoligonucleotide
  source 1..24: mol_type = other DNA
acgggactctccggagagtcccgt

SEQ ID NO: 2058 - DNA, 24 bp, synthetic construct
  misc_feature 1..24: note = Description of Artificial Sequence: Syntheticoligonucleotide
  source 1..24: mol_type = other DNA
cagggactctccggagagtccctg

SEQ ID NO: 2059 - DNA, 24 bp, synthetic construct
  misc_feature 1..24: note = Description of Artificial Sequence: Syntheticoligonucleotide
  source 1..24: mol_type = other DNA
ccaggactctccggagagtcctgg

SEQ ID NO: 2060 - DNA, 24 bp, synthetic construct
  misc_feature 1..24: note = Description of Artificial Sequence: Syntheticoligonucleotide
  source 1..24: mol_type = other DNA
ccgagactctccggagagtctcgg

SEQ ID NO: 2061 - DNA, 24 bp, synthetic construct
  misc_feature 1..24: note = Description of Artificial Sequence: Syntheticoligonucleotide
  source 1..24: mol_type = other DNA
tcgggactctccggagagtcccga

SEQ ID NO: 2062 - DNA, 24 bp, synthetic construct
  misc_feature 1..24: note = Description of Artificial Sequence: Syntheticoligonucleotide
  source 1..24: mol_type = other DNA
ctgggactctccggagagtcccag

SEQ ID NO: 2063 - DNA, 24 bp, synthetic construct
  misc_feature 1..24: note = Description of Artificial Sequence: Syntheticoligonucleotide
  source 1..24: mol_type = other DNA
cctggactctccggagagtccagg

SEQ ID NO: 2064 - DNA, 24 bp, synthetic construct
  misc_feature 1..24: note = Description of Artificial Sequence: Syntheticoligonucleotide
  source 1..24: mol_type = other DNA
ccgtgactctccggagagtcacgg

SEQ ID NO: 2065 - DNA, 24 bp, synthetic construct
  misc_feature 1..24: note = Description of Artificial Sequence: Syntheticoligonucleotide
  source 1..24: mol_type = other DNA
cggcgactctccggagagtcgccg

SEQ ID NO: 2066 - DNA, 24 bp, synthetic construct
  misc_feature 1..24: note = Description of Artificial Sequence: Syntheticoligonucleotide
  source 1..24: mol_type = other DNA
cagcgactctccggagagtcgctg

SEQ ID NO: 2067 - DNA, 24 bp, synthetic construct
  misc_feature 1..24: note = Description of Artificial Sequence: Syntheticoligonucleotide
  source 1..24: mol_type = other DNA
cgacgactctccggagagtcgtcg

SEQ ID NO: 2068 - DNA, 24 bp, synthetic construct
  misc_feature 1..24: note = Description of Artificial Sequence: Syntheticoligonucleotide
  source 1..24: mol_type = other DNA
cggagactctccggagagtctccg

SEQ ID NO: 2069 - DNA, 24 bp, synthetic construct
  misc_feature 1..24: note = Description of Artificial Sequence: Syntheticoligonucleotide
  source 1..24: mol_type = other DNA
ctgcgactctccggagagtcgcag

SEQ ID NO: 2070 - DNA, 24 bp, synthetic construct
  misc_feature 1..24: note = Description of Artificial Sequence: Syntheticoligonucleotide
  source 1..24: mol_type = other DNA
cggtgactctccggagagtcaccg

SEQ ID NO: 2071 - DNA, 24 bp, synthetic construct
  misc_feature 1..24: note = Description of Artificial Sequence: Syntheticoligonucleotide
  source 1..24: mol_type = other DNA
cacggactctccggagagtccgtg

SEQ ID NO: 2072 - DNA, 24 bp, synthetic construct
  misc_feature 1..24: note = Description of Artificial Sequence: Syntheticoligonucleotide
  source 1..24: mol_type = other DNA
cccagactctccggagagtctggg

SEQ ID NO: 2073 - DNA, 24 bp, synthetic construct
  misc_feature 1..24: note = Description of Artificial Sequence: Syntheticoligonucleotide
  source 1..24: mol_type = other DNA
ctcggactctccggagagtccgag

SEQ ID NO: 2074 - DNA, 24 bp, synthetic construct
  misc_feature 1..24: note = Description of Artificial Sequence: Syntheticoligonucleotide
  source 1..24: mol_type = other DNA
ccctgactctccggagagtcaggg

SEQ ID NO: 2075 - DNA, 24 bp, synthetic construct
  misc_feature 1..24: note = Description of Artificial Sequence: Syntheticoligonucleotide
  source 1..24: mol_type = other DNA
ccacgactctccggagagtcgtgg

SEQ ID NO: 2076 - DNA, 24 bp, synthetic construct
  misc_feature 1..24: note = Description of Artificial Sequence: Syntheticoligonucleotide
  source 1..24: mol_type = other DNA
agccgactctccggagagtcggct

SEQ ID NO: 2077 - DNA, 24 bp, synthetic construct
  misc_feature 1..24: note = Description of Artificial Sequence: Syntheticoligonucleotide
  source 1..24: mol_type = other DNA
tgccgactctccggagagtcggca

SEQ ID NO: 2078 - DNA, 24 bp, synthetic construct
  misc_feature 1..24: note = Description of Artificial Sequence: Syntheticoligonucleotide
  source 1..24: mol_type = other DNA
gcgagactctccggagagtctcgc

SEQ ID NO: 2079 - DNA, 24 bp, synthetic construct
  misc_feature 1..24: note = Description of Artificial Sequence: Syntheticoligonucleotide
  source 1..24: mol_type = other DNA
gcgtgactctccggagagtcacgc

SEQ ID NO: 2080 - DNA, 24 bp, synthetic construct
  misc_feature 1..24: note = Description of Artificial Sequence: Syntheticoligonucleotide
  source 1..24: mol_type = other DNA
gcaggactctccggagagtcctgc

SEQ ID NO: 2081 - DNA, 24 bp, synthetic construct
  misc_feature 1..24: note = Description of Artificial Sequence: Syntheticoligonucleotide
  source 1..24: mol_type = other DNA
gctggactctccggagagtccagc

SEQ ID NO: 2082 - DNA, 24 bp, synthetic construct
  misc_feature 1..24: note = Description of Artificial Sequence: Syntheticoligonucleotide
  source 1..24: mol_type = other DNA
cgaggactctccggagagtcctcg

SEQ ID NO: 2083 - DNA, 24 bp, synthetic construct
  misc_feature 1..24: note = Description of Artificial Sequence: Syntheticoligonucleotide
  source 1..24: mol_type = other DNA
cgtggactctccggagagtccacg

SEQ ID NO: 2084 - DNA, 24 bp, synthetic construct
  misc_feature 1..24: note = Description of Artificial Sequence: Syntheticoligonucleotide
  source 1..24: mol_type = other DNA
caccgactctccggagagtcggtg

SEQ ID NO: 2085 - DNA, 24 bp, synthetic construct
  misc_feature 1..24: note = Description of Artificial Sequence: Syntheticoligonucleotide
  source 1..24: mol_type = other DNA
ctccgactctccggagagtcggag

SEQ ID NO: 2086 - DNA, 24 bp, synthetic construct
  misc_feature 1..24: note = Description of Artificial Sequence: Syntheticoligonucleotide
  source 1..24: mol_type = other DNA
gcgggactctccggagagtcccgc

SEQ ID NO: 2087 - DNA, 24 bp, synthetic construct
  misc_feature 1..24: note = Description of Artificial Sequence: Syntheticoligonucleotide
  source 1..24: mol_type = other DNA
gagggactctccggagagtccctc

SEQ ID NO: 2088 - DNA, 24 bp, synthetic construct
  misc_feature 1..24: note = Description of Artificial Sequence: Syntheticoligonucleotide
  source 1..24: mol_type = other DNA
gtgggactctccggagagtcccac

SEQ ID NO: 2089 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcagatctgagtcnnnn

SEQ ID NO: 2090 - DNA, 24 bp, synthetic construct
  misc_feature 1..24: note = Description of Artificial Sequence: Syntheticoligonucleotide
  source 1..24: mol_type = other DNA
ggcggactcagatctgagtccgcc

SEQ ID NO: 2091 - DNA, 24 bp, synthetic construct
  misc_feature 1..24: note = Description of Artificial Sequence: Syntheticoligonucleotide
  source 1..24: mol_type = other DNA
agcggactcagatctgagtccgct

SEQ ID NO: 2092 - DNA, 24 bp, synthetic construct
  misc_feature 1..24: note = Description of Artificial Sequence: Syntheticoligonucleotide
  source 1..24: mol_type = other DNA
gacggactcagatctgagtccgtc

SEQ ID NO: 2093 - DNA, 24 bp, synthetic construct
  misc_feature 1..24: note = Description of Artificial Sequence: Syntheticoligonucleotide
  source 1..24: mol_type = other DNA
ggaggactcagatctgagtcctcc

SEQ ID NO: 2094 - DNA, 24 bp, synthetic construct
  misc_feature 1..24: note = Description of Artificial Sequence: Syntheticoligonucleotide
  source 1..24: mol_type = other DNA
ggcagactcagatctgagtctgcc

SEQ ID NO: 2095 - DNA, 24 bp, synthetic construct
  misc_feature 1..24: note = Description of Artificial Sequence: Syntheticoligonucleotide
  source 1..24: mol_type = other DNA
tgcggactcagatctgagtccgca

SEQ ID NO: 2096 - DNA, 24 bp, synthetic construct
  misc_feature 1..24: note = Description of Artificial Sequence: Syntheticoligonucleotide
  source 1..24: mol_type = other DNA
gtcggactcagatctgagtccgac

SEQ ID NO: 2097 - DNA, 24 bp, synthetic construct
  misc_feature 1..24: note = Description of Artificial Sequence: Syntheticoligonucleotide
  source 1..24: mol_type = other DNA
ggtggactcagatctgagtccacc

SEQ ID NO: 2098 - DNA, 24 bp, synthetic construct
  misc_feature 1..24: note = Description of Artificial Sequence: Syntheticoligonucleotide
  source 1..24: mol_type = other DNA
ggctgactcagatctgagtcagcc

SEQ ID NO: 2099 - DNA, 24 bp, synthetic construct
  misc_feature 1..24: note = Description of Artificial Sequence: Syntheticoligonucleotide
  source 1..24: mol_type = other DNA
gcccgactcagatctgagtcgggc

SEQ ID NO: 2100 - DNA, 24 bp, synthetic construct
  misc_feature 1..24: note = Description of Artificial Sequence: Syntheticoligonucleotide
  source 1..24: mol_type = other DNA
acccgactcagatctgagtcgggt

SEQ ID NO: 2101 - DNA, 24 bp, synthetic construct
  misc_feature 1..24: note = Description of Artificial Sequence: Syntheticoligonucleotide
  source 1..24: mol_type = other DNA
gaccgactcagatctgagtcggtc

SEQ ID NO: 2102 - DNA, 24 bp, synthetic construct
  misc_feature 1..24: note = Description of Artificial Sequence: Syntheticoligonucleotide
  source 1..24: mol_type = other DNA
gcacgactcagatctgagtcgtgc

SEQ ID NO: 2103 - DNA, 24 bp, synthetic construct
  misc_feature 1..24: note = Description of Artificial Sequence: Syntheticoligonucleotide
  source 1..24: mol_type = other DNA
gccagactcagatctgagtctggc

SEQ ID NO: 2104 - DNA, 24 bp, synthetic construct
  misc_feature 1..24: note = Description of Artificial Sequence: Syntheticoligonucleotide
  source 1..24: mol_type = other DNA
tcccgactcagatctgagtcggga

SEQ ID NO: 2105 - DNA, 24 bp, synthetic construct
  misc_feature 1..24: note = Description of Artificial Sequence: Syntheticoligonucleotide
  source 1..24: mol_type = other DNA
gtccgactcagatctgagtcggac

SEQ ID NO: 2106 - DNA, 24 bp, synthetic construct
  misc_feature 1..24: note = Description of Artificial Sequence: Syntheticoligonucleotide
  source 1..24: mol_type = other DNA
gcctgactcagatctgagtcaggc

SEQ ID NO: 2107 - DNA, 24 bp, synthetic construct
  misc_feature 1..24: note = Description of Artificial Sequence: Syntheticoligonucleotide
  source 1..24: mol_type = other DNA
gggcgactcagatctgagtcgccc

SEQ ID NO: 2108 - DNA, 24 bp, synthetic construct
  misc_feature 1..24: note = Description of Artificial Sequence: Syntheticoligonucleotide
  source 1..24: mol_type = other DNA
aggcgactcagatctgagtcgcct

SEQ ID NO: 2109 - DNA, 24 bp, synthetic construct
  misc_feature 1..24: note = Description of Artificial Sequence: Syntheticoligonucleotide
  source 1..24: mol_type = other DNA
gagcgactcagatctgagtcgctc

SEQ ID NO: 2110 - DNA, 24 bp, synthetic construct
  misc_feature 1..24: note = Description of Artificial Sequence: Syntheticoligonucleotide
  source 1..24: mol_type = other DNA
ggacgactcagatctgagtcgtcc

SEQ ID NO: 2111 - DNA, 24 bp, synthetic construct
  misc_feature 1..24: note = Description of Artificial Sequence: Syntheticoligonucleotide
  source 1..24: mol_type = other DNA
gggagactcagatctgagtctccc

SEQ ID NO: 2112 - DNA, 24 bp, synthetic construct
  misc_feature 1..24: note = Description of Artificial Sequence: Syntheticoligonucleotide
  source 1..24: mol_type = other DNA
tggcgactcagatctgagtcgcca

SEQ ID NO: 2113 - DNA, 24 bp, synthetic construct
  misc_feature 1..24: note = Description of Artificial Sequence: Syntheticoligonucleotide
  source 1..24: mol_type = other DNA
gtgcgactcagatctgagtcgcac

SEQ ID NO: 2114 - DNA, 24 bp, synthetic construct
  misc_feature 1..24: note = Description of Artificial Sequence: Syntheticoligonucleotide
  source 1..24: mol_type = other DNA
gggtgactcagatctgagtcaccc

SEQ ID NO: 2115 - DNA, 24 bp, synthetic construct
  misc_feature 1..24: note = Description of Artificial Sequence: Syntheticoligonucleotide
  source 1..24: mol_type = other DNA
acgggactcagatctgagtcccgt

SEQ ID NO: 2116 - DNA, 24 bp, synthetic construct
  misc_feature 1..24: note = Description of Artificial Sequence: Syntheticoligonucleotide
  source 1..24: mol_type = other DNA
cagggactcagatctgagtccctg

SEQ ID NO: 2117 - DNA, 24 bp, synthetic construct
  misc_feature 1..24: note = Description of Artificial Sequence: Syntheticoligonucleotide
  source 1..24: mol_type = other DNA
ccaggactcagatctgagtcctgg

SEQ ID NO: 2118 - DNA, 24 bp, synthetic construct
  misc_feature 1..24: note = Description of Artificial Sequence: Syntheticoligonucleotide
  source 1..24: mol_type = other DNA
ccgagactcagatctgagtctcgg

SEQ ID NO: 2119 - DNA, 24 bp, synthetic construct
  misc_feature 1..24: note = Description of Artificial Sequence: Syntheticoligonucleotide
  source 1..24: mol_type = other DNA
tcgggactcagatctgagtcccga

SEQ ID NO: 2120 - DNA, 24 bp, synthetic construct
  misc_feature 1..24: note = Description of Artificial Sequence: Syntheticoligonucleotide
  source 1..24: mol_type = other DNA
ctgggactcagatctgagtcccag

SEQ ID NO: 2121 - DNA, 24 bp, synthetic construct
  misc_feature 1..24: note = Description of Artificial Sequence: Syntheticoligonucleotide
  source 1..24: mol_type = other DNA
cctggactcagatctgagtccagg

SEQ ID NO: 2122 - DNA, 24 bp, synthetic construct
  misc_feature 1..24: note = Description of Artificial Sequence: Syntheticoligonucleotide
  source 1..24: mol_type = other DNA
ccgtgactcagatctgagtcacgg

SEQ ID NO: 2123 - DNA, 24 bp, synthetic construct
  misc_feature 1..24: note = Description of Artificial Sequence: Syntheticoligonucleotide
  source 1..24: mol_type = other DNA
cggcgactcagatctgagtcgccg

SEQ ID NO: 2124 - DNA, 24 bp, synthetic construct
  misc_feature 1..24: note = Description of Artificial Sequence: Syntheticoligonucleotide
  source 1..24: mol_type = other DNA
cagcgactcagatctgagtcgctg

SEQ ID NO: 2125 - DNA, 24 bp, synthetic construct
  misc_feature 1..24: note = Description of Artificial Sequence: Syntheticoligonucleotide
  source 1..24: mol_type = other DNA
cgacgactcagatctgagtcgtcg

SEQ ID NO: 2126 - DNA, 24 bp, synthetic construct
  misc_feature 1..24: note = Description of Artificial Sequence: Syntheticoligonucleotide
  source 1..24: mol_type = other DNA
cggagactcagatctgagtctccg

SEQ ID NO: 2127 - DNA, 24 bp, synthetic construct
  misc_feature 1..24: note = Description of Artificial Sequence: Syntheticoligonucleotide
  source 1..24: mol_type = other DNA
ctgcgactcagatctgagtcgcag

SEQ ID NO: 2128 - DNA, 24 bp, synthetic construct
  misc_feature 1..24: note = Description of Artificial Sequence: Syntheticoligonucleotide
  source 1..24: mol_type = other DNA
cggtgactcagatctgagtcaccg

SEQ ID NO: 2129 - DNA, 24 bp, synthetic construct
  misc_feature 1..24: note = Description of Artificial Sequence: Syntheticoligonucleotide
  source 1..24: mol_type = other DNA
cacggactcagatctgagtccgtg

SEQ ID NO: 2130 - DNA, 24 bp, synthetic construct
  misc_feature 1..24: note = Description of Artificial Sequence: Syntheticoligonucleotide
  source 1..24: mol_type = other DNA
cccagactcagatctgagtctggg

SEQ ID NO: 2131 - DNA, 24 bp, synthetic construct
  misc_feature 1..24: note = Description of Artificial Sequence: Syntheticoligonucleotide
  source 1..24: mol_type = other DNA
ctcggactcagatctgagtccgag

SEQ ID NO: 2132 - DNA, 24 bp, synthetic construct
  misc_feature 1..24: note = Description of Artificial Sequence: Syntheticoligonucleotide
  source 1..24: mol_type = other DNA
ccctgactcagatctgagtcaggg

SEQ ID NO: 2133 - DNA, 24 bp, synthetic construct
  misc_feature 1..24: note = Description of Artificial Sequence: Syntheticoligonucleotide
  source 1..24: mol_type = other DNA
ccacgactcagatctgagtcgtgg

SEQ ID NO: 2134 - DNA, 24 bp, synthetic construct
  misc_feature 1..24: note = Description of Artificial Sequence: Syntheticoligonucleotide
  source 1..24: mol_type = other DNA
agccgactcagatctgagtcggct

SEQ ID NO: 2135 - DNA, 24 bp, synthetic construct
  misc_feature 1..24: note = Description of Artificial Sequence: Syntheticoligonucleotide
  source 1..24: mol_type = other DNA
tgccgactcagatctgagtcggca

SEQ ID NO: 2136 - DNA, 24 bp, synthetic construct
  misc_feature 1..24: note = Description of Artificial Sequence: Syntheticoligonucleotide
  source 1..24: mol_type = other DNA
gcgagactcagatctgagtctcgc

SEQ ID NO: 2137 - DNA, 24 bp, synthetic construct
  misc_feature 1..24: note = Description of Artificial Sequence: Syntheticoligonucleotide
  source 1..24: mol_type = other DNA
gcgtgactcagatctgagtcacgc

SEQ ID NO: 2138 - DNA, 24 bp, synthetic construct
  misc_feature 1..24: note = Description of Artificial Sequence: Syntheticoligonucleotide
  source 1..24: mol_type = other DNA
gcaggactcagatctgagtcctgc

SEQ ID NO: 2139 - DNA, 24 bp, synthetic construct
  misc_feature 1..24: note = Description of Artificial Sequence: Syntheticoligonucleotide
  source 1..24: mol_type = other DNA
gctggactcagatctgagtccagc

SEQ ID NO: 2140 - DNA, 24 bp, synthetic construct
  misc_feature 1..24: note = Description of Artificial Sequence: Syntheticoligonucleotide
  source 1..24: mol_type = other DNA
cgaggactcagatctgagtcctcg

SEQ ID NO: 2141 - DNA, 24 bp, synthetic construct
  misc_feature 1..24: note = Description of Artificial Sequence: Syntheticoligonucleotide
  source 1..24: mol_type = other DNA
cgtggactcagatctgagtccacg

SEQ ID NO: 2142 - DNA, 24 bp, synthetic construct
  misc_feature 1..24: note = Description of Artificial Sequence: Syntheticoligonucleotide
  source 1..24: mol_type = other DNA
caccgactcagatctgagtcggtg

SEQ ID NO: 2143 - DNA, 24 bp, synthetic construct
  misc_feature 1..24: note = Description of Artificial Sequence: Syntheticoligonucleotide
  source 1..24: mol_type = other DNA
ctccgactcagatctgagtcggag

SEQ ID NO: 2144 - DNA, 24 bp, synthetic construct
  misc_feature 1..24: note = Description of Artificial Sequence: Syntheticoligonucleotide
  source 1..24: mol_type = other DNA
gcgggactcagatctgagtcccgc

SEQ ID NO: 2145 - DNA, 24 bp, synthetic construct
  misc_feature 1..24: note = Description of Artificial Sequence: Syntheticoligonucleotide
  source 1..24: mol_type = other DNA
gagggactcagatctgagtccctc

SEQ ID NO: 2146 - DNA, 24 bp, synthetic construct
  misc_feature 1..24: note = Description of Artificial Sequence: Syntheticoligonucleotide
  source 1..24: mol_type = other DNA
gtgggactcagatctgagtcccac

SEQ ID NO: 2147 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcagtactgagtcnnnn

SEQ ID NO: 2148 - DNA, 24 bp, synthetic construct
  misc_feature 1..24: note = Description of Artificial Sequence: Syntheticoligonucleotide
  source 1..24: mol_type = other DNA
ggcggactcagtactgagtccgcc

SEQ ID NO: 2149 - DNA, 24 bp, synthetic construct
  misc_feature 1..24: note = Description of Artificial Sequence: Syntheticoligonucleotide
  source 1..24: mol_type = other DNA
agcggactcagtactgagtccgct

SEQ ID NO: 2150 - DNA, 24 bp, synthetic construct
  misc_feature 1..24: note = Description of Artificial Sequence: Syntheticoligonucleotide
  source 1..24: mol_type = other DNA
gacggactcagtactgagtccgtc

SEQ ID NO: 2151 - DNA, 24 bp, synthetic construct
  misc_feature 1..24: note = Description of Artificial Sequence: Syntheticoligonucleotide
  source 1..24: mol_type = other DNA
ggaggactcagtactgagtcctcc

SEQ ID NO: 2152 - DNA, 24 bp, synthetic construct
  misc_feature 1..24: note = Description of Artificial Sequence: Syntheticoligonucleotide
  source 1..24: mol_type = other DNA
ggcagactcagtactgagtctgcc

SEQ ID NO: 2153 - DNA, 24 bp, synthetic construct
  misc_feature 1..24: note = Description of Artificial Sequence: Syntheticoligonucleotide
  source 1..24: mol_type = other DNA
tgcggactcagtactgagtccgca

SEQ ID NO: 2154 - DNA, 24 bp, synthetic construct
  misc_feature 1..24: note = Description of Artificial Sequence: Syntheticoligonucleotide
  source 1..24: mol_type = other DNA
gtcggactcagtactgagtccgac

SEQ ID NO: 2155 - DNA, 24 bp, synthetic construct
  misc_feature 1..24: note = Description of Artificial Sequence: Syntheticoligonucleotide
  source 1..24: mol_type = other DNA
ggtggactcagtactgagtccacc

SEQ ID NO: 2156 - DNA, 24 bp, synthetic construct
  misc_feature 1..24: note = Description of Artificial Sequence: Syntheticoligonucleotide
  source 1..24: mol_type = other DNA
ggctgactcagtactgagtcagcc

SEQ ID NO: 2157 - DNA, 24 bp, synthetic construct
  misc_feature 1..24: note = Description of Artificial Sequence: Syntheticoligonucleotide
  source 1..24: mol_type = other DNA
gcccgactcagtactgagtcgggc

SEQ ID NO: 2158 - DNA, 24 bp, synthetic construct
  misc_feature 1..24: note = Description of Artificial Sequence: Syntheticoligonucleotide
  source 1..24: mol_type = other DNA
acccgactcagtactgagtcgggt

SEQ ID NO: 2159 - DNA, 24 bp, synthetic construct
  misc_feature 1..24: note = Description of Artificial Sequence: Syntheticoligonucleotide
  source 1..24: mol_type = other DNA
gaccgactcagtactgagtcggtc

SEQ ID NO: 2160 - DNA, 24 bp, synthetic construct
  misc_feature 1..24: note = Description of Artificial Sequence: Syntheticoligonucleotide
  source 1..24: mol_type = other DNA
gcacgactcagtactgagtcgtgc

SEQ ID NO: 2161 - DNA, 24 bp, synthetic construct
  misc_feature 1..24: note = Description of Artificial Sequence: Syntheticoligonucleotide
  source 1..24: mol_type = other DNA
gccagactcagtactgagtctggc

SEQ ID NO: 2162 - DNA, 24 bp, synthetic construct
  misc_feature 1..24: note = Description of Artificial Sequence: Syntheticoligonucleotide
  source 1..24: mol_type = other DNA
tcccgactcagtactgagtcggga

SEQ ID NO: 2163 - DNA, 24 bp, synthetic construct
  misc_feature 1..24: note = Description of Artificial Sequence: Syntheticoligonucleotide
  source 1..24: mol_type = other DNA
gtccgactcagtactgagtcggac

SEQ ID NO: 2164 - DNA, 24 bp, synthetic construct
  misc_feature 1..24: note = Description of Artificial Sequence: Syntheticoligonucleotide
  source 1..24: mol_type = other DNA
gcctgactcagtactgagtcaggc

SEQ ID NO: 2165 - DNA, 24 bp, synthetic construct
  misc_feature 1..24: note = Description of Artificial Sequence: Syntheticoligonucleotide
  source 1..24: mol_type = other DNA
gggcgactcagtactgagtcgccc

SEQ ID NO: 2166 - DNA, 24 bp, synthetic construct
  misc_feature 1..24: note = Description of Artificial Sequence: Syntheticoligonucleotide
  source 1..24: mol_type = other DNA
aggcgactcagtactgagtcgcct

SEQ ID NO: 2167 - DNA, 24 bp, synthetic construct
  misc_feature 1..24: note = Description of Artificial Sequence: Syntheticoligonucleotide
  source 1..24: mol_type = other DNA
gagcgactcagtactgagtcgctc

SEQ ID NO: 2168 - DNA, 24 bp, synthetic construct
  misc_feature 1..24: note = Description of Artificial Sequence: Syntheticoligonucleotide
  source 1..24: mol_type = other DNA
ggacgactcagtactgagtcgtcc

SEQ ID NO: 2169 - DNA, 24 bp, synthetic construct
  misc_feature 1..24: note = Description of Artificial Sequence: Syntheticoligonucleotide
  source 1..24: mol_type = other DNA
gggagactcagtactgagtctccc

SEQ ID NO: 2170 - DNA, 24 bp, synthetic construct
  misc_feature 1..24: note = Description of Artificial Sequence: Syntheticoligonucleotide
  source 1..24: mol_type = other DNA
tggcgactcagtactgagtcgcca

SEQ ID NO: 2171 - DNA, 24 bp, synthetic construct
  misc_feature 1..24: note = Description of Artificial Sequence: Syntheticoligonucleotide
  source 1..24: mol_type = other DNA
gtgcgactcagtactgagtcgcac

SEQ ID NO: 2172 - DNA, 24 bp, synthetic construct
  misc_feature 1..24: note = Description of Artificial Sequence: Syntheticoligonucleotide
  source 1..24: mol_type = other DNA
gggtgactcagtactgagtcaccc

SEQ ID NO: 2173 - DNA, 24 bp, synthetic construct
  misc_feature 1..24: note = Description of Artificial Sequence: Syntheticoligonucleotide
  source 1..24: mol_type = other DNA
acgggactcagtactgagtcccgt

SEQ ID NO: 2174 - DNA, 24 bp, synthetic construct
  misc_feature 1..24: note = Description of Artificial Sequence: Syntheticoligonucleotide
  source 1..24: mol_type = other DNA
cagggactcagtactgagtccctg

SEQ ID NO: 2175 - DNA, 24 bp, synthetic construct
  misc_feature 1..24: note = Description of Artificial Sequence: Syntheticoligonucleotide
  source 1..24: mol_type = other DNA
ccaggactcagtactgagtcctgg

SEQ ID NO: 2176 - DNA, 24 bp, synthetic construct
  misc_feature 1..24: note = Description of Artificial Sequence: Syntheticoligonucleotide
  source 1..24: mol_type = other DNA
ccgagactcagtactgagtctcgg

SEQ ID NO: 2177 - DNA, 24 bp, synthetic construct
  misc_feature 1..24: note = Description of Artificial Sequence: Syntheticoligonucleotide
  source 1..24: mol_type = other DNA
tcgggactcagtactgagtcccga

SEQ ID NO: 2178 - DNA, 24 bp, synthetic construct
  misc_feature 1..24: note = Description of Artificial Sequence: Syntheticoligonucleotide
  source 1..24: mol_type = other DNA
ctgggactcagtactgagtcccag

SEQ ID NO: 2179 - DNA, 24 bp, synthetic construct
  misc_feature 1..24: note = Description of Artificial Sequence: Syntheticoligonucleotide
  source 1..24: mol_type = other DNA
cctggactcagtactgagtccagg

SEQ ID NO: 2180 - DNA, 24 bp, synthetic construct
  misc_feature 1..24: note = Description of Artificial Sequence: Syntheticoligonucleotide
  source 1..24: mol_type = other DNA
ccgtgactcagtactgagtcacgg

SEQ ID NO: 2181 - DNA, 24 bp, synthetic construct
  misc_feature 1..24: note = Description of Artificial Sequence: Syntheticoligonucleotide
  source 1..24: mol_type = other DNA
cggcgactcagtactgagtcgccg

SEQ ID NO: 2182 - DNA, 24 bp, synthetic construct
  misc_feature 1..24: note = Description of Artificial Sequence: Syntheticoligonucleotide
  source 1..24: mol_type = other DNA
cagcgactcagtactgagtcgctg

SEQ ID NO: 2183 - DNA, 24 bp, synthetic construct
  misc_feature 1..24: note = Description of Artificial Sequence: Syntheticoligonucleotide
  source 1..24: mol_type = other DNA
cgacgactcagtactgagtcgtcg

SEQ ID NO: 2184 - DNA, 24 bp, synthetic construct
  misc_feature 1..24: note = Description of Artificial Sequence: Syntheticoligonucleotide
  source 1..24: mol_type = other DNA
cggagactcagtactgagtctccg

SEQ ID NO: 2185 - DNA, 24 bp, synthetic construct
  misc_feature 1..24: note = Description of Artificial Sequence: Syntheticoligonucleotide
  source 1..24: mol_type = other DNA
ctgcgactcagtactgagtcgcag

SEQ ID NO: 2186 - DNA, 24 bp, synthetic construct
  misc_feature 1..24: note = Description of Artificial Sequence: Syntheticoligonucleotide
  source 1..24: mol_type = other DNA
cggtgactcagtactgagtcaccg

SEQ ID NO: 2187 - DNA, 24 bp, synthetic construct
  misc_feature 1..24: note = Description of Artificial Sequence: Syntheticoligonucleotide
  source 1..24: mol_type = other DNA
cacggactcagtactgagtccgtg

SEQ ID NO: 2188 - DNA, 24 bp, synthetic construct
  misc_feature 1..24: note = Description of Artificial Sequence: Syntheticoligonucleotide
  source 1..24: mol_type = other DNA
cccagactcagtactgagtctggg

SEQ ID NO: 2189 - DNA, 24 bp, synthetic construct
  misc_feature 1..24: note = Description of Artificial Sequence: Syntheticoligonucleotide
  source 1..24: mol_type = other DNA
ctcggactcagtactgagtccgag

SEQ ID NO: 2190 - DNA, 24 bp, synthetic construct
  misc_feature 1..24: note = Description of Artificial Sequence: Syntheticoligonucleotide
  source 1..24: mol_type = other DNA
ccctgactcagtactgagtcaggg

SEQ ID NO: 2191 - DNA, 24 bp, synthetic construct
  misc_feature 1..24: note = Description of Artificial Sequence: Syntheticoligonucleotide
  source 1..24: mol_type = other DNA
ccacgactcagtactgagtcgtgg

SEQ ID NO: 2192 - DNA, 24 bp, synthetic construct
  misc_feature 1..24: note = Description of Artificial Sequence: Syntheticoligonucleotide
  source 1..24: mol_type = other DNA
agccgactcagtactgagtcggct

SEQ ID NO: 2193 - DNA, 24 bp, synthetic construct
  misc_feature 1..24: note = Description of Artificial Sequence: Syntheticoligonucleotide
  source 1..24: mol_type = other DNA
tgccgactcagtactgagtcggca

SEQ ID NO: 2194 - DNA, 24 bp, synthetic construct
  misc_feature 1..24: note = Description of Artificial Sequence: Syntheticoligonucleotide
  source 1..24: mol_type = other DNA
gcgagactcagtactgagtctcgc

SEQ ID NO: 2195 - DNA, 24 bp, synthetic construct
  misc_feature 1..24: note = Description of Artificial Sequence: Syntheticoligonucleotide
  source 1..24: mol_type = other DNA
gcgtgactcagtactgagtcacgc

SEQ ID NO: 2196 - DNA, 24 bp, synthetic construct
  misc_feature 1..24: note = Description of Artificial Sequence: Syntheticoligonucleotide
  source 1..24: mol_type = other DNA
gcaggactcagtactgagtcctgc

SEQ ID NO: 2197 - DNA, 24 bp, synthetic construct
  misc_feature 1..24: note = Description of Artificial Sequence: Syntheticoligonucleotide
  source 1..24: mol_type = other DNA
gctggactcagtactgagtccagc

SEQ ID NO: 2198 - DNA, 24 bp, synthetic construct
  misc_feature 1..24: note = Description of Artificial Sequence: Syntheticoligonucleotide
  source 1..24: mol_type = other DNA
cgaggactcagtactgagtcctcg

SEQ ID NO: 2199 - DNA, 24 bp, synthetic construct
  misc_feature 1..24: note = Description of Artificial Sequence: Syntheticoligonucleotide
  source 1..24: mol_type = other DNA
cgtggactcagtactgagtccacg

SEQ ID NO: 2200 - DNA, 24 bp, synthetic construct
  misc_feature 1..24: note = Description of Artificial Sequence: Syntheticoligonucleotide
  source 1..24: mol_type = other DNA
caccgactcagtactgagtcggtg

SEQ ID NO: 2201 - DNA, 24 bp, synthetic construct
  misc_feature 1..24: note = Description of Artificial Sequence: Syntheticoligonucleotide
  source 1..24: mol_type = other DNA
ctccgactcagtactgagtcggag

SEQ ID NO: 2202 - DNA, 24 bp, synthetic construct
  misc_feature 1..24: note = Description of Artificial Sequence: Syntheticoligonucleotide
  source 1..24: mol_type = other DNA
gcgggactcagtactgagtcccgc

SEQ ID NO: 2203 - DNA, 24 bp, synthetic construct
  misc_feature 1..24: note = Description of Artificial Sequence: Syntheticoligonucleotide
  source 1..24: mol_type = other DNA
gagggactcagtactgagtccctc

SEQ ID NO: 2204 - DNA, 24 bp, synthetic construct
  misc_feature 1..24: note = Description of Artificial Sequence: Syntheticoligonucleotide
  source 1..24: mol_type = other DNA
gtgggactcagtactgagtcccac

SEQ ID NO: 2205 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcaggcctgagtcnnnn

SEQ ID NO: 2206 - DNA, 24 bp, synthetic construct
  misc_feature 1..24: note = Description of Artificial Sequence: Syntheticoligonucleotide
  source 1..24: mol_type = other DNA
ggcggactcaggcctgagtccgcc

SEQ ID NO: 2207 - DNA, 24 bp, synthetic construct
  misc_feature 1..24: note = Description of Artificial Sequence: Syntheticoligonucleotide
  source 1..24: mol_type = other DNA
agcggactcaggcctgagtccgct

SEQ ID NO: 2208 - DNA, 24 bp, synthetic construct
  misc_feature 1..24: note = Description of Artificial Sequence: Syntheticoligonucleotide
  source 1..24: mol_type = other DNA
gacggactcaggcctgagtccgtc

SEQ ID NO: 2209 - DNA, 24 bp, synthetic construct
  misc_feature 1..24: note = Description of Artificial Sequence: Syntheticoligonucleotide
  source 1..24: mol_type = other DNA
ggaggactcaggcctgagtcctcc

SEQ ID NO: 2210 - DNA, 24 bp, synthetic construct
  misc_feature 1..24: note = Description of Artificial Sequence: Syntheticoligonucleotide
  source 1..24: mol_type = other DNA
ggcagactcaggcctgagtctgcc

SEQ ID NO: 2211 - DNA, 24 bp, synthetic construct
  misc_feature 1..24: note = Description of Artificial Sequence: Syntheticoligonucleotide
  source 1..24: mol_type = other DNA
tgcggactcaggcctgagtccgca

SEQ ID NO: 2212 - DNA, 24 bp, synthetic construct
  misc_feature 1..24: note = Description of Artificial Sequence: Syntheticoligonucleotide
  source 1..24: mol_type = other DNA
gtcggactcaggcctgagtccgac

SEQ ID NO: 2213 - DNA, 24 bp, synthetic construct
  misc_feature 1..24: note = Description of Artificial Sequence: Syntheticoligonucleotide
  source 1..24: mol_type = other DNA
ggtggactcaggcctgagtccacc

SEQ ID NO: 2214 - DNA, 24 bp, synthetic construct
  misc_feature 1..24: note = Description of Artificial Sequence: Syntheticoligonucleotide
  source 1..24: mol_type = other DNA
ggctgactcaggcctgagtcagcc

SEQ ID NO: 2215 - DNA, 24 bp, synthetic construct
  misc_feature 1..24: note = Description of Artificial Sequence: Syntheticoligonucleotide
  source 1..24: mol_type = other DNA
gcccgactcaggcctgagtcgggc

SEQ ID NO: 2216 - DNA, 24 bp, synthetic construct
  misc_feature 1..24: note = Description of Artificial Sequence: Syntheticoligonucleotide
  source 1..24: mol_type = other DNA
acccgactcaggcctgagtcgggt

SEQ ID NO: 2217 - DNA, 24 bp, synthetic construct
  misc_feature 1..24: note = Description of Artificial Sequence: Syntheticoligonucleotide
  source 1..24: mol_type = other DNA
gaccgactcaggcctgagtcggtc

SEQ ID NO: 2218 - DNA, 24 bp, synthetic construct
  misc_feature 1..24: note = Description of Artificial Sequence: Syntheticoligonucleotide
  source 1..24: mol_type = other DNA
gcacgactcaggcctgagtcgtgc

SEQ ID NO: 2219 - DNA, 24 bp, synthetic construct
  misc_feature 1..24: note = Description of Artificial Sequence: Syntheticoligonucleotide
  source 1..24: mol_type = other DNA
gccagactcaggcctgagtctggc

SEQ ID NO: 2220 - DNA, 24 bp, synthetic construct
  misc_feature 1..24: note = Description of Artificial Sequence: Syntheticoligonucleotide
  source 1..24: mol_type = other DNA
tcccgactcaggcctgagtcggga

SEQ ID NO: 2221 - DNA, 24 bp, synthetic construct
  misc_feature 1..24: note = Description of Artificial Sequence: Syntheticoligonucleotide
  source 1..24: mol_type = other DNA
gtccgactcaggcctgagtcggac

SEQ ID NO: 2222 - DNA, 24 bp, synthetic construct
  misc_feature 1..24: note = Description of Artificial Sequence: Syntheticoligonucleotide
  source 1..24: mol_type = other DNA
gcctgactcaggcctgagtcaggc

SEQ ID NO: 2223 - DNA, 24 bp, synthetic construct
  misc_feature 1..24: note = Description of Artificial Sequence: Syntheticoligonucleotide
  source 1..24: mol_type = other DNA
gggcgactcaggcctgagtcgccc

SEQ ID NO: 2224 - DNA, 24 bp, synthetic construct
  misc_feature 1..24: note = Description of Artificial Sequence: Syntheticoligonucleotide
  source 1..24: mol_type = other DNA
aggcgactcaggcctgagtcgcct

SEQ ID NO: 2225 - DNA, 24 bp, synthetic construct
  misc_feature 1..24: note = Description of Artificial Sequence: Syntheticoligonucleotide
  source 1..24: mol_type = other DNA
gagcgactcaggcctgagtcgctc

SEQ ID NO: 2226 - DNA, 24 bp, synthetic construct
  misc_feature 1..24: note = Description of Artificial Sequence: Syntheticoligonucleotide
  source 1..24: mol_type = other DNA
ggacgactcaggcctgagtcgtcc

SEQ ID NO: 2227 - DNA, 24 bp, synthetic construct
  misc_feature 1..24: note = Description of Artificial Sequence: Syntheticoligonucleotide
  source 1..24: mol_type = other DNA
gggagactcaggcctgagtctccc

SEQ ID NO: 2228 - DNA, 24 bp, synthetic construct
  misc_feature 1..24: note = Description of Artificial Sequence: Syntheticoligonucleotide
  source 1..24: mol_type = other DNA
tggcgactcaggcctgagtcgcca

SEQ ID NO: 2229 - DNA, 24 bp, synthetic construct
  misc_feature 1..24: note = Description of Artificial Sequence: Syntheticoligonucleotide
  source 1..24: mol_type = other DNA
gtgcgactcaggcctgagtcgcac

SEQ ID NO: 2230 - DNA, 24 bp, synthetic construct
  misc_feature 1..24: note = Description of Artificial Sequence: Syntheticoligonucleotide
  source 1..24: mol_type = other DNA
gggtgactcaggcctgagtcaccc

SEQ ID NO: 2231 - DNA, 24 bp, synthetic construct
  misc_feature 1..24: note = Description of Artificial Sequence: Syntheticoligonucleotide
  source 1..24: mol_type = other DNA
acgggactcaggcctgagtcccgt

SEQ ID NO: 2232 - DNA, 24 bp, synthetic construct
  misc_feature 1..24: note = Description of Artificial Sequence: Syntheticoligonucleotide
  source 1..24: mol_type = other DNA
cagggactcaggcctgagtccctg

SEQ ID NO: 2233 - DNA, 24 bp, synthetic construct
  misc_feature 1..24: note = Description of Artificial Sequence: Syntheticoligonucleotide
  source 1..24: mol_type = other DNA
ccaggactcaggcctgagtcctgg

SEQ ID NO: 2234 - DNA, 24 bp, synthetic construct
  misc_feature 1..24: note = Description of Artificial Sequence: Syntheticoligonucleotide
  source 1..24: mol_type = other DNA
ccgagactcaggcctgagtctcgg

SEQ ID NO: 2235 - DNA, 24 bp, synthetic construct
  misc_feature 1..24: note = Description of Artificial Sequence: Syntheticoligonucleotide
  source 1..24: mol_type = other DNA
tcgggactcaggcctgagtcccga

SEQ ID NO: 2236 - DNA, 24 bp, synthetic construct
  misc_feature 1..24: note = Description of Artificial Sequence: Syntheticoligonucleotide
  source 1..24: mol_type = other DNA
ctgggactcaggcctgagtcccag

SEQ ID NO: 2237 - DNA, 24 bp, synthetic construct
  misc_feature 1..24: note = Description of Artificial Sequence: Syntheticoligonucleotide
  source 1..24: mol_type = other DNA
cctggactcaggcctgagtccagg

SEQ ID NO: 2238 - DNA, 24 bp, synthetic construct
  misc_feature 1..24: note = Description of Artificial Sequence: Syntheticoligonucleotide
  source 1..24: mol_type = other DNA
ccgtgactcaggcctgagtcacgg

SEQ ID NO: 2239 - DNA, 24 bp, synthetic construct
  misc_feature 1..24: note = Description of Artificial Sequence: Syntheticoligonucleotide
  source 1..24: mol_type = other DNA
cggcgactcaggcctgagtcgccg

SEQ ID NO: 2240 - DNA, 24 bp, synthetic construct
  misc_feature 1..24: note = Description of Artificial Sequence: Syntheticoligonucleotide
  source 1..24: mol_type = other DNA
cagcgactcaggcctgagtcgctg

SEQ ID NO: 2241 - DNA, 24 bp, synthetic construct
  misc_feature 1..24: note = Description of Artificial Sequence: Syntheticoligonucleotide
  source 1..24: mol_type = other DNA
cgacgactcaggcctgagtcgtcg

SEQ ID NO: 2242 - DNA, 24 bp, synthetic construct
  misc_feature 1..24: note = Description of Artificial Sequence: Syntheticoligonucleotide
  source 1..24: mol_type = other DNA
cggagactcaggcctgagtctccg

SEQ ID NO: 2243 - DNA, 24 bp, synthetic construct
  misc_feature 1..24: note = Description of Artificial Sequence: Syntheticoligonucleotide
  source 1..24: mol_type = other DNA
ctgcgactcaggcctgagtcgcag

SEQ ID NO: 2244 - DNA, 24 bp, synthetic construct
  misc_feature 1..24: note = Description of Artificial Sequence: Syntheticoligonucleotide
  source 1..24: mol_type = other DNA
cggtgactcaggcctgagtcaccg

SEQ ID NO: 2245 - DNA, 24 bp, synthetic construct
  misc_feature 1..24: note = Description of Artificial Sequence: Syntheticoligonucleotide
  source 1..24: mol_type = other DNA
cacggactcaggcctgagtccgtg

SEQ ID NO: 2246 - DNA, 24 bp, synthetic construct
  misc_feature 1..24: note = Description of Artificial Sequence: Syntheticoligonucleotide
  source 1..24: mol_type = other DNA
cccagactcaggcctgagtctggg

SEQ ID NO: 2247 - DNA, 24 bp, synthetic construct
  misc_feature 1..24: note = Description of Artificial Sequence: Syntheticoligonucleotide
  source 1..24: mol_type = other DNA
ctcggactcaggcctgagtccgag

SEQ ID NO: 2248 - DNA, 24 bp, synthetic construct
  misc_feature 1..24: note = Description of Artificial Sequence: Syntheticoligonucleotide
  source 1..24: mol_type = other DNA
ccctgactcaggcctgagtcaggg

SEQ ID NO: 2249 - DNA, 24 bp, synthetic construct
  misc_feature 1..24: note = Description of Artificial Sequence: Syntheticoligonucleotide
  source 1..24: mol_type = other DNA
ccacgactcaggcctgagtcgtgg

SEQ ID NO: 2250 - DNA, 24 bp, synthetic construct
  misc_feature 1..24: note = Description of Artificial Sequence: Syntheticoligonucleotide
  source 1..24: mol_type = other DNA
agccgactcaggcctgagtcggct

SEQ ID NO: 2251 - DNA, 24 bp, synthetic construct
  misc_feature 1..24: note = Description of Artificial Sequence: Syntheticoligonucleotide
  source 1..24: mol_type = other DNA
tgccgactcaggcctgagtcggca

SEQ ID NO: 2252 - DNA, 24 bp, synthetic construct
  misc_feature 1..24: note = Description of Artificial Sequence: Syntheticoligonucleotide
  source 1..24: mol_type = other DNA
gcgagactcaggcctgagtctcgc

SEQ ID NO: 2253 - DNA, 24 bp, synthetic construct
  misc_feature 1..24: note = Description of Artificial Sequence: Syntheticoligonucleotide
  source 1..24: mol_type = other DNA
gcgtgactcaggcctgagtcacgc

SEQ ID NO: 2254 - DNA, 24 bp, synthetic construct
  misc_feature 1..24: note = Description of Artificial Sequence: Syntheticoligonucleotide
  source 1..24: mol_type = other DNA
gcaggactcaggcctgagtcctgc

SEQ ID NO: 2255 - DNA, 24 bp, synthetic construct
  misc_feature 1..24: note = Description of Artificial Sequence: Syntheticoligonucleotide
  source 1..24: mol_type = other DNA
gctggactcaggcctgagtccagc

SEQ ID NO: 2256 - DNA, 24 bp, synthetic construct
  misc_feature 1..24: note = Description of Artificial Sequence: Syntheticoligonucleotide
  source 1..24: mol_type = other DNA
cgaggactcaggcctgagtcctcg

SEQ ID NO: 2257 - DNA, 24 bp, synthetic construct
  misc_feature 1..24: note = Description of Artificial Sequence: Syntheticoligonucleotide
  source 1..24: mol_type = other DNA
cgtggactcaggcctgagtccacg

SEQ ID NO: 2258 - DNA, 24 bp, synthetic construct
  misc_feature 1..24: note = Description of Artificial Sequence: Syntheticoligonucleotide
  source 1..24: mol_type = other DNA
caccgactcaggcctgagtcggtg

SEQ ID NO: 2259 - DNA, 24 bp, synthetic construct
  misc_feature 1..24: note = Description of Artificial Sequence: Syntheticoligonucleotide
  source 1..24: mol_type = other DNA
ctccgactcaggcctgagtcggag

SEQ ID NO: 2260 - DNA, 24 bp, synthetic construct
  misc_feature 1..24: note = Description of Artificial Sequence: Syntheticoligonucleotide
  source 1..24: mol_type = other DNA
gcgggactcaggcctgagtcccgc

SEQ ID NO: 2261 - DNA, 24 bp, synthetic construct
  misc_feature 1..24: note = Description of Artificial Sequence: Syntheticoligonucleotide
  source 1..24: mol_type = other DNA
gagggactcaggcctgagtccctc

SEQ ID NO: 2262 - DNA, 24 bp, synthetic construct
  misc_feature 1..24: note = Description of Artificial Sequence: Syntheticoligonucleotide
  source 1..24: mol_type = other DNA
gtgggactcaggcctgagtcccac

SEQ ID NO: 2263 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcagcgctgagtcnnnn

SEQ ID NO: 2264 - DNA, 24 bp, synthetic construct
  misc_feature 1..24: note = Description of Artificial Sequence: Syntheticoligonucleotide
  source 1..24: mol_type = other DNA
ggcggactcagcgctgagtccgcc

SEQ ID NO: 2265 - DNA, 24 bp, synthetic construct
  misc_feature 1..24: note = Description of Artificial Sequence: Syntheticoligonucleotide
  source 1..24: mol_type = other DNA
agcggactcagcgctgagtccgct

SEQ ID NO: 2266 - DNA, 24 bp, synthetic construct
  misc_feature 1..24: note = Description of Artificial Sequence: Syntheticoligonucleotide
  source 1..24: mol_type = other DNA
gacggactcagcgctgagtccgtc

SEQ ID NO: 2267 - DNA, 24 bp, synthetic construct
  misc_feature 1..24: note = Description of Artificial Sequence: Syntheticoligonucleotide
  source 1..24: mol_type = other DNA
ggaggactcagcgctgagtcctcc

SEQ ID NO: 2268 - DNA, 24 bp, synthetic construct
  misc_feature 1..24: note = Description of Artificial Sequence: Syntheticoligonucleotide
  source 1..24: mol_type = other DNA
ggcagactcagcgctgagtctgcc

SEQ ID NO: 2269 - DNA, 24 bp, synthetic construct
  misc_feature 1..24: note = Description of Artificial Sequence: Syntheticoligonucleotide
  source 1..24: mol_type = other DNA
tgcggactcagcgctgagtccgca

SEQ ID NO: 2270 - DNA, 24 bp, synthetic construct
  misc_feature 1..24: note = Description of Artificial Sequence: Syntheticoligonucleotide
  source 1..24: mol_type = other DNA
gtcggactcagcgctgagtccgac

SEQ ID NO: 2271 - DNA, 24 bp, synthetic construct
  misc_feature 1..24: note = Description of Artificial Sequence: Syntheticoligonucleotide
  source 1..24: mol_type = other DNA
ggtggactcagcgctgagtccacc

SEQ ID NO: 2272 - DNA, 24 bp, synthetic construct
  misc_feature 1..24: note = Description of Artificial Sequence: Syntheticoligonucleotide
  source 1..24: mol_type = other DNA
ggctgactcagcgctgagtcagcc

SEQ ID NO: 2273 - DNA, 24 bp, synthetic construct
  misc_feature 1..24: note = Description of Artificial Sequence: Syntheticoligonucleotide
  source 1..24: mol_type = other DNA
gcccgactcagcgctgagtcgggc

SEQ ID NO: 2274 - DNA, 24 bp, synthetic construct
  misc_feature 1..24: note = Description of Artificial Sequence: Syntheticoligonucleotide
  source 1..24: mol_type = other DNA
acccgactcagcgctgagtcgggt

SEQ ID NO: 2275 - DNA, 24 bp, synthetic construct
  misc_feature 1..24: note = Description of Artificial Sequence: Syntheticoligonucleotide
  source 1..24: mol_type = other DNA
gaccgactcagcgctgagtcggtc

SEQ ID NO: 2276 - DNA, 24 bp, synthetic construct
  misc_feature 1..24: note = Description of Artificial Sequence: Syntheticoligonucleotide
  source 1..24: mol_type = other DNA
gcacgactcagcgctgagtcgtgc

SEQ ID NO: 2277 - DNA, 24 bp, synthetic construct
  misc_feature 1..24: note = Description of Artificial Sequence: Syntheticoligonucleotide
  source 1..24: mol_type = other DNA
gccagactcagcgctgagtctggc

SEQ ID NO: 2278 - DNA, 24 bp, synthetic construct
  misc_feature 1..24: note = Description of Artificial Sequence: Syntheticoligonucleotide
  source 1..24: mol_type = other DNA
tcccgactcagcgctgagtcggga

SEQ ID NO: 2279 - DNA, 24 bp, synthetic construct
  misc_feature 1..24: note = Description of Artificial Sequence: Syntheticoligonucleotide
  source 1..24: mol_type = other DNA
gtccgactcagcgctgagtcggac

SEQ ID NO: 2280 - DNA, 24 bp, synthetic construct
  misc_feature 1..24: note = Description of Artificial Sequence: Syntheticoligonucleotide
  source 1..24: mol_type = other DNA
gcctgactcagcgctgagtcaggc

SEQ ID NO: 2281 - DNA, 24 bp, synthetic construct
  misc_feature 1..24: note = Description of Artificial Sequence: Syntheticoligonucleotide
  source 1..24: mol_type = other DNA
gggcgactcagcgctgagtcgccc

SEQ ID NO: 2282 - DNA, 24 bp, synthetic construct
  misc_feature 1..24: note = Description of Artificial Sequence: Syntheticoligonucleotide
  source 1..24: mol_type = other DNA
aggcgactcagcgctgagtcgcct

SEQ ID NO: 2283 - DNA, 24 bp, synthetic construct
  misc_feature 1..24: note = Description of Artificial Sequence: Syntheticoligonucleotide
  source 1..24: mol_type = other DNA
gagcgactcagcgctgagtcgctc

SEQ ID NO: 2284 - DNA, 24 bp, synthetic construct
  misc_feature 1..24: note = Description of Artificial Sequence: Syntheticoligonucleotide
  source 1..24: mol_type = other DNA
ggacgactcagcgctgagtcgtcc

SEQ ID NO: 2285 - DNA, 24 bp, synthetic construct
  misc_feature 1..24: note = Description of Artificial Sequence: Syntheticoligonucleotide
  source 1..24: mol_type = other DNA
gggagactcagcgctgagtctccc

SEQ ID NO: 2286 - DNA, 24 bp, synthetic construct
  misc_feature 1..24: note = Description of Artificial Sequence: Syntheticoligonucleotide
  source 1..24: mol_type = other DNA
tggcgactcagcgctgagtcgcca

SEQ ID NO: 2287 - DNA, 24 bp, synthetic construct
  misc_feature 1..24: note = Description of Artificial Sequence: Syntheticoligonucleotide
  source 1..24: mol_type = other DNA
gtgcgactcagcgctgagtcgcac

SEQ ID NO: 2288 - DNA, 24 bp, synthetic construct
  misc_feature 1..24: note = Description of Artificial Sequence: Syntheticoligonucleotide
  source 1..24: mol_type = other DNA
gggtgactcagcgctgagtcaccc

SEQ ID NO: 2289 - DNA, 24 bp, synthetic construct
  misc_feature 1..24: note = Description of Artificial Sequence: Syntheticoligonucleotide
  source 1..24: mol_type = other DNA
acgggactcagcgctgagtcccgt

SEQ ID NO: 2290 - DNA, 24 bp, synthetic construct
  misc_feature 1..24: note = Description of Artificial Sequence: Syntheticoligonucleotide
  source 1..24: mol_type = other DNA
cagggactcagcgctgagtccctg

SEQ ID NO: 2291 - DNA, 24 bp, synthetic construct
  misc_feature 1..24: note = Description of Artificial Sequence: Syntheticoligonucleotide
  source 1..24: mol_type = other DNA
ccaggactcagcgctgagtcctgg

SEQ ID NO: 2292 - DNA, 24 bp, synthetic construct
  misc_feature 1..24: note = Description of Artificial Sequence: Syntheticoligonucleotide
  source 1..24: mol_type = other DNA
ccgagactcagcgctgagtctcgg

SEQ ID NO: 2293 - DNA, 24 bp, synthetic construct
  misc_feature 1..24: note = Description of Artificial Sequence: Syntheticoligonucleotide
  source 1..24: mol_type = other DNA
tcgggactcagcgctgagtcccga

SEQ ID NO: 2294 - DNA, 24 bp, synthetic construct
  misc_feature 1..24: note = Description of Artificial Sequence: Syntheticoligonucleotide
  source 1..24: mol_type = other DNA
ctgggactcagcgctgagtcccag

SEQ ID NO: 2295 - DNA, 24 bp, synthetic construct
  misc_feature 1..24: note = Description of Artificial Sequence: Syntheticoligonucleotide
  source 1..24: mol_type = other DNA
cctggactcagcgctgagtccagg

SEQ ID NO: 2296 - DNA, 24 bp, synthetic construct
  misc_feature 1..24: note = Description of Artificial Sequence: Syntheticoligonucleotide
  source 1..24: mol_type = other DNA
ccgtgactcagcgctgagtcacgg

SEQ ID NO: 2297 - DNA, 24 bp, synthetic construct
  misc_feature 1..24: note = Description of Artificial Sequence: Syntheticoligonucleotide
  source 1..24: mol_type = other DNA
cggcgactcagcgctgagtcgccg

SEQ ID NO: 2298 - DNA, 24 bp, synthetic construct
  misc_feature 1..24: note = Description of Artificial Sequence: Syntheticoligonucleotide
  source 1..24: mol_type = other DNA
cagcgactcagcgctgagtcgctg

SEQ ID NO: 2299 - DNA, 24 bp, synthetic construct
  misc_feature 1..24: note = Description of Artificial Sequence: Syntheticoligonucleotide
  source 1..24: mol_type = other DNA
cgacgactcagcgctgagtcgtcg

SEQ ID NO: 2300 - DNA, 24 bp, synthetic construct
  misc_feature 1..24: note = Description of Artificial Sequence: Syntheticoligonucleotide
  source 1..24: mol_type = other DNA
cggagactcagcgctgagtctccg

SEQ ID NO: 2301 - DNA, 24 bp, synthetic construct
  misc_feature 1..24: note = Description of Artificial Sequence: Syntheticoligonucleotide
  source 1..24: mol_type = other DNA
ctgcgactcagcgctgagtcgcag

SEQ ID NO: 2302 - DNA, 24 bp, synthetic construct
  misc_feature 1..24: note = Description of Artificial Sequence: Syntheticoligonucleotide
  source 1..24: mol_type = other DNA
cggtgactcagcgctgagtcaccg

SEQ ID NO: 2303 - DNA, 24 bp, synthetic construct
  misc_feature 1..24: note = Description of Artificial Sequence: Syntheticoligonucleotide
  source 1..24: mol_type = other DNA
cacggactcagcgctgagtccgtg

SEQ ID NO: 2304 - DNA, 24 bp, synthetic construct
  misc_feature 1..24: note = Description of Artificial Sequence: Syntheticoligonucleotide
  source 1..24: mol_type = other DNA
cccagactcagcgctgagtctggg

SEQ ID NO: 2305 - DNA, 24 bp, synthetic construct
  misc_feature 1..24: note = Description of Artificial Sequence: Syntheticoligonucleotide
  source 1..24: mol_type = other DNA
ctcggactcagcgctgagtccgag

SEQ ID NO: 2306 - DNA, 24 bp, synthetic construct
  misc_feature 1..24: note = Description of Artificial Sequence: Syntheticoligonucleotide
  source 1..24: mol_type = other DNA
ccctgactcagcgctgagtcaggg

SEQ ID NO: 2307 - DNA, 24 bp, synthetic construct
  misc_feature 1..24: note = Description of Artificial Sequence: Syntheticoligonucleotide
  source 1..24: mol_type = other DNA
ccacgactcagcgctgagtcgtgg

SEQ ID NO: 2308 - DNA, 24 bp, synthetic construct
  misc_feature 1..24: note = Description of Artificial Sequence: Syntheticoligonucleotide
  source 1..24: mol_type = other DNA
agccgactcagcgctgagtcggct

SEQ ID NO: 2309 - DNA, 24 bp, synthetic construct
  misc_feature 1..24: note = Description of Artificial Sequence: Syntheticoligonucleotide
  source 1..24: mol_type = other DNA
tgccgactcagcgctgagtcggca

SEQ ID NO: 2310 - DNA, 24 bp, synthetic construct
  misc_feature 1..24: note = Description of Artificial Sequence: Syntheticoligonucleotide
  source 1..24: mol_type = other DNA
gcgagactcagcgctgagtctcgc

SEQ ID NO: 2311 - DNA, 24 bp, synthetic construct
  misc_feature 1..24: note = Description of Artificial Sequence: Syntheticoligonucleotide
  source 1..24: mol_type = other DNA
gcgtgactcagcgctgagtcacgc

SEQ ID NO: 2312 - DNA, 24 bp, synthetic construct
  misc_feature 1..24: note = Description of Artificial Sequence: Syntheticoligonucleotide
  source 1..24: mol_type = other DNA
gcaggactcagcgctgagtcctgc

SEQ ID NO: 2313 - DNA, 24 bp, synthetic construct
  misc_feature 1..24: note = Description of Artificial Sequence: Syntheticoligonucleotide
  source 1..24: mol_type = other DNA
gctggactcagcgctgagtccagc

SEQ ID NO: 2314 - DNA, 24 bp, synthetic construct
  misc_feature 1..24: note = Description of Artificial Sequence: Syntheticoligonucleotide
  source 1..24: mol_type = other DNA
cgaggactcagcgctgagtcctcg

SEQ ID NO: 2315 - DNA, 24 bp, synthetic construct
  misc_feature 1..24: note = Description of Artificial Sequence: Syntheticoligonucleotide
  source 1..24: mol_type = other DNA
cgtggactcagcgctgagtccacg

SEQ ID NO: 2316 - DNA, 24 bp, synthetic construct
  misc_feature 1..24: note = Description of Artificial Sequence: Syntheticoligonucleotide
  source 1..24: mol_type = other DNA
caccgactcagcgctgagtcggtg

SEQ ID NO: 2317 - DNA, 24 bp, synthetic construct
  misc_feature 1..24: note = Description of Artificial Sequence: Syntheticoligonucleotide
  source 1..24: mol_type = other DNA
ctccgactcagcgctgagtcggag

SEQ ID NO: 2318 - DNA, 24 bp, synthetic construct
  misc_feature 1..24: note = Description of Artificial Sequence: Syntheticoligonucleotide
  source 1..24: mol_type = other DNA
gcgggactcagcgctgagtcccgc

SEQ ID NO: 2319 - DNA, 24 bp, synthetic construct
  misc_feature 1..24: note = Description of Artificial Sequence: Syntheticoligonucleotide
  source 1..24: mol_type = other DNA
gagggactcagcgctgagtccctc

SEQ ID NO: 2320 - DNA, 24 bp, synthetic construct
  misc_feature 1..24: note = Description of Artificial Sequence: Syntheticoligonucleotide
  source 1..24: mol_type = other DNA
gtgggactcagcgctgagtcccac

SEQ ID NO: 2321 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcaaatttgagtcnnnn

SEQ ID NO: 2322 - DNA, 24 bp, synthetic construct
  misc_feature 1..24: note = Description of Artificial Sequence: Syntheticoligonucleotide
  source 1..24: mol_type = other DNA
ggcggactcaaatttgagtccgcc

SEQ ID NO: 2323 - DNA, 24 bp, synthetic construct
  misc_feature 1..24: note = Description of Artificial Sequence: Syntheticoligonucleotide
  source 1..24: mol_type = other DNA
agcggactcaaatttgagtccgct

SEQ ID NO: 2324 - DNA, 24 bp, synthetic construct
  misc_feature 1..24: note = Description of Artificial Sequence: Syntheticoligonucleotide
  source 1..24: mol_type = other DNA
gacggactcaaatttgagtccgtc

SEQ ID NO: 2325 - DNA, 24 bp, synthetic construct
  misc_feature 1..24: note = Description of Artificial Sequence: Syntheticoligonucleotide
  source 1..24: mol_type = other DNA
ggaggactcaaatttgagtcctcc

SEQ ID NO: 2326 - DNA, 24 bp, synthetic construct
  misc_feature 1..24: note = Description of Artificial Sequence: Syntheticoligonucleotide
  source 1..24: mol_type = other DNA
ggcagactcaaatttgagtctgcc

SEQ ID NO: 2327 - DNA, 24 bp, synthetic construct
  misc_feature 1..24: note = Description of Artificial Sequence: Syntheticoligonucleotide
  source 1..24: mol_type = other DNA
tgcggactcaaatttgagtccgca

SEQ ID NO: 2328 - DNA, 24 bp, synthetic construct
  misc_feature 1..24: note = Description of Artificial Sequence: Syntheticoligonucleotide
  source 1..24: mol_type = other DNA
gtcggactcaaatttgagtccgac

SEQ ID NO: 2329 - DNA, 24 bp, synthetic construct
  misc_feature 1..24: note = Description of Artificial Sequence: Syntheticoligonucleotide
  source 1..24: mol_type = other DNA
ggtggactcaaatttgagtccacc

SEQ ID NO: 2330 - DNA, 24 bp, synthetic construct
  misc_feature 1..24: note = Description of Artificial Sequence: Syntheticoligonucleotide
  source 1..24: mol_type = other DNA
ggctgactcaaatttgagtcagcc

SEQ ID NO: 2331 - DNA, 24 bp, synthetic construct
  misc_feature 1..24: note = Description of Artificial Sequence: Syntheticoligonucleotide
  source 1..24: mol_type = other DNA
gcccgactcaaatttgagtcgggc

SEQ ID NO: 2332 - DNA, 24 bp, synthetic construct
  misc_feature 1..24: note = Description of Artificial Sequence: Syntheticoligonucleotide
  source 1..24: mol_type = other DNA
acccgactcaaatttgagtcgggt

SEQ ID NO: 2333 - DNA, 24 bp, synthetic construct
  misc_feature 1..24: note = Description of Artificial Sequence: Syntheticoligonucleotide
  source 1..24: mol_type = other DNA
gaccgactcaaatttgagtcggtc

SEQ ID NO: 2334 - DNA, 24 bp, synthetic construct
  misc_feature 1..24: note = Description of Artificial Sequence: Syntheticoligonucleotide
  source 1..24: mol_type = other DNA
gcacgactcaaatttgagtcgtgc

SEQ ID NO: 2335 - DNA, 24 bp, synthetic construct
  misc_feature 1..24: note = Description of Artificial Sequence: Syntheticoligonucleotide
  source 1..24: mol_type = other DNA
gccagactcaaatttgagtctggc

SEQ ID NO: 2336 - DNA, 24 bp, synthetic construct
  misc_feature 1..24: note = Description of Artificial Sequence: Syntheticoligonucleotide
  source 1..24: mol_type = other DNA
tcccgactcaaatttgagtcggga

SEQ ID NO: 2337 - DNA, 24 bp, synthetic construct
  misc_feature 1..24: note = Description of Artificial Sequence: Syntheticoligonucleotide
  source 1..24: mol_type = other DNA
gtccgactcaaatttgagtcggac

SEQ ID NO: 2338 - DNA, 24 bp, synthetic construct
  misc_feature 1..24: note = Description of Artificial Sequence: Syntheticoligonucleotide
  source 1..24: mol_type = other DNA
gcctgactcaaatttgagtcaggc

SEQ ID NO: 2339 - DNA, 24 bp, synthetic construct
  misc_feature 1..24: note = Description of Artificial Sequence: Syntheticoligonucleotide
  source 1..24: mol_type = other DNA
gggcgactcaaatttgagtcgccc

SEQ ID NO: 2340 - DNA, 24 bp, synthetic construct
  misc_feature 1..24: note = Description of Artificial Sequence: Syntheticoligonucleotide
  source 1..24: mol_type = other DNA
aggcgactcaaatttgagtcgcct

SEQ ID NO: 2341 - DNA, 24 bp, synthetic construct
  misc_feature 1..24: note = Description of Artificial Sequence: Syntheticoligonucleotide
  source 1..24: mol_type = other DNA
gagcgactcaaatttgagtcgctc

SEQ ID NO: 2342 - DNA, 24 bp, synthetic construct
  misc_feature 1..24: note = Description of Artificial Sequence: Syntheticoligonucleotide
  source 1..24: mol_type = other DNA
ggacgactcaaatttgagtcgtcc

SEQ ID NO: 2343 - DNA, 24 bp, synthetic construct
  misc_feature 1..24: note = Description of Artificial Sequence: Syntheticoligonucleotide
  source 1..24: mol_type = other DNA
gggagactcaaatttgagtctccc

SEQ ID NO: 2344 - DNA, 24 bp, synthetic construct
  misc_feature 1..24: note = Description of Artificial Sequence: Syntheticoligonucleotide
  source 1..24: mol_type = other DNA
tggcgactcaaatttgagtcgcca

SEQ ID NO: 2345 - DNA, 24 bp, synthetic construct
  misc_feature 1..24: note = Description of Artificial Sequence: Syntheticoligonucleotide
  source 1..24: mol_type = other DNA
gtgcgactcaaatttgagtcgcac

SEQ ID NO: 2346 - DNA, 24 bp, synthetic construct
  misc_feature 1..24: note = Description of Artificial Sequence: Syntheticoligonucleotide
  source 1..24: mol_type = other DNA
gggtgactcaaatttgagtcaccc

SEQ ID NO: 2347 - DNA, 24 bp, synthetic construct
  misc_feature 1..24: note = Description of Artificial Sequence: Syntheticoligonucleotide
  source 1..24: mol_type = other DNA
acgggactcaaatttgagtcccgt

SEQ ID NO: 2348 - DNA, 24 bp, synthetic construct
  misc_feature 1..24: note = Description of Artificial Sequence: Syntheticoligonucleotide
  source 1..24: mol_type = other DNA
cagggactcaaatttgagtccctg

SEQ ID NO: 2349 - DNA, 24 bp, synthetic construct
  misc_feature 1..24: note = Description of Artificial Sequence: Syntheticoligonucleotide
  source 1..24: mol_type = other DNA
ccaggactcaaatttgagtcctgg

SEQ ID NO: 2350 - DNA, 24 bp, synthetic construct
  misc_feature 1..24: note = Description of Artificial Sequence: Syntheticoligonucleotide
  source 1..24: mol_type = other DNA
ccgagactcaaatttgagtctcgg

SEQ ID NO: 2351 - DNA, 24 bp, synthetic construct
  misc_feature 1..24: note = Description of Artificial Sequence: Syntheticoligonucleotide
  source 1..24: mol_type = other DNA
tcgggactcaaatttgagtcccga

SEQ ID NO: 2352 - DNA, 24 bp, synthetic construct
  misc_feature 1..24: note = Description of Artificial Sequence: Syntheticoligonucleotide
  source 1..24: mol_type = other DNA
ctgggactcaaatttgagtcccag

SEQ ID NO: 2353 - DNA, 24 bp, synthetic construct
  misc_feature 1..24: note = Description of Artificial Sequence: Syntheticoligonucleotide
  source 1..24: mol_type = other DNA
cctggactcaaatttgagtccagg

SEQ ID NO: 2354 - DNA, 24 bp, synthetic construct
  misc_feature 1..24: note = Description of Artificial Sequence: Syntheticoligonucleotide
  source 1..24: mol_type = other DNA
ccgtgactcaaatttgagtcacgg

SEQ ID NO: 2355 - DNA, 24 bp, synthetic construct
  misc_feature 1..24: note = Description of Artificial Sequence: Syntheticoligonucleotide
  source 1..24: mol_type = other DNA
cggcgactcaaatttgagtcgccg

SEQ ID NO: 2356 - DNA, 24 bp, synthetic construct
  misc_feature 1..24: note = Description of Artificial Sequence: Syntheticoligonucleotide
  source 1..24: mol_type = other DNA
cagcgactcaaatttgagtcgctg

SEQ ID NO: 2357 - DNA, 24 bp, synthetic construct
  misc_feature 1..24: note = Description of Artificial Sequence: Syntheticoligonucleotide
  source 1..24: mol_type = other DNA
cgacgactcaaatttgagtcgtcg

SEQ ID NO: 2358 - DNA, 24 bp, synthetic construct
  misc_feature 1..24: note = Description of Artificial Sequence: Syntheticoligonucleotide
  source 1..24: mol_type = other DNA
cggagactcaaatttgagtctccg

SEQ ID NO: 2359 - DNA, 24 bp, synthetic construct
  misc_feature 1..24: note = Description of Artificial Sequence: Syntheticoligonucleotide
  source 1..24: mol_type = other DNA
ctgcgactcaaatttgagtcgcag

SEQ ID NO: 2360 - DNA, 24 bp, synthetic construct
  misc_feature 1..24: note = Description of Artificial Sequence: Syntheticoligonucleotide
  source 1..24: mol_type = other DNA
cggtgactcaaatttgagtcaccg

SEQ ID NO: 2361 - DNA, 24 bp, synthetic construct
  misc_feature 1..24: note = Description of Artificial Sequence: Syntheticoligonucleotide
  source 1..24: mol_type = other DNA
cacggactcaaatttgagtccgtg

SEQ ID NO: 2362 - DNA, 24 bp, synthetic construct
  misc_feature 1..24: note = Description of Artificial Sequence: Syntheticoligonucleotide
  source 1..24: mol_type = other DNA
cccagactcaaatttgagtctggg

SEQ ID NO: 2363 - DNA, 24 bp, synthetic construct
  misc_feature 1..24: note = Description of Artificial Sequence: Syntheticoligonucleotide
  source 1..24: mol_type = other DNA
ctcggactcaaatttgagtccgag

SEQ ID NO: 2364 - DNA, 24 bp, synthetic construct
  misc_feature 1..24: note = Description of Artificial Sequence: Syntheticoligonucleotide
  source 1..24: mol_type = other DNA
ccctgactcaaatttgagtcaggg

SEQ ID NO: 2365 - DNA, 24 bp, synthetic construct
  misc_feature 1..24: note = Description of Artificial Sequence: Syntheticoligonucleotide
  source 1..24: mol_type = other DNA
ccacgactcaaatttgagtcgtgg

SEQ ID NO: 2366 - DNA, 24 bp, synthetic construct
  misc_feature 1..24: note = Description of Artificial Sequence: Syntheticoligonucleotide
  source 1..24: mol_type = other DNA
agccgactcaaatttgagtcggct

SEQ ID NO: 2367 - DNA, 24 bp, synthetic construct
  misc_feature 1..24: note = Description of Artificial Sequence: Syntheticoligonucleotide
  source 1..24: mol_type = other DNA
tgccgactcaaatttgagtcggca

SEQ ID NO: 2368 - DNA, 24 bp, synthetic construct
  misc_feature 1..24: note = Description of Artificial Sequence: Syntheticoligonucleotide
  source 1..24: mol_type = other DNA
gcgagactcaaatttgagtctcgc

SEQ ID NO: 2369 - DNA, 24 bp, synthetic construct
  misc_feature 1..24: note = Description of Artificial Sequence: Syntheticoligonucleotide
  source 1..24: mol_type = other DNA
gcgtgactcaaatttgagtcacgc

SEQ ID NO: 2370 - DNA, 24 bp, synthetic construct
  misc_feature 1..24: note = Description of Artificial Sequence: Syntheticoligonucleotide
  source 1..24: mol_type = other DNA
gcaggactcaaatttgagtcctgc

SEQ ID NO: 2371 - DNA, 24 bp, synthetic construct
  misc_feature 1..24: note = Description of Artificial Sequence: Syntheticoligonucleotide
  source 1..24: mol_type = other DNA
gctggactcaaatttgagtccagc

SEQ ID NO: 2372 - DNA, 24 bp, synthetic construct
  misc_feature 1..24: note = Description of Artificial Sequence: Syntheticoligonucleotide
  source 1..24: mol_type = other DNA
cgaggactcaaatttgagtcctcg

SEQ ID NO: 2373 - DNA, 24 bp, synthetic construct
  misc_feature 1..24: note = Description of Artificial Sequence: Syntheticoligonucleotide
  source 1..24: mol_type = other DNA
cgtggactcaaatttgagtccacg

SEQ ID NO: 2374 - DNA, 24 bp, synthetic construct
  misc_feature 1..24: note = Description of Artificial Sequence: Syntheticoligonucleotide
  source 1..24: mol_type = other DNA
caccgactcaaatttgagtcggtg

SEQ ID NO: 2375 - DNA, 24 bp, synthetic construct
  misc_feature 1..24: note = Description of Artificial Sequence: Syntheticoligonucleotide
  source 1..24: mol_type = other DNA
ctccgactcaaatttgagtcggag

SEQ ID NO: 2376 - DNA, 24 bp, synthetic construct
  misc_feature 1..24: note = Description of Artificial Sequence: Syntheticoligonucleotide
  source 1..24: mol_type = other DNA
gcgggactcaaatttgagtcccgc

SEQ ID NO: 2377 - DNA, 24 bp, synthetic construct
  misc_feature 1..24: note = Description of Artificial Sequence: Syntheticoligonucleotide
  source 1..24: mol_type = other DNA
gagggactcaaatttgagtccctc

SEQ ID NO: 2378 - DNA, 24 bp, synthetic construct
  misc_feature 1..24: note = Description of Artificial Sequence: Syntheticoligonucleotide
  source 1..24: mol_type = other DNA
gtgggactcaaatttgagtcccac

SEQ ID NO: 2379 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcaatattgagtcnnnn

SEQ ID NO: 2380 - DNA, 24 bp, synthetic construct
  misc_feature 1..24: note = Description of Artificial Sequence: Syntheticoligonucleotide
  source 1..24: mol_type = other DNA
ggcggactcaatattgagtccgcc

SEQ ID NO: 2381 - DNA, 24 bp, synthetic construct
  misc_feature 1..24: note = Description of Artificial Sequence: Syntheticoligonucleotide
  source 1..24: mol_type = other DNA
agcggactcaatattgagtccgct

SEQ ID NO: 2382 - DNA, 24 bp, synthetic construct
  misc_feature 1..24: note = Description of Artificial Sequence: Syntheticoligonucleotide
  source 1..24: mol_type = other DNA
gacggactcaatattgagtccgtc

SEQ ID NO: 2383 - DNA, 24 bp, synthetic construct
  misc_feature 1..24: note = Description of Artificial Sequence: Syntheticoligonucleotide
  source 1..24: mol_type = other DNA
ggaggactcaatattgagtcctcc

SEQ ID NO: 2384 - DNA, 24 bp, synthetic construct
  misc_feature 1..24: note = Description of Artificial Sequence: Syntheticoligonucleotide
  source 1..24: mol_type = other DNA
ggcagactcaatattgagtctgcc

SEQ ID NO: 2385 - DNA, 24 bp, synthetic construct
  misc_feature 1..24: note = Description of Artificial Sequence: Syntheticoligonucleotide
  source 1..24: mol_type = other DNA
tgcggactcaatattgagtccgca

SEQ ID NO: 2386 - DNA, 24 bp, synthetic construct
  misc_feature 1..24: note = Description of Artificial Sequence: Syntheticoligonucleotide
  source 1..24: mol_type = other DNA
gtcggactcaatattgagtccgac

SEQ ID NO: 2387 - DNA, 24 bp, synthetic construct
  misc_feature 1..24: note = Description of Artificial Sequence: Syntheticoligonucleotide
  source 1..24: mol_type = other DNA
ggtggactcaatattgagtccacc

SEQ ID NO: 2388 - DNA, 24 bp, synthetic construct
  misc_feature 1..24: note = Description of Artificial Sequence: Syntheticoligonucleotide
  source 1..24: mol_type = other DNA
ggctgactcaatattgagtcagcc

SEQ ID NO: 2389 - DNA, 24 bp, synthetic construct
  misc_feature 1..24: note = Description of Artificial Sequence: Syntheticoligonucleotide
  source 1..24: mol_type = other DNA
gcccgactcaatattgagtcgggc

SEQ ID NO: 2390 - DNA, 24 bp, synthetic construct
  misc_feature 1..24: note = Description of Artificial Sequence: Syntheticoligonucleotide
  source 1..24: mol_type = other DNA
acccgactcaatattgagtcgggt

SEQ ID NO: 2391 - DNA, 24 bp, synthetic construct
  misc_feature 1..24: note = Description of Artificial Sequence: Syntheticoligonucleotide
  source 1..24: mol_type = other DNA
gaccgactcaatattgagtcggtc

SEQ ID NO: 2392 - DNA, 24 bp, synthetic construct
  misc_feature 1..24: note = Description of Artificial Sequence: Syntheticoligonucleotide
  source 1..24: mol_type = other DNA
gcacgactcaatattgagtcgtgc

SEQ ID NO: 2393 - DNA, 24 bp, synthetic construct
  misc_feature 1..24: note = Description of Artificial Sequence: Syntheticoligonucleotide
  source 1..24: mol_type = other DNA
gccagactcaatattgagtctggc

SEQ ID NO: 2394 - DNA, 24 bp, synthetic construct
  misc_feature 1..24: note = Description of Artificial Sequence: Syntheticoligonucleotide
  source 1..24: mol_type = other DNA
tcccgactcaatattgagtcggga

SEQ ID NO: 2395 - DNA, 24 bp, synthetic construct
  misc_feature 1..24: note = Description of Artificial Sequence: Syntheticoligonucleotide
  source 1..24: mol_type = other DNA
gtccgactcaatattgagtcggac

SEQ ID NO: 2396 - DNA, 24 bp, synthetic construct
  misc_feature 1..24: note = Description of Artificial Sequence: Syntheticoligonucleotide
  source 1..24: mol_type = other DNA
gcctgactcaatattgagtcaggc

SEQ ID NO: 2397 - DNA, 24 bp, synthetic construct
  misc_feature 1..24: note = Description of Artificial Sequence: Syntheticoligonucleotide
  source 1..24: mol_type = other DNA
gggcgactcaatattgagtcgccc

SEQ ID NO: 2398 - DNA, 24 bp, synthetic construct
  misc_feature 1..24: note = Description of Artificial Sequence: Syntheticoligonucleotide
  source 1..24: mol_type = other DNA
aggcgactcaatattgagtcgcct

SEQ ID NO: 2399 - DNA, 24 bp, synthetic construct
  misc_feature 1..24: note = Description of Artificial Sequence: Syntheticoligonucleotide
  source 1..24: mol_type = other DNA
gagcgactcaatattgagtcgctc

SEQ ID NO: 2400 - DNA, 24 bp, synthetic construct
  misc_feature 1..24: note = Description of Artificial Sequence: Syntheticoligonucleotide
  source 1..24: mol_type = other DNA
ggacgactcaatattgagtcgtcc

SEQ ID NO: 2401 - DNA, 24 bp, synthetic construct
  misc_feature 1..24: note = Description of Artificial Sequence: Syntheticoligonucleotide
  source 1..24: mol_type = other DNA
gggagactcaatattgagtctccc

SEQ ID NO: 2402 - DNA, 24 bp, synthetic construct
  misc_feature 1..24: note = Description of Artificial Sequence: Syntheticoligonucleotide
  source 1..24: mol_type = other DNA
tggcgactcaatattgagtcgcca

SEQ ID NO: 2403 - DNA, 24 bp, synthetic construct
  misc_feature 1..24: note = Description of Artificial Sequence: Syntheticoligonucleotide
  source 1..24: mol_type = other DNA
gtgcgactcaatattgagtcgcac

SEQ ID NO: 2404 - DNA, 24 bp, synthetic construct
  misc_feature 1..24: note = Description of Artificial Sequence: Syntheticoligonucleotide
  source 1..24: mol_type = other DNA
gggtgactcaatattgagtcaccc

SEQ ID NO: 2405 - DNA, 24 bp, synthetic construct
  misc_feature 1..24: note = Description of Artificial Sequence: Syntheticoligonucleotide
  source 1..24: mol_type = other DNA
acgggactcaatattgagtcccgt

SEQ ID NO: 2406 - DNA, 24 bp, synthetic construct
  misc_feature 1..24: note = Description of Artificial Sequence: Syntheticoligonucleotide
  source 1..24: mol_type = other DNA
cagggactcaatattgagtccctg

SEQ ID NO: 2407 - DNA, 24 bp, synthetic construct
  misc_feature 1..24: note = Description of Artificial Sequence: Syntheticoligonucleotide
  source 1..24: mol_type = other DNA
ccaggactcaatattgagtcctgg

SEQ ID NO: 2408 - DNA, 24 bp, synthetic construct
  misc_feature 1..24: note = Description of Artificial Sequence: Syntheticoligonucleotide
  source 1..24: mol_type = other DNA
ccgagactcaatattgagtctcgg

SEQ ID NO: 2409 - DNA, 24 bp, synthetic construct
  misc_feature 1..24: note = Description of Artificial Sequence: Syntheticoligonucleotide
  source 1..24: mol_type = other DNA
tcgggactcaatattgagtcccga

SEQ ID NO: 2410 - DNA, 24 bp, synthetic construct
  misc_feature 1..24: note = Description of Artificial Sequence: Syntheticoligonucleotide
  source 1..24: mol_type = other DNA
ctgggactcaatattgagtcccag

SEQ ID NO: 2411 - DNA, 24 bp, synthetic construct
  misc_feature 1..24: note = Description of Artificial Sequence: Syntheticoligonucleotide
  source 1..24: mol_type = other DNA
cctggactcaatattgagtccagg

SEQ ID NO: 2412 - DNA, 24 bp, synthetic construct
  misc_feature 1..24: note = Description of Artificial Sequence: Syntheticoligonucleotide
  source 1..24: mol_type = other DNA
ccgtgactcaatattgagtcacgg

SEQ ID NO: 2413 - DNA, 24 bp, synthetic construct
  misc_feature 1..24: note = Description of Artificial Sequence: Syntheticoligonucleotide
  source 1..24: mol_type = other DNA
cggcgactcaatattgagtcgccg

SEQ ID NO: 2414 - DNA, 24 bp, synthetic construct
  misc_feature 1..24: note = Description of Artificial Sequence: Syntheticoligonucleotide
  source 1..24: mol_type = other DNA
cagcgactcaatattgagtcgctg

SEQ ID NO: 2415 - DNA, 24 bp, synthetic construct
  misc_feature 1..24: note = Description of Artificial Sequence: Syntheticoligonucleotide
  source 1..24: mol_type = other DNA
cgacgactcaatattgagtcgtcg

SEQ ID NO: 2416 - DNA, 24 bp, synthetic construct
  misc_feature 1..24: note = Description of Artificial Sequence: Syntheticoligonucleotide
  source 1..24: mol_type = other DNA
cggagactcaatattgagtctccg

SEQ ID NO: 2417 - DNA, 24 bp, synthetic construct
  misc_feature 1..24: note = Description of Artificial Sequence: Syntheticoligonucleotide
  source 1..24: mol_type = other DNA
ctgcgactcaatattgagtcgcag

SEQ ID NO: 2418 - DNA, 24 bp, synthetic construct
  misc_feature 1..24: note = Description of Artificial Sequence: Syntheticoligonucleotide
  source 1..24: mol_type = other DNA
cggtgactcaatattgagtcaccg

SEQ ID NO: 2419 - DNA, 24 bp, synthetic construct
  misc_feature 1..24: note = Description of Artificial Sequence: Syntheticoligonucleotide
  source 1..24: mol_type = other DNA
cacggactcaatattgagtccgtg

SEQ ID NO: 2420 - DNA, 24 bp, synthetic construct
  misc_feature 1..24: note = Description of Artificial Sequence: Syntheticoligonucleotide
  source 1..24: mol_type = other DNA
cccagactcaatattgagtctggg

SEQ ID NO: 2421 - DNA, 24 bp, synthetic construct
  misc_feature 1..24: note = Description of Artificial Sequence: Syntheticoligonucleotide
  source 1..24: mol_type = other DNA
ctcggactcaatattgagtccgag

SEQ ID NO: 2422 - DNA, 24 bp, synthetic construct
  misc_feature 1..24: note = Description of Artificial Sequence: Syntheticoligonucleotide
  source 1..24: mol_type = other DNA
ccctgactcaatattgagtcaggg

SEQ ID NO: 2423 - DNA, 24 bp, synthetic construct
  misc_feature 1..24: note = Description of Artificial Sequence: Syntheticoligonucleotide
  source 1..24: mol_type = other DNA
ccacgactcaatattgagtcgtgg

SEQ ID NO: 2424 - DNA, 24 bp, synthetic construct
  misc_feature 1..24: note = Description of Artificial Sequence: Syntheticoligonucleotide
  source 1..24: mol_type = other DNA
agccgactcaatattgagtcggct

SEQ ID NO: 2425 - DNA, 24 bp, synthetic construct
  misc_feature 1..24: note = Description of Artificial Sequence: Syntheticoligonucleotide
  source 1..24: mol_type = other DNA
tgccgactcaatattgagtcggca

SEQ ID NO: 2426 - DNA, 24 bp, synthetic construct
  misc_feature 1..24: note = Description of Artificial Sequence: Syntheticoligonucleotide
  source 1..24: mol_type = other DNA
gcgagactcaatattgagtctcgc

SEQ ID NO: 2427 - DNA, 24 bp, synthetic construct
  misc_feature 1..24: note = Description of Artificial Sequence: Syntheticoligonucleotide
  source 1..24: mol_type = other DNA
gcgtgactcaatattgagtcacgc

SEQ ID NO: 2428 - DNA, 24 bp, synthetic construct
  misc_feature 1..24: note = Description of Artificial Sequence: Syntheticoligonucleotide
  source 1..24: mol_type = other DNA
gcaggactcaatattgagtcctgc

SEQ ID NO: 2429 - DNA, 24 bp, synthetic construct
  misc_feature 1..24: note = Description of Artificial Sequence: Syntheticoligonucleotide
  source 1..24: mol_type = other DNA
gctggactcaatattgagtccagc

SEQ ID NO: 2430 - DNA, 24 bp, synthetic construct
  misc_feature 1..24: note = Description of Artificial Sequence: Syntheticoligonucleotide
  source 1..24: mol_type = other DNA
cgaggactcaatattgagtcctcg

SEQ ID NO: 2431 - DNA, 24 bp, synthetic construct
  misc_feature 1..24: note = Description of Artificial Sequence: Syntheticoligonucleotide
  source 1..24: mol_type = other DNA
cgtggactcaatattgagtccacg

SEQ ID NO: 2432 - DNA, 24 bp, synthetic construct
  misc_feature 1..24: note = Description of Artificial Sequence: Syntheticoligonucleotide
  source 1..24: mol_type = other DNA
caccgactcaatattgagtcggtg

SEQ ID NO: 2433 - DNA, 24 bp, synthetic construct
  misc_feature 1..24: note = Description of Artificial Sequence: Syntheticoligonucleotide
  source 1..24: mol_type = other DNA
ctccgactcaatattgagtcggag

SEQ ID NO: 2434 - DNA, 24 bp, synthetic construct
  misc_feature 1..24: note = Description of Artificial Sequence: Syntheticoligonucleotide
  source 1..24: mol_type = other DNA
gcgggactcaatattgagtcccgc

SEQ ID NO: 2435 - DNA, 24 bp, synthetic construct
  misc_feature 1..24: note = Description of Artificial Sequence: Syntheticoligonucleotide
  source 1..24: mol_type = other DNA
gagggactcaatattgagtccctc

SEQ ID NO: 2436 - DNA, 24 bp, synthetic construct
  misc_feature 1..24: note = Description of Artificial Sequence: Syntheticoligonucleotide
  source 1..24: mol_type = other DNA
gtgggactcaatattgagtcccac

SEQ ID NO: 2437 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcaagcttgagtcnnnn

SEQ ID NO: 2438 - DNA, 24 bp, synthetic construct
  misc_feature 1..24: note = Description of Artificial Sequence: Syntheticoligonucleotide
  source 1..24: mol_type = other DNA
ggcggactcaagcttgagtccgcc

SEQ ID NO: 2439 - DNA, 24 bp, synthetic construct
  misc_feature 1..24: note = Description of Artificial Sequence: Syntheticoligonucleotide
  source 1..24: mol_type = other DNA
agcggactcaagcttgagtccgct

SEQ ID NO: 2440 - DNA, 24 bp, synthetic construct
  misc_feature 1..24: note = Description of Artificial Sequence: Syntheticoligonucleotide
  source 1..24: mol_type = other DNA
gacggactcaagcttgagtccgtc

SEQ ID NO: 2441 - DNA, 24 bp, synthetic construct
  misc_feature 1..24: note = Description of Artificial Sequence: Syntheticoligonucleotide
  source 1..24: mol_type = other DNA
ggaggactcaagcttgagtcctcc

SEQ ID NO: 2442 - DNA, 24 bp, synthetic construct
  misc_feature 1..24: note = Description of Artificial Sequence: Syntheticoligonucleotide
  source 1..24: mol_type = other DNA
ggcagactcaagcttgagtctgcc

SEQ ID NO: 2443 - DNA, 24 bp, synthetic construct
  misc_feature 1..24: note = Description of Artificial Sequence: Syntheticoligonucleotide
  source 1..24: mol_type = other DNA
tgcggactcaagcttgagtccgca

SEQ ID NO: 2444 - DNA, 24 bp, synthetic construct
  misc_feature 1..24: note = Description of Artificial Sequence: Syntheticoligonucleotide
  source 1..24: mol_type = other DNA
gtcggactcaagcttgagtccgac

SEQ ID NO: 2445 - DNA, 24 bp, synthetic construct
  misc_feature 1..24: note = Description of Artificial Sequence: Syntheticoligonucleotide
  source 1..24: mol_type = other DNA
ggtggactcaagcttgagtccacc

SEQ ID NO: 2446 - DNA, 24 bp, synthetic construct
  misc_feature 1..24: note = Description of Artificial Sequence: Syntheticoligonucleotide
  source 1..24: mol_type = other DNA
ggctgactcaagcttgagtcagcc

SEQ ID NO: 2447 - DNA, 24 bp, synthetic construct
  misc_feature 1..24: note = Description of Artificial Sequence: Syntheticoligonucleotide
  source 1..24: mol_type = other DNA
gcccgactcaagcttgagtcgggc

SEQ ID NO: 2448 - DNA, 24 bp, synthetic construct
  misc_feature 1..24: note = Description of Artificial Sequence: Syntheticoligonucleotide
  source 1..24: mol_type = other DNA
acccgactcaagcttgagtcgggt

SEQ ID NO: 2449 - DNA, 24 bp, synthetic construct
  misc_feature 1..24: note = Description of Artificial Sequence: Syntheticoligonucleotide
  source 1..24: mol_type = other DNA
gaccgactcaagcttgagtcggtc

SEQ ID NO: 2450 - DNA, 24 bp, synthetic construct
  misc_feature 1..24: note = Description of Artificial Sequence: Syntheticoligonucleotide
  source 1..24: mol_type = other DNA
gcacgactcaagcttgagtcgtgc

SEQ ID NO: 2451 - DNA, 24 bp, synthetic construct
  misc_feature 1..24: note = Description of Artificial Sequence: Syntheticoligonucleotide
  source 1..24: mol_type = other DNA
gccagactcaagcttgagtctggc

SEQ ID NO: 2452 - DNA, 24 bp, synthetic construct
  misc_feature 1..24: note = Description of Artificial Sequence: Syntheticoligonucleotide
  source 1..24: mol_type = other DNA
tcccgactcaagcttgagtcggga

SEQ ID NO: 2453 - DNA, 24 bp, synthetic construct
  misc_feature 1..24: note = Description of Artificial Sequence: Syntheticoligonucleotide
  source 1..24: mol_type = other DNA
gtccgactcaagcttgagtcggac

SEQ ID NO: 2454 - DNA, 24 bp, synthetic construct
  misc_feature 1..24: note = Description of Artificial Sequence: Syntheticoligonucleotide
  source 1..24: mol_type = other DNA
gcctgactcaagcttgagtcaggc

SEQ ID NO: 2455 - DNA, 24 bp, synthetic construct
  misc_feature 1..24: note = Description of Artificial Sequence: Syntheticoligonucleotide
  source 1..24: mol_type = other DNA
gggcgactcaagcttgagtcgccc

SEQ ID NO: 2456 - DNA, 24 bp, synthetic construct
  misc_feature 1..24: note = Description of Artificial Sequence: Syntheticoligonucleotide
  source 1..24: mol_type = other DNA
aggcgactcaagcttgagtcgcct

SEQ ID NO: 2457 - DNA, 24 bp, synthetic construct
  misc_feature 1..24: note = Description of Artificial Sequence: Syntheticoligonucleotide
  source 1..24: mol_type = other DNA
gagcgactcaagcttgagtcgctc

SEQ ID NO: 2458 - DNA, 24 bp, synthetic construct
  misc_feature 1..24: note = Description of Artificial Sequence: Syntheticoligonucleotide
  source 1..24: mol_type = other DNA
ggacgactcaagcttgagtcgtcc

SEQ ID NO: 2459 - DNA, 24 bp, synthetic construct
  misc_feature 1..24: note = Description of Artificial Sequence: Syntheticoligonucleotide
  source 1..24: mol_type = other DNA
gggagactcaagcttgagtctccc

SEQ ID NO: 2460 - DNA, 24 bp, synthetic construct
  misc_feature 1..24: note = Description of Artificial Sequence: Syntheticoligonucleotide
  source 1..24: mol_type = other DNA
tggcgactcaagcttgagtcgcca

SEQ ID NO: 2461 - DNA, 24 bp, synthetic construct
  misc_feature 1..24: note = Description of Artificial Sequence: Syntheticoligonucleotide
  source 1..24: mol_type = other DNA
gtgcgactcaagcttgagtcgcac

SEQ ID NO: 2462 - DNA, 24 bp, synthetic construct
  misc_feature 1..24: note = Description of Artificial Sequence: Syntheticoligonucleotide
  source 1..24: mol_type = other DNA
gggtgactcaagcttgagtcaccc

SEQ ID NO: 2463 - DNA, 24 bp, synthetic construct
  misc_feature 1..24: note = Description of Artificial Sequence: Syntheticoligonucleotide
  source 1..24: mol_type = other DNA
acgggactcaagcttgagtcccgt

SEQ ID NO: 2464 - DNA, 24 bp, synthetic construct
  misc_feature 1..24: note = Description of Artificial Sequence: Syntheticoligonucleotide
  source 1..24: mol_type = other DNA
cagggactcaagcttgagtccctg

SEQ ID NO: 2465 - DNA, 24 bp, synthetic construct
  misc_feature 1..24: note = Description of Artificial Sequence: Syntheticoligonucleotide
  source 1..24: mol_type = other DNA
ccaggactcaagcttgagtcctgg

SEQ ID NO: 2466 - DNA, 24 bp, synthetic construct
  misc_feature 1..24: note = Description of Artificial Sequence: Syntheticoligonucleotide
  source 1..24: mol_type = other DNA
ccgagactcaagcttgagtctcgg

SEQ ID NO: 2467 - DNA, 24 bp, synthetic construct
  misc_feature 1..24: note = Description of Artificial Sequence: Syntheticoligonucleotide
  source 1..24: mol_type = other DNA
tcgggactcaagcttgagtcccga

SEQ ID NO: 2468 - DNA, 24 bp, synthetic construct
  misc_feature 1..24: note = Description of Artificial Sequence: Syntheticoligonucleotide
  source 1..24: mol_type = other DNA
ctgggactcaagcttgagtcccag

SEQ ID NO: 2469 - DNA, 24 bp, synthetic construct
  misc_feature 1..24: note = Description of Artificial Sequence: Syntheticoligonucleotide
  source 1..24: mol_type = other DNA
cctggactcaagcttgagtccagg

SEQ ID NO: 2470 - DNA, 24 bp, synthetic construct
  misc_feature 1..24: note = Description of Artificial Sequence: Syntheticoligonucleotide
  source 1..24: mol_type = other DNA
ccgtgactcaagcttgagtcacgg

SEQ ID NO: 2471 - DNA, 24 bp, synthetic construct
  misc_feature 1..24: note = Description of Artificial Sequence: Syntheticoligonucleotide
  source 1..24: mol_type = other DNA
cggcgactcaagcttgagtcgccg

SEQ ID NO: 2472 - DNA, 24 bp, synthetic construct
  misc_feature 1..24: note = Description of Artificial Sequence: Syntheticoligonucleotide
  source 1..24: mol_type = other DNA
cagcgactcaagcttgagtcgctg

SEQ ID NO: 2473 - DNA, 24 bp, synthetic construct
  misc_feature 1..24: note = Description of Artificial Sequence: Syntheticoligonucleotide
  source 1..24: mol_type = other DNA
cgacgactcaagcttgagtcgtcg

SEQ ID NO: 2474 - DNA, 24 bp, synthetic construct
  misc_feature 1..24: note = Description of Artificial Sequence: Syntheticoligonucleotide
  source 1..24: mol_type = other DNA
cggagactcaagcttgagtctccg

SEQ ID NO: 2475 - DNA, 24 bp, synthetic construct
  misc_feature 1..24: note = Description of Artificial Sequence: Syntheticoligonucleotide
  source 1..24: mol_type = other DNA
ctgcgactcaagcttgagtcgcag

SEQ ID NO: 2476 - DNA, 24 bp, synthetic construct
  misc_feature 1..24: note = Description of Artificial Sequence: Syntheticoligonucleotide
  source 1..24: mol_type = other DNA
cggtgactcaagcttgagtcaccg

SEQ ID NO: 2477 - DNA, 24 bp, synthetic construct
  misc_feature 1..24: note = Description of Artificial Sequence: Syntheticoligonucleotide
  source 1..24: mol_type = other DNA
cacggactcaagcttgagtccgtg

SEQ ID NO: 2478 - DNA, 24 bp, synthetic construct
  misc_feature 1..24: note = Description of Artificial Sequence: Syntheticoligonucleotide
  source 1..24: mol_type = other DNA
cccagactcaagcttgagtctggg

SEQ ID NO: 2479 - DNA, 24 bp, synthetic construct
  misc_feature 1..24: note = Description of Artificial Sequence: Syntheticoligonucleotide
  source 1..24: mol_type = other DNA
ctcggactcaagcttgagtccgag

SEQ ID NO: 2480 - DNA, 24 bp, synthetic construct
  misc_feature 1..24: note = Description of Artificial Sequence: Syntheticoligonucleotide
  source 1..24: mol_type = other DNA
ccctgactcaagcttgagtcaggg

SEQ ID NO: 2481 - DNA, 24 bp, synthetic construct
  misc_feature 1..24: note = Description of Artificial Sequence: Syntheticoligonucleotide
  source 1..24: mol_type = other DNA
ccacgactcaagcttgagtcgtgg

SEQ ID NO: 2482 - DNA, 24 bp, synthetic construct
  misc_feature 1..24: note = Description of Artificial Sequence: Syntheticoligonucleotide
  source 1..24: mol_type = other DNA
agccgactcaagcttgagtcggct

SEQ ID NO: 2483 - DNA, 24 bp, synthetic construct
  misc_feature 1..24: note = Description of Artificial Sequence: Syntheticoligonucleotide
  source 1..24: mol_type = other DNA
tgccgactcaagcttgagtcggca

SEQ ID NO: 2484 - DNA, 24 bp, synthetic construct
  misc_feature 1..24: note = Description of Artificial Sequence: Syntheticoligonucleotide
  source 1..24: mol_type = other DNA
gcgagactcaagcttgagtctcgc

SEQ ID NO: 2485 - DNA, 24 bp, synthetic construct
  misc_feature 1..24: note = Description of Artificial Sequence: Syntheticoligonucleotide
  source 1..24: mol_type = other DNA
gcgtgactcaagcttgagtcacgc

SEQ ID NO: 2486 - DNA, 24 bp, synthetic construct
  misc_feature 1..24: note = Description of Artificial Sequence: Syntheticoligonucleotide
  source 1..24: mol_type = other DNA
gcaggactcaagcttgagtcctgc

SEQ ID NO: 2487 - DNA, 24 bp, synthetic construct
  misc_feature 1..24: note = Description of Artificial Sequence: Syntheticoligonucleotide
  source 1..24: mol_type = other DNA
gctggactcaagcttgagtccagc

SEQ ID NO: 2488 - DNA, 24 bp, synthetic construct
  misc_feature 1..24: note = Description of Artificial Sequence: Syntheticoligonucleotide
  source 1..24: mol_type = other DNA
cgaggactcaagcttgagtcctcg

SEQ ID NO: 2489 - DNA, 24 bp, synthetic construct
  misc_feature 1..24: note = Description of Artificial Sequence: Syntheticoligonucleotide
  source 1..24: mol_type = other DNA
cgtggactcaagcttgagtccacg

SEQ ID NO: 2490 - DNA, 24 bp, synthetic construct
  misc_feature 1..24: note = Description of Artificial Sequence: Syntheticoligonucleotide
  source 1..24: mol_type = other DNA
caccgactcaagcttgagtcggtg

SEQ ID NO: 2491 - DNA, 24 bp, synthetic construct
  misc_feature 1..24: note = Description of Artificial Sequence: Syntheticoligonucleotide
  source 1..24: mol_type = other DNA
ctccgactcaagcttgagtcggag

SEQ ID NO: 2492 - DNA, 24 bp, synthetic construct
  misc_feature 1..24: note = Description of Artificial Sequence: Syntheticoligonucleotide
  source 1..24: mol_type = other DNA
gcgggactcaagcttgagtcccgc

SEQ ID NO: 2493 - DNA, 24 bp, synthetic construct
  misc_feature 1..24: note = Description of Artificial Sequence: Syntheticoligonucleotide
  source 1..24: mol_type = other DNA
gagggactcaagcttgagtccctc

SEQ ID NO: 2494 - DNA, 24 bp, synthetic construct
  misc_feature 1..24: note = Description of Artificial Sequence: Syntheticoligonucleotide
  source 1..24: mol_type = other DNA
gtgggactcaagcttgagtcccac

SEQ ID NO: 2495 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcaacgttgagtcnnnn

SEQ ID NO: 2496 - DNA, 24 bp, synthetic construct
  misc_feature 1..24: note = Description of Artificial Sequence: Syntheticoligonucleotide
  source 1..24: mol_type = other DNA
ggcggactcaacgttgagtccgcc

SEQ ID NO: 2497 - DNA, 24 bp, synthetic construct
  misc_feature 1..24: note = Description of Artificial Sequence: Syntheticoligonucleotide
  source 1..24: mol_type = other DNA
agcggactcaacgttgagtccgct

SEQ ID NO: 2498 - DNA, 24 bp, synthetic construct
  misc_feature 1..24: note = Description of Artificial Sequence: Syntheticoligonucleotide
  source 1..24: mol_type = other DNA
gacggactcaacgttgagtccgtc

SEQ ID NO: 2499 - DNA, 24 bp, synthetic construct
  misc_feature 1..24: note = Description of Artificial Sequence: Syntheticoligonucleotide
  source 1..24: mol_type = other DNA
ggaggactcaacgttgagtcctcc

SEQ ID NO: 2500 - DNA, 24 bp, synthetic construct
  misc_feature 1..24: note = Description of Artificial Sequence: Syntheticoligonucleotide
  source 1..24: mol_type = other DNA
ggcagactcaacgttgagtctgcc

SEQ ID NO: 2501 - DNA, 24 bp, synthetic construct
  misc_feature 1..24: note = Description of Artificial Sequence: Syntheticoligonucleotide
  source 1..24: mol_type = other DNA
tgcggactcaacgttgagtccgca

SEQ ID NO: 2502 - DNA, 24 bp, synthetic construct
  misc_feature 1..24: note = Description of Artificial Sequence: Syntheticoligonucleotide
  source 1..24: mol_type = other DNA
gtcggactcaacgttgagtccgac

SEQ ID NO: 2503 - DNA, 24 bp, synthetic construct
  misc_feature 1..24: note = Description of Artificial Sequence: Syntheticoligonucleotide
  source 1..24: mol_type = other DNA
ggtggactcaacgttgagtccacc

SEQ ID NO: 2504 - DNA, 24 bp, synthetic construct
  misc_feature 1..24: note = Description of Artificial Sequence: Syntheticoligonucleotide
  source 1..24: mol_type = other DNA
ggctgactcaacgttgagtcagcc

SEQ ID NO: 2505 - DNA, 24 bp, synthetic construct
  misc_feature 1..24: note = Description of Artificial Sequence: Syntheticoligonucleotide
  source 1..24: mol_type = other DNA
gcccgactcaacgttgagtcgggc

SEQ ID NO: 2506 - DNA, 24 bp, synthetic construct
  misc_feature 1..24: note = Description of Artificial Sequence: Syntheticoligonucleotide
  source 1..24: mol_type = other DNA
acccgactcaacgttgagtcgggt

SEQ ID NO: 2507 - DNA, 24 bp, synthetic construct
  misc_feature 1..24: note = Description of Artificial Sequence: Syntheticoligonucleotide
  source 1..24: mol_type = other DNA
gaccgactcaacgttgagtcggtc

SEQ ID NO: 2508 - DNA, 24 bp, synthetic construct
  misc_feature 1..24: note = Description of Artificial Sequence: Syntheticoligonucleotide
  source 1..24: mol_type = other DNA
gcacgactcaacgttgagtcgtgc

SEQ ID NO: 2509 - DNA, 24 bp, synthetic construct
  misc_feature 1..24: note = Description of Artificial Sequence: Syntheticoligonucleotide
  source 1..24: mol_type = other DNA
gccagactcaacgttgagtctggc

SEQ ID NO: 2510 - DNA, 24 bp, synthetic construct
  misc_feature 1..24: note = Description of Artificial Sequence: Syntheticoligonucleotide
  source 1..24: mol_type = other DNA
tcccgactcaacgttgagtcggga

SEQ ID NO: 2511 - DNA, 24 bp, synthetic construct
  misc_feature 1..24: note = Description of Artificial Sequence: Syntheticoligonucleotide
  source 1..24: mol_type = other DNA
gtccgactcaacgttgagtcggac

SEQ ID NO: 2512 - DNA, 24 bp, synthetic construct
  misc_feature 1..24: note = Description of Artificial Sequence: Syntheticoligonucleotide
  source 1..24: mol_type = other DNA
gcctgactcaacgttgagtcaggc

SEQ ID NO: 2513 - DNA, 24 bp, synthetic construct
  misc_feature 1..24: note = Description of Artificial Sequence: Syntheticoligonucleotide
  source 1..24: mol_type = other DNA
gggcgactcaacgttgagtcgccc

SEQ ID NO: 2514 - DNA, 24 bp, synthetic construct
  misc_feature 1..24: note = Description of Artificial Sequence: Syntheticoligonucleotide
  source 1..24: mol_type = other DNA
aggcgactcaacgttgagtcgcct

SEQ ID NO: 2515 - DNA, 24 bp, synthetic construct
  misc_feature 1..24: note = Description of Artificial Sequence: Syntheticoligonucleotide
  source 1..24: mol_type = other DNA
gagcgactcaacgttgagtcgctc

SEQ ID NO: 2516 - DNA, 24 bp, synthetic construct
  misc_feature 1..24: note = Description of Artificial Sequence: Syntheticoligonucleotide
  source 1..24: mol_type = other DNA
ggacgactcaacgttgagtcgtcc

SEQ ID NO: 2517 - DNA, 24 bp, synthetic construct
  misc_feature 1..24: note = Description of Artificial Sequence: Syntheticoligonucleotide
  source 1..24: mol_type = other DNA
gggagactcaacgttgagtctccc

SEQ ID NO: 2518 - DNA, 24 bp, synthetic construct
  misc_feature 1..24: note = Description of Artificial Sequence: Syntheticoligonucleotide
  source 1..24: mol_type = other DNA
tggcgactcaacgttgagtcgcca

SEQ ID NO: 2519 - DNA, 24 bp, synthetic construct
  misc_feature 1..24: note = Description of Artificial Sequence: Syntheticoligonucleotide
  source 1..24: mol_type = other DNA
gtgcgactcaacgttgagtcgcac

SEQ ID NO: 2520 - DNA, 24 bp, synthetic construct
  misc_feature 1..24: note = Description of Artificial Sequence: Syntheticoligonucleotide
  source 1..24: mol_type = other DNA
gggtgactcaacgttgagtcaccc

SEQ ID NO: 2521 - DNA, 24 bp, synthetic construct
  misc_feature 1..24: note = Description of Artificial Sequence: Syntheticoligonucleotide
  source 1..24: mol_type = other DNA
acgggactcaacgttgagtcccgt

SEQ ID NO: 2522 - DNA, 24 bp, synthetic construct
  misc_feature 1..24: note = Description of Artificial Sequence: Syntheticoligonucleotide
  source 1..24: mol_type = other DNA
cagggactcaacgttgagtccctg

SEQ ID NO: 2523 - DNA, 24 bp, synthetic construct
  misc_feature 1..24: note = Description of Artificial Sequence: Syntheticoligonucleotide
  source 1..24: mol_type = other DNA
ccaggactcaacgttgagtcctgg

SEQ ID NO: 2524 - DNA, 24 bp, synthetic construct
  misc_feature 1..24: note = Description of Artificial Sequence: Syntheticoligonucleotide
  source 1..24: mol_type = other DNA
ccgagactcaacgttgagtctcgg

SEQ ID NO: 2525 - DNA, 24 bp, synthetic construct
  misc_feature 1..24: note = Description of Artificial Sequence: Syntheticoligonucleotide
  source 1..24: mol_type = other DNA
tcgggactcaacgttgagtcccga

SEQ ID NO: 2526 - DNA, 24 bp, synthetic construct
  misc_feature 1..24: note = Description of Artificial Sequence: Syntheticoligonucleotide
  source 1..24: mol_type = other DNA
ctgggactcaacgttgagtcccag

SEQ ID NO: 2527 - DNA, 24 bp, synthetic construct
  misc_feature 1..24: note = Description of Artificial Sequence: Syntheticoligonucleotide
  source 1..24: mol_type = other DNA
cctggactcaacgttgagtccagg

SEQ ID NO: 2528 - DNA, 24 bp, synthetic construct
  misc_feature 1..24: note = Description of Artificial Sequence: Syntheticoligonucleotide
  source 1..24: mol_type = other DNA
ccgtgactcaacgttgagtcacgg

SEQ ID NO: 2529 - DNA, 24 bp, synthetic construct
  misc_feature 1..24: note = Description of Artificial Sequence: Syntheticoligonucleotide
  source 1..24: mol_type = other DNA
cggcgactcaacgttgagtcgccg

SEQ ID NO: 2530 - DNA, 24 bp, synthetic construct
  misc_feature 1..24: note = Description of Artificial Sequence: Syntheticoligonucleotide
  source 1..24: mol_type = other DNA
cagcgactcaacgttgagtcgctg

SEQ ID NO: 2531 - DNA, 24 bp, synthetic construct
  misc_feature 1..24: note = Description of Artificial Sequence: Syntheticoligonucleotide
  source 1..24: mol_type = other DNA
cgacgactcaacgttgagtcgtcg

SEQ ID NO: 2532 - DNA, 24 bp, synthetic construct
  misc_feature 1..24: note = Description of Artificial Sequence: Syntheticoligonucleotide
  source 1..24: mol_type = other DNA
cggagactcaacgttgagtctccg

SEQ ID NO: 2533 - DNA, 24 bp, synthetic construct
  misc_feature 1..24: note = Description of Artificial Sequence: Syntheticoligonucleotide
  source 1..24: mol_type = other DNA
ctgcgactcaacgttgagtcgcag

SEQ ID NO: 2534 - DNA, 24 bp, synthetic construct
  misc_feature 1..24: note = Description of Artificial Sequence: Syntheticoligonucleotide
  source 1..24: mol_type = other DNA
cggtgactcaacgttgagtcaccg

SEQ ID NO: 2535 - DNA, 24 bp, synthetic construct
  misc_feature 1..24: note = Description of Artificial Sequence: Syntheticoligonucleotide
  source 1..24: mol_type = other DNA
cacggactcaacgttgagtccgtg

SEQ ID NO: 2536 - DNA, 24 bp, synthetic construct
  misc_feature 1..24: note = Description of Artificial Sequence: Syntheticoligonucleotide
  source 1..24: mol_type = other DNA
cccagactcaacgttgagtctggg

SEQ ID NO: 2537 - DNA, 24 bp, synthetic construct
  misc_feature 1..24: note = Description of Artificial Sequence: Syntheticoligonucleotide
  source 1..24: mol_type = other DNA
ctcggactcaacgttgagtccgag

SEQ ID NO: 2538 - DNA, 24 bp, synthetic construct
  misc_feature 1..24: note = Description of Artificial Sequence: Syntheticoligonucleotide
  source 1..24: mol_type = other DNA
ccctgactcaacgttgagtcaggg

SEQ ID NO: 2539 - DNA, 24 bp, synthetic construct
  misc_feature 1..24: note = Description of Artificial Sequence: Syntheticoligonucleotide
  source 1..24: mol_type = other DNA
ccacgactcaacgttgagtcgtgg

SEQ ID NO: 2540 - DNA, 24 bp, synthetic construct
  misc_feature 1..24: note = Description of Artificial Sequence: Syntheticoligonucleotide
  source 1..24: mol_type = other DNA
agccgactcaacgttgagtcggct

SEQ ID NO: 2541 - DNA, 24 bp, synthetic construct
  misc_feature 1..24: note = Description of Artificial Sequence: Syntheticoligonucleotide
  source 1..24: mol_type = other DNA
tgccgactcaacgttgagtcggca

SEQ ID NO: 2542 - DNA, 24 bp, synthetic construct
  misc_feature 1..24: note = Description of Artificial Sequence: Syntheticoligonucleotide
  source 1..24: mol_type = other DNA
gcgagactcaacgttgagtctcgc

SEQ ID NO: 2543 - DNA, 24 bp, synthetic construct
  misc_feature 1..24: note = Description of Artificial Sequence: Syntheticoligonucleotide
  source 1..24: mol_type = other DNA
gcgtgactcaacgttgagtcacgc

SEQ ID NO: 2544 - DNA, 24 bp, synthetic construct
  misc_feature 1..24: note = Description of Artificial Sequence: Syntheticoligonucleotide
  source 1..24: mol_type = other DNA
gcaggactcaacgttgagtcctgc

SEQ ID NO: 2545 - DNA, 24 bp, synthetic construct
  misc_feature 1..24: note = Description of Artificial Sequence: Syntheticoligonucleotide
  source 1..24: mol_type = other DNA
gctggactcaacgttgagtccagc

SEQ ID NO: 2546 - DNA, 24 bp, synthetic construct
  misc_feature 1..24: note = Description of Artificial Sequence: Syntheticoligonucleotide
  source 1..24: mol_type = other DNA
cgaggactcaacgttgagtcctcg

SEQ ID NO: 2547 - DNA, 24 bp, synthetic construct
  misc_feature 1..24: note = Description of Artificial Sequence: Syntheticoligonucleotide
  source 1..24: mol_type = other DNA
cgtggactcaacgttgagtccacg

SEQ ID NO: 2548 - DNA, 24 bp, synthetic construct
  misc_feature 1..24: note = Description of Artificial Sequence: Syntheticoligonucleotide
  source 1..24: mol_type = other DNA
caccgactcaacgttgagtcggtg

SEQ ID NO: 2549 - DNA, 24 bp, synthetic construct
  misc_feature 1..24: note = Description of Artificial Sequence: Syntheticoligonucleotide
  source 1..24: mol_type = other DNA
ctccgactcaacgttgagtcggag

SEQ ID NO: 2550 - DNA, 24 bp, synthetic construct
  misc_feature 1..24: note = Description of Artificial Sequence: Syntheticoligonucleotide
  source 1..24: mol_type = other DNA
gcgggactcaacgttgagtcccgc

SEQ ID NO: 2551 - DNA, 24 bp, synthetic construct
  misc_feature 1..24: note = Description of Artificial Sequence: Syntheticoligonucleotide
  source 1..24: mol_type = other DNA
gagggactcaacgttgagtccctc

SEQ ID NO: 2552 - DNA, 24 bp, synthetic construct
  misc_feature 1..24: note = Description of Artificial Sequence: Syntheticoligonucleotide
  source 1..24: mol_type = other DNA
gtgggactcaacgttgagtcccac

SEQ ID NO: 2553 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactctaattagagtcnnnn

SEQ ID NO: 2554 - DNA, 24 bp, synthetic construct
  misc_feature 1..24: note = Description of Artificial Sequence: Syntheticoligonucleotide
  source 1..24: mol_type = other DNA
ggcggactctaattagagtccgcc

SEQ ID NO: 2555 - DNA, 24 bp, synthetic construct
  misc_feature 1..24: note = Description of Artificial Sequence: Syntheticoligonucleotide
  source 1..24: mol_type = other DNA
agcggactctaattagagtccgct

SEQ ID NO: 2556 - DNA, 24 bp, synthetic construct
  misc_feature 1..24: note = Description of Artificial Sequence: Syntheticoligonucleotide
  source 1..24: mol_type = other DNA
gacggactctaattagagtccgtc

SEQ ID NO: 2557 - DNA, 24 bp, synthetic construct
  misc_feature 1..24: note = Description of Artificial Sequence: Syntheticoligonucleotide
  source 1..24: mol_type = other DNA
ggaggactctaattagagtcctcc

SEQ ID NO: 2558 - DNA, 24 bp, synthetic construct
  misc_feature 1..24: note = Description of Artificial Sequence: Syntheticoligonucleotide
  source 1..24: mol_type = other DNA
ggcagactctaattagagtctgcc

SEQ ID NO: 2559 - DNA, 24 bp, synthetic construct
  misc_feature 1..24: note = Description of Artificial Sequence: Syntheticoligonucleotide
  source 1..24: mol_type = other DNA
tgcggactctaattagagtccgca

SEQ ID NO: 2560 - DNA, 24 bp, synthetic construct
  misc_feature 1..24: note = Description of Artificial Sequence: Syntheticoligonucleotide
  source 1..24: mol_type = other DNA
gtcggactctaattagagtccgac

SEQ ID NO: 2561 - DNA, 24 bp, synthetic construct
  misc_feature 1..24: note = Description of Artificial Sequence: Syntheticoligonucleotide
  source 1..24: mol_type = other DNA
ggtggactctaattagagtccacc

SEQ ID NO: 2562 - DNA, 24 bp, synthetic construct
  misc_feature 1..24: note = Description of Artificial Sequence: Syntheticoligonucleotide
  source 1..24: mol_type = other DNA
ggctgactctaattagagtcagcc

SEQ ID NO: 2563 - DNA, 24 bp, synthetic construct
  misc_feature 1..24: note = Description of Artificial Sequence: Syntheticoligonucleotide
  source 1..24: mol_type = other DNA
gcccgactctaattagagtcgggc

SEQ ID NO: 2564 - DNA, 24 bp, synthetic construct
  misc_feature 1..24: note = Description of Artificial Sequence: Syntheticoligonucleotide
  source 1..24: mol_type = other DNA
acccgactctaattagagtcgggt

SEQ ID NO: 2565 - DNA, 24 bp, synthetic construct
  misc_feature 1..24: note = Description of Artificial Sequence: Syntheticoligonucleotide
  source 1..24: mol_type = other DNA
gaccgactctaattagagtcggtc

SEQ ID NO: 2566 - DNA, 24 bp, synthetic construct
  misc_feature 1..24: note = Description of Artificial Sequence: Syntheticoligonucleotide
  source 1..24: mol_type = other DNA
gcacgactctaattagagtcgtgc

SEQ ID NO: 2567 - DNA, 24 bp, synthetic construct
  misc_feature 1..24: note = Description of Artificial Sequence: Syntheticoligonucleotide
  source 1..24: mol_type = other DNA
gccagactctaattagagtctggc

SEQ ID NO: 2568 - DNA, 24 bp, synthetic construct
  misc_feature 1..24: note = Description of Artificial Sequence: Syntheticoligonucleotide
  source 1..24: mol_type = other DNA
tcccgactctaattagagtcggga

SEQ ID NO: 2569 - DNA, 24 bp, synthetic construct
  misc_feature 1..24: note = Description of Artificial Sequence: Syntheticoligonucleotide
  source 1..24: mol_type = other DNA
gtccgactctaattagagtcggac

SEQ ID NO: 2570 - DNA, 24 bp, synthetic construct
  misc_feature 1..24: note = Description of Artificial Sequence: Syntheticoligonucleotide
  source 1..24: mol_type = other DNA
gcctgactctaattagagtcaggc

SEQ ID NO: 2571 - DNA, 24 bp, synthetic construct
  misc_feature 1..24: note = Description of Artificial Sequence: Syntheticoligonucleotide
  source 1..24: mol_type = other DNA
gggcgactctaattagagtcgccc

SEQ ID NO: 2572 - DNA, 24 bp, synthetic construct
  misc_feature 1..24: note = Description of Artificial Sequence: Syntheticoligonucleotide
  source 1..24: mol_type = other DNA
aggcgactctaattagagtcgcct

SEQ ID NO: 2573 - DNA, 24 bp, synthetic construct
  misc_feature 1..24: note = Description of Artificial Sequence: Syntheticoligonucleotide
  source 1..24: mol_type = other DNA
gagcgactctaattagagtcgctc

SEQ ID NO: 2574 - DNA, 24 bp, synthetic construct
  misc_feature 1..24: note = Description of Artificial Sequence: Syntheticoligonucleotide
  source 1..24: mol_type = other DNA
ggacgactctaattagagtcgtcc

SEQ ID NO: 2575 - DNA, 24 bp, synthetic construct
  misc_feature 1..24: note = Description of Artificial Sequence: Syntheticoligonucleotide
  source 1..24: mol_type = other DNA
gggagactctaattagagtctccc

SEQ ID NO: 2576 - DNA, 24 bp, synthetic construct
  misc_feature 1..24: note = Description of Artificial Sequence: Syntheticoligonucleotide
  source 1..24: mol_type = other DNA
tggcgactctaattagagtcgcca

SEQ ID NO: 2577 - DNA, 24 bp, synthetic construct
  misc_feature 1..24: note = Description of Artificial Sequence: Syntheticoligonucleotide
  source 1..24: mol_type = other DNA
gtgcgactctaattagagtcgcac

SEQ ID NO: 2578 - DNA, 24 bp, synthetic construct
  misc_feature 1..24: note = Description of Artificial Sequence: Syntheticoligonucleotide
  source 1..24: mol_type = other DNA
gggtgactctaattagagtcaccc

SEQ ID NO: 2579 - DNA, 24 bp, synthetic construct
  misc_feature 1..24: note = Description of Artificial Sequence: Syntheticoligonucleotide
  source 1..24: mol_type = other DNA
acgggactctaattagagtcccgt

SEQ ID NO: 2580 - DNA, 24 bp, synthetic construct
  misc_feature 1..24: note = Description of Artificial Sequence: Syntheticoligonucleotide
  source 1..24: mol_type = other DNA
cagggactctaattagagtccctg

SEQ ID NO: 2581 - DNA, 24 bp, synthetic construct
  misc_feature 1..24: note = Description of Artificial Sequence: Syntheticoligonucleotide
  source 1..24: mol_type = other DNA
ccaggactctaattagagtcctgg

SEQ ID NO: 2582 - DNA, 24 bp, synthetic construct
  misc_feature 1..24: note = Description of Artificial Sequence: Syntheticoligonucleotide
  source 1..24: mol_type = other DNA
ccgagactctaattagagtctcgg

SEQ ID NO: 2583 - DNA, 24 bp, synthetic construct
  misc_feature 1..24: note = Description of Artificial Sequence: Syntheticoligonucleotide
  source 1..24: mol_type = other DNA
tcgggactctaattagagtcccga

SEQ ID NO: 2584 - DNA, 24 bp, synthetic construct
  misc_feature 1..24: note = Description of Artificial Sequence: Syntheticoligonucleotide
  source 1..24: mol_type = other DNA
ctgggactctaattagagtcccag

SEQ ID NO: 2585 - DNA, 24 bp, synthetic construct
  misc_feature 1..24: note = Description of Artificial Sequence: Syntheticoligonucleotide
  source 1..24: mol_type = other DNA
cctggactctaattagagtccagg

SEQ ID NO: 2586 - DNA, 24 bp, synthetic construct
  misc_feature 1..24: note = Description of Artificial Sequence: Syntheticoligonucleotide
  source 1..24: mol_type = other DNA
ccgtgactctaattagagtcacgg

SEQ ID NO: 2587 - DNA, 24 bp, synthetic construct
  misc_feature 1..24: note = Description of Artificial Sequence: Syntheticoligonucleotide
  source 1..24: mol_type = other DNA
cggcgactctaattagagtcgccg

SEQ ID NO: 2588 - DNA, 24 bp, synthetic construct
  misc_feature 1..24: note = Description of Artificial Sequence: Syntheticoligonucleotide
  source 1..24: mol_type = other DNA
cagcgactctaattagagtcgctg

SEQ ID NO: 2589 - DNA, 24 bp, synthetic construct
  misc_feature 1..24: note = Description of Artificial Sequence: Syntheticoligonucleotide
  source 1..24: mol_type = other DNA
cgacgactctaattagagtcgtcg

SEQ ID NO: 2590 - DNA, 24 bp, synthetic construct
  misc_feature 1..24: note = Description of Artificial Sequence: Syntheticoligonucleotide
  source 1..24: mol_type = other DNA
cggagactctaattagagtctccg

SEQ ID NO: 2591 - DNA, 24 bp, synthetic construct
  misc_feature 1..24: note = Description of Artificial Sequence: Syntheticoligonucleotide
  source 1..24: mol_type = other DNA
ctgcgactctaattagagtcgcag

SEQ ID NO: 2592 - DNA, 24 bp, synthetic construct
  misc_feature 1..24: note = Description of Artificial Sequence: Syntheticoligonucleotide
  source 1..24: mol_type = other DNA
cggtgactctaattagagtcaccg

SEQ ID NO: 2593 - DNA, 24 bp, synthetic construct
  misc_feature 1..24: note = Description of Artificial Sequence: Syntheticoligonucleotide
  source 1..24: mol_type = other DNA
cacggactctaattagagtccgtg

SEQ ID NO: 2594 - DNA, 24 bp, synthetic construct
  misc_feature 1..24: note = Description of Artificial Sequence: Syntheticoligonucleotide
  source 1..24: mol_type = other DNA
cccagactctaattagagtctggg

SEQ ID NO: 2595 - DNA, 24 bp, synthetic construct
  misc_feature 1..24: note = Description of Artificial Sequence: Syntheticoligonucleotide
  source 1..24: mol_type = other DNA
ctcggactctaattagagtccgag

SEQ ID NO: 2596 - DNA, 24 bp, synthetic construct
  misc_feature 1..24: note = Description of Artificial Sequence: Syntheticoligonucleotide
  source 1..24: mol_type = other DNA
ccctgactctaattagagtcaggg

SEQ ID NO: 2597 - DNA, 24 bp, synthetic construct
  misc_feature 1..24: note = Description of Artificial Sequence: Syntheticoligonucleotide
  source 1..24: mol_type = other DNA
ccacgactctaattagagtcgtgg

SEQ ID NO: 2598 - DNA, 24 bp, synthetic construct
  misc_feature 1..24: note = Description of Artificial Sequence: Syntheticoligonucleotide
  source 1..24: mol_type = other DNA
agccgactctaattagagtcggct

SEQ ID NO: 2599 - DNA, 24 bp, synthetic construct
  misc_feature 1..24: note = Description of Artificial Sequence: Syntheticoligonucleotide
  source 1..24: mol_type = other DNA
tgccgactctaattagagtcggca

SEQ ID NO: 2600 - DNA, 24 bp, synthetic construct
  misc_feature 1..24: note = Description of Artificial Sequence: Syntheticoligonucleotide
  source 1..24: mol_type = other DNA
gcgagactctaattagagtctcgc

SEQ ID NO: 2601 - DNA, 24 bp, synthetic construct
  misc_feature 1..24: note = Description of Artificial Sequence: Syntheticoligonucleotide
  source 1..24: mol_type = other DNA
gcgtgactctaattagagtcacgc

SEQ ID NO: 2602 - DNA, 24 bp, synthetic construct
  misc_feature 1..24: note = Description of Artificial Sequence: Syntheticoligonucleotide
  source 1..24: mol_type = other DNA
gcaggactctaattagagtcctgc

SEQ ID NO: 2603 - DNA, 24 bp, synthetic construct
  misc_feature 1..24: note = Description of Artificial Sequence: Syntheticoligonucleotide
  source 1..24: mol_type = other DNA
gctggactctaattagagtccagc

SEQ ID NO: 2604 - DNA, 24 bp, synthetic construct
  misc_feature 1..24: note = Description of Artificial Sequence: Syntheticoligonucleotide
  source 1..24: mol_type = other DNA
cgaggactctaattagagtcctcg

SEQ ID NO: 2605 - DNA, 24 bp, synthetic construct
  misc_feature 1..24: note = Description of Artificial Sequence: Syntheticoligonucleotide
  source 1..24: mol_type = other DNA
cgtggactctaattagagtccacg

SEQ ID NO: 2606 - DNA, 24 bp, synthetic construct
  misc_feature 1..24: note = Description of Artificial Sequence: Syntheticoligonucleotide
  source 1..24: mol_type = other DNA
caccgactctaattagagtcggtg

SEQ ID NO: 2607 - DNA, 24 bp, synthetic construct
  misc_feature 1..24: note = Description of Artificial Sequence: Syntheticoligonucleotide
  source 1..24: mol_type = other DNA
ctccgactctaattagagtcggag

SEQ ID NO: 2608 - DNA, 24 bp, synthetic construct
  misc_feature 1..24: note = Description of Artificial Sequence: Syntheticoligonucleotide
  source 1..24: mol_type = other DNA
gcgggactctaattagagtcccgc

SEQ ID NO: 2609 - DNA, 24 bp, synthetic construct
  misc_feature 1..24: note = Description of Artificial Sequence: Syntheticoligonucleotide
  source 1..24: mol_type = other DNA
gagggactctaattagagtccctc

SEQ ID NO: 2610 - DNA, 24 bp, synthetic construct
  misc_feature 1..24: note = Description of Artificial Sequence: Syntheticoligonucleotide
  source 1..24: mol_type = other DNA
gtgggactctaattagagtcccac

SEQ ID NO: 2611 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactctatatagagtcnnnn

SEQ ID NO: 2612 - DNA, 24 bp, synthetic construct
  misc_feature 1..24: note = Description of Artificial Sequence: Syntheticoligonucleotide
  source 1..24: mol_type = other DNA
ggcggactctatatagagtccgcc

SEQ ID NO: 2613 - DNA, 24 bp, synthetic construct
  misc_feature 1..24: note = Description of Artificial Sequence: Syntheticoligonucleotide
  source 1..24: mol_type = other DNA
agcggactctatatagagtccgct

SEQ ID NO: 2614 - DNA, 24 bp, synthetic construct
  misc_feature 1..24: note = Description of Artificial Sequence: Syntheticoligonucleotide
  source 1..24: mol_type = other DNA
gacggactctatatagagtccgtc

SEQ ID NO: 2615 - DNA, 24 bp, synthetic construct
  misc_feature 1..24: note = Description of Artificial Sequence: Syntheticoligonucleotide
  source 1..24: mol_type = other DNA
ggaggactctatatagagtcctcc

SEQ ID NO: 2616 - DNA, 24 bp, synthetic construct
  misc_feature 1..24: note = Description of Artificial Sequence: Syntheticoligonucleotide
  source 1..24: mol_type = other DNA
ggcagactctatatagagtctgcc

SEQ ID NO: 2617 - DNA, 24 bp, synthetic construct
  misc_feature 1..24: note = Description of Artificial Sequence: Syntheticoligonucleotide
  source 1..24: mol_type = other DNA
tgcggactctatatagagtccgca

SEQ ID NO: 2618 - DNA, 24 bp, synthetic construct
  misc_feature 1..24: note = Description of Artificial Sequence: Syntheticoligonucleotide
  source 1..24: mol_type = other DNA
gtcggactctatatagagtccgac

SEQ ID NO: 2619 - DNA, 24 bp, synthetic construct
  misc_feature 1..24: note = Description of Artificial Sequence: Syntheticoligonucleotide
  source 1..24: mol_type = other DNA
ggtggactctatatagagtccacc

SEQ ID NO: 2620 - DNA, 24 bp, synthetic construct
  misc_feature 1..24: note = Description of Artificial Sequence: Syntheticoligonucleotide
  source 1..24: mol_type = other DNA
ggctgactctatatagagtcagcc

SEQ ID NO: 2621 - DNA, 24 bp, synthetic construct
  misc_feature 1..24: note = Description of Artificial Sequence: Syntheticoligonucleotide
  source 1..24: mol_type = other DNA
gcccgactctatatagagtcgggc

SEQ ID NO: 2622 - DNA, 24 bp, synthetic construct
  misc_feature 1..24: note = Description of Artificial Sequence: Syntheticoligonucleotide
  source 1..24: mol_type = other DNA
acccgactctatatagagtcgggt

SEQ ID NO: 2623 - DNA, 24 bp, synthetic construct
  misc_feature 1..24: note = Description of Artificial Sequence: Syntheticoligonucleotide
  source 1..24: mol_type = other DNA
gaccgactctatatagagtcggtc

SEQ ID NO: 2624 - DNA, 24 bp, synthetic construct
  misc_feature 1..24: note = Description of Artificial Sequence: Syntheticoligonucleotide
  source 1..24: mol_type = other DNA
gcacgactctatatagagtcgtgc

SEQ ID NO: 2625 - DNA, 24 bp, synthetic construct
  misc_feature 1..24: note = Description of Artificial Sequence: Syntheticoligonucleotide
  source 1..24: mol_type = other DNA
gccagactctatatagagtctggc

SEQ ID NO: 2626 - DNA, 24 bp, synthetic construct
  misc_feature 1..24: note = Description of Artificial Sequence: Syntheticoligonucleotide
  source 1..24: mol_type = other DNA
tcccgactctatatagagtcggga

SEQ ID NO: 2627 - DNA, 24 bp, synthetic construct
  misc_feature 1..24: note = Description of Artificial Sequence: Syntheticoligonucleotide
  source 1..24: mol_type = other DNA
gtccgactctatatagagtcggac

SEQ ID NO: 2628 - DNA, 24 bp, synthetic construct
  misc_feature 1..24: note = Description of Artificial Sequence: Syntheticoligonucleotide
  source 1..24: mol_type = other DNA
gcctgactctatatagagtcaggc

SEQ ID NO: 2629 - DNA, 24 bp, synthetic construct
  misc_feature 1..24: note = Description of Artificial Sequence: Syntheticoligonucleotide
  source 1..24: mol_type = other DNA
gggcgactctatatagagtcgccc

SEQ ID NO: 2630 - DNA, 24 bp, synthetic construct
  misc_feature 1..24: note = Description of Artificial Sequence: Syntheticoligonucleotide
  source 1..24: mol_type = other DNA
aggcgactctatatagagtcgcct

SEQ ID NO: 2631 - DNA, 24 bp, synthetic construct
  misc_feature 1..24: note = Description of Artificial Sequence: Syntheticoligonucleotide
  source 1..24: mol_type = other DNA
gagcgactctatatagagtcgctc

SEQ ID NO: 2632 - DNA, 24 bp, synthetic construct
  misc_feature 1..24: note = Description of Artificial Sequence: Syntheticoligonucleotide
  source 1..24: mol_type = other DNA
ggacgactctatatagagtcgtcc

SEQ ID NO: 2633 - DNA, 24 bp, synthetic construct
  misc_feature 1..24: note = Description of Artificial Sequence: Syntheticoligonucleotide
  source 1..24: mol_type = other DNA
gggagactctatatagagtctccc

SEQ ID NO: 2634 - DNA, 24 bp, synthetic construct
  misc_feature 1..24: note = Description of Artificial Sequence: Syntheticoligonucleotide
  source 1..24: mol_type = other DNA
tggcgactctatatagagtcgcca

SEQ ID NO: 2635 - DNA, 24 bp, synthetic construct
  misc_feature 1..24: note = Description of Artificial Sequence: Syntheticoligonucleotide
  source 1..24: mol_type = other DNA
gtgcgactctatatagagtcgcac

SEQ ID NO: 2636 - DNA, 24 bp, synthetic construct
  misc_feature 1..24: note = Description of Artificial Sequence: Syntheticoligonucleotide
  source 1..24: mol_type = other DNA
gggtgactctatatagagtcaccc

SEQ ID NO: 2637 - DNA, 24 bp, synthetic construct
  misc_feature 1..24: note = Description of Artificial Sequence: Syntheticoligonucleotide
  source 1..24: mol_type = other DNA
acgggactctatatagagtcccgt

SEQ ID NO: 2638 - DNA, 24 bp, synthetic construct
  misc_feature 1..24: note = Description of Artificial Sequence: Syntheticoligonucleotide
  source 1..24: mol_type = other DNA
cagggactctatatagagtccctg

SEQ ID NO: 2639 - DNA, 24 bp, synthetic construct
  misc_feature 1..24: note = Description of Artificial Sequence: Syntheticoligonucleotide
  source 1..24: mol_type = other DNA
ccaggactctatatagagtcctgg

SEQ ID NO: 2640 - DNA, 24 bp, synthetic construct
  misc_feature 1..24: note = Description of Artificial Sequence: Syntheticoligonucleotide
  source 1..24: mol_type = other DNA
ccgagactctatatagagtctcgg

SEQ ID NO: 2641 - DNA, 24 bp, synthetic construct
  misc_feature 1..24: note = Description of Artificial Sequence: Syntheticoligonucleotide
  source 1..24: mol_type = other DNA
tcgggactctatatagagtcccga

SEQ ID NO: 2642 - DNA, 24 bp, synthetic construct
  misc_feature 1..24: note = Description of Artificial Sequence: Syntheticoligonucleotide
  source 1..24: mol_type = other DNA
ctgggactctatatagagtcccag

SEQ ID NO: 2643 - DNA, 24 bp, synthetic construct
  misc_feature 1..24: note = Description of Artificial Sequence: Syntheticoligonucleotide
  source 1..24: mol_type = other DNA
cctggactctatatagagtccagg

SEQ ID NO: 2644 - DNA, 24 bp, synthetic construct
  misc_feature 1..24: note = Description of Artificial Sequence: Syntheticoligonucleotide
  source 1..24: mol_type = other DNA
ccgtgactctatatagagtcacgg

SEQ ID NO: 2645 - DNA, 24 bp, synthetic construct
  misc_feature 1..24: note = Description of Artificial Sequence: Syntheticoligonucleotide
  source 1..24: mol_type = other DNA
cggcgactctatatagagtcgccg

SEQ ID NO: 2646 - DNA, 24 bp, synthetic construct
  misc_feature 1..24: note = Description of Artificial Sequence: Syntheticoligonucleotide
  source 1..24: mol_type = other DNA
cagcgactctatatagagtcgctg

SEQ ID NO: 2647 - DNA, 24 bp, synthetic construct
  misc_feature 1..24: note = Description of Artificial Sequence: Syntheticoligonucleotide
  source 1..24: mol_type = other DNA
cgacgactctatatagagtcgtcg

SEQ ID NO: 2648 - DNA, 24 bp, synthetic construct
  misc_feature 1..24: note = Description of Artificial Sequence: Syntheticoligonucleotide
  source 1..24: mol_type = other DNA
cggagactctatatagagtctccg

SEQ ID NO: 2649 - DNA, 24 bp, synthetic construct
  misc_feature 1..24: note = Description of Artificial Sequence: Syntheticoligonucleotide
  source 1..24: mol_type = other DNA
ctgcgactctatatagagtcgcag

SEQ ID NO: 2650 - DNA, 24 bp, synthetic construct
  misc_feature 1..24: note = Description of Artificial Sequence: Syntheticoligonucleotide
  source 1..24: mol_type = other DNA
cggtgactctatatagagtcaccg

SEQ ID NO: 2651 - DNA, 24 bp, synthetic construct
  misc_feature 1..24: note = Description of Artificial Sequence: Syntheticoligonucleotide
  source 1..24: mol_type = other DNA
cacggactctatatagagtccgtg

SEQ ID NO: 2652 - DNA, 24 bp, synthetic construct
  misc_feature 1..24: note = Description of Artificial Sequence: Syntheticoligonucleotide
  source 1..24: mol_type = other DNA
cccagactctatatagagtctggg

SEQ ID NO: 2653 - DNA, 24 bp, synthetic construct
  misc_feature 1..24: note = Description of Artificial Sequence: Syntheticoligonucleotide
  source 1..24: mol_type = other DNA
ctcggactctatatagagtccgag

SEQ ID NO: 2654 - DNA, 24 bp, synthetic construct
  misc_feature 1..24: note = Description of Artificial Sequence: Syntheticoligonucleotide
  source 1..24: mol_type = other DNA
ccctgactctatatagagtcaggg

SEQ ID NO: 2655 - DNA, 24 bp, synthetic construct
  misc_feature 1..24: note = Description of Artificial Sequence: Syntheticoligonucleotide
  source 1..24: mol_type = other DNA
ccacgactctatatagagtcgtgg

SEQ ID NO: 2656 - DNA, 24 bp, synthetic construct
  misc_feature 1..24: note = Description of Artificial Sequence: Syntheticoligonucleotide
  source 1..24: mol_type = other DNA
agccgactctatatagagtcggct

SEQ ID NO: 2657 - DNA, 24 bp, synthetic construct
  misc_feature 1..24: note = Description of Artificial Sequence: Syntheticoligonucleotide
  source 1..24: mol_type = other DNA
tgccgactctatatagagtcggca

SEQ ID NO: 2658 - DNA, 24 bp, synthetic construct
  misc_feature 1..24: note = Description of Artificial Sequence: Syntheticoligonucleotide
  source 1..24: mol_type = other DNA
gcgagactctatatagagtctcgc

SEQ ID NO: 2659 - DNA, 24 bp, synthetic construct
  misc_feature 1..24: note = Description of Artificial Sequence: Syntheticoligonucleotide
  source 1..24: mol_type = other DNA
gcgtgactctatatagagtcacgc

SEQ ID NO: 2660 - DNA, 24 bp, synthetic construct
  misc_feature 1..24: note = Description of Artificial Sequence: Syntheticoligonucleotide
  source 1..24: mol_type = other DNA
gcaggactctatatagagtcctgc

SEQ ID NO: 2661 - DNA, 24 bp, synthetic construct
  misc_feature 1..24: note = Description of Artificial Sequence: Syntheticoligonucleotide
  source 1..24: mol_type = other DNA
gctggactctatatagagtccagc

SEQ ID NO: 2662 - DNA, 24 bp, synthetic construct
  misc_feature 1..24: note = Description of Artificial Sequence: Syntheticoligonucleotide
  source 1..24: mol_type = other DNA
cgaggactctatatagagtcctcg

SEQ ID NO: 2663 - DNA, 24 bp, synthetic construct
  misc_feature 1..24: note = Description of Artificial Sequence: Syntheticoligonucleotide
  source 1..24: mol_type = other DNA
cgtggactctatatagagtccacg

SEQ ID NO: 2664 - DNA, 24 bp, synthetic construct
  misc_feature 1..24: note = Description of Artificial Sequence: Syntheticoligonucleotide
  source 1..24: mol_type = other DNA
caccgactctatatagagtcggtg

SEQ ID NO: 2665 - DNA, 24 bp, synthetic construct
  misc_feature 1..24: note = Description of Artificial Sequence: Syntheticoligonucleotide
  source 1..24: mol_type = other DNA
ctccgactctatatagagtcggag

SEQ ID NO: 2666 - DNA, 24 bp, synthetic construct
  misc_feature 1..24: note = Description of Artificial Sequence: Syntheticoligonucleotide
  source 1..24: mol_type = other DNA
gcgggactctatatagagtcccgc

SEQ ID NO: 2667 - DNA, 24 bp, synthetic construct
  misc_feature 1..24: note = Description of Artificial Sequence: Syntheticoligonucleotide
  source 1..24: mol_type = other DNA
gagggactctatatagagtccctc

SEQ ID NO: 2668 - DNA, 24 bp, synthetic construct
  misc_feature 1..24: note = Description of Artificial Sequence: Syntheticoligonucleotide
  source 1..24: mol_type = other DNA
gtgggactctatatagagtcccac

SEQ ID NO: 2669 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactctagctagagtcnnnn

SEQ ID NO: 2670 - DNA, 24 bp, synthetic construct
  misc_feature 1..24: note = Description of Artificial Sequence: Syntheticoligonucleotide
  source 1..24: mol_type = other DNA
ggcggactctagctagagtccgcc

SEQ ID NO: 2671 - DNA, 24 bp, synthetic construct
  misc_feature 1..24: note = Description of Artificial Sequence: Syntheticoligonucleotide
  source 1..24: mol_type = other DNA
agcggactctagctagagtccgct

SEQ ID NO: 2672 - DNA, 24 bp, synthetic construct
  misc_feature 1..24: note = Description of Artificial Sequence: Syntheticoligonucleotide
  source 1..24: mol_type = other DNA
gacggactctagctagagtccgtc

SEQ ID NO: 2673 - DNA, 24 bp, synthetic construct
  misc_feature 1..24: note = Description of Artificial Sequence: Syntheticoligonucleotide
  source 1..24: mol_type = other DNA
ggaggactctagctagagtcctcc

SEQ ID NO: 2674 - DNA, 24 bp, synthetic construct
  misc_feature 1..24: note = Description of Artificial Sequence: Syntheticoligonucleotide
  source 1..24: mol_type = other DNA
ggcagactctagctagagtctgcc

SEQ ID NO: 2675 - DNA, 24 bp, synthetic construct
  misc_feature 1..24: note = Description of Artificial Sequence: Syntheticoligonucleotide
  source 1..24: mol_type = other DNA
tgcggactctagctagagtccgca

SEQ ID NO: 2676 - DNA, 24 bp, synthetic construct
  misc_feature 1..24: note = Description of Artificial Sequence: Syntheticoligonucleotide
  source 1..24: mol_type = other DNA
gtcggactctagctagagtccgac

SEQ ID NO: 2677 - DNA, 24 bp, synthetic construct
  misc_feature 1..24: note = Description of Artificial Sequence: Syntheticoligonucleotide
  source 1..24: mol_type = other DNA
ggtggactctagctagagtccacc

SEQ ID NO: 2678 - DNA, 24 bp, synthetic construct
  misc_feature 1..24: note = Description of Artificial Sequence: Syntheticoligonucleotide
  source 1..24: mol_type = other DNA
ggctgactctagctagagtcagcc

SEQ ID NO: 2679 - DNA, 24 bp, synthetic construct
  misc_feature 1..24: note = Description of Artificial Sequence: Syntheticoligonucleotide
  source 1..24: mol_type = other DNA
gcccgactctagctagagtcgggc

SEQ ID NO: 2680 - DNA, 24 bp, synthetic construct
  misc_feature 1..24: note = Description of Artificial Sequence: Syntheticoligonucleotide
  source 1..24: mol_type = other DNA
acccgactctagctagagtcgggt

SEQ ID NO: 2681 - DNA, 24 bp, synthetic construct
  misc_feature 1..24: note = Description of Artificial Sequence: Syntheticoligonucleotide
  source 1..24: mol_type = other DNA
gaccgactctagctagagtcggtc

SEQ ID NO: 2682 - DNA, 24 bp, synthetic construct
  misc_feature 1..24: note = Description of Artificial Sequence: Syntheticoligonucleotide
  source 1..24: mol_type = other DNA
gcacgactctagctagagtcgtgc

SEQ ID NO: 2683 - DNA, 24 bp, synthetic construct
  misc_feature 1..24: note = Description of Artificial Sequence: Syntheticoligonucleotide
  source 1..24: mol_type = other DNA
gccagactctagctagagtctggc

SEQ ID NO: 2684 - DNA, 24 bp, synthetic construct
  misc_feature 1..24: note = Description of Artificial Sequence: Syntheticoligonucleotide
  source 1..24: mol_type = other DNA
tcccgactctagctagagtcggga

SEQ ID NO: 2685 - DNA, 24 bp, synthetic construct
  misc_feature 1..24: note = Description of Artificial Sequence: Syntheticoligonucleotide
  source 1..24: mol_type = other DNA
gtccgactctagctagagtcggac

SEQ ID NO: 2686 - DNA, 24 bp, synthetic construct
  misc_feature 1..24: note = Description of Artificial Sequence: Syntheticoligonucleotide
  source 1..24: mol_type = other DNA
gcctgactctagctagagtcaggc

SEQ ID NO: 2687 - DNA, 24 bp, synthetic construct
  misc_feature 1..24: note = Description of Artificial Sequence: Syntheticoligonucleotide
  source 1..24: mol_type = other DNA
gggcgactctagctagagtcgccc

SEQ ID NO: 2688 - DNA, 24 bp, synthetic construct
  misc_feature 1..24: note = Description of Artificial Sequence: Syntheticoligonucleotide
  source 1..24: mol_type = other DNA
aggcgactctagctagagtcgcct

SEQ ID NO: 2689 - DNA, 24 bp, synthetic construct
  misc_feature 1..24: note = Description of Artificial Sequence: Syntheticoligonucleotide
  source 1..24: mol_type = other DNA
gagcgactctagctagagtcgctc

SEQ ID NO: 2690 - DNA, 24 bp, synthetic construct
  misc_feature 1..24: note = Description of Artificial Sequence: Syntheticoligonucleotide
  source 1..24: mol_type = other DNA
ggacgactctagctagagtcgtcc

SEQ ID NO: 2691 - DNA, 24 bp, synthetic construct
  misc_feature 1..24: note = Description of Artificial Sequence: Syntheticoligonucleotide
  source 1..24: mol_type = other DNA
gggagactctagctagagtctccc

SEQ ID NO: 2692 - DNA, 24 bp, synthetic construct
  misc_feature 1..24: note = Description of Artificial Sequence: Syntheticoligonucleotide
  source 1..24: mol_type = other DNA
tggcgactctagctagagtcgcca

SEQ ID NO: 2693 - DNA, 24 bp, synthetic construct
  misc_feature 1..24: note = Description of Artificial Sequence: Syntheticoligonucleotide
  source 1..24: mol_type = other DNA
gtgcgactctagctagagtcgcac

SEQ ID NO: 2694 - DNA, 24 bp, synthetic construct
  misc_feature 1..24: note = Description of Artificial Sequence: Syntheticoligonucleotide
  source 1..24: mol_type = other DNA
gggtgactctagctagagtcaccc

SEQ ID NO: 2695 - DNA, 24 bp, synthetic construct
  misc_feature 1..24: note = Description of Artificial Sequence: Syntheticoligonucleotide
  source 1..24: mol_type = other DNA
acgggactctagctagagtcccgt

SEQ ID NO: 2696 - DNA, 24 bp, synthetic construct
  misc_feature 1..24: note = Description of Artificial Sequence: Syntheticoligonucleotide
  source 1..24: mol_type = other DNA
cagggactctagctagagtccctg

SEQ ID NO: 2697 - DNA, 24 bp, synthetic construct
  misc_feature 1..24: note = Description of Artificial Sequence: Syntheticoligonucleotide
  source 1..24: mol_type = other DNA
ccaggactctagctagagtcctgg

SEQ ID NO: 2698 - DNA, 24 bp, synthetic construct
  misc_feature 1..24: note = Description of Artificial Sequence: Syntheticoligonucleotide
  source 1..24: mol_type = other DNA
ccgagactctagctagagtctcgg

SEQ ID NO: 2699 - DNA, 24 bp, synthetic construct
  misc_feature 1..24: note = Description of Artificial Sequence: Syntheticoligonucleotide
  source 1..24: mol_type = other DNA
tcgggactctagctagagtcccga

SEQ ID NO: 2700 - DNA, 24 bp, synthetic construct
  misc_feature 1..24: note = Description of Artificial Sequence: Syntheticoligonucleotide
  source 1..24: mol_type = other DNA
ctgggactctagctagagtcccag

SEQ ID NO: 2701 - DNA, 24 bp, synthetic construct
  misc_feature 1..24: note = Description of Artificial Sequence: Syntheticoligonucleotide
  source 1..24: mol_type = other DNA
cctggactctagctagagtccagg

SEQ ID NO: 2702 - DNA, 24 bp, synthetic construct
  misc_feature 1..24: note = Description of Artificial Sequence: Syntheticoligonucleotide
  source 1..24: mol_type = other DNA
ccgtgactctagctagagtcacgg

SEQ ID NO: 2703 - DNA, 24 bp, synthetic construct
  misc_feature 1..24: note = Description of Artificial Sequence: Syntheticoligonucleotide
  source 1..24: mol_type = other DNA
cggcgactctagctagagtcgccg

SEQ ID NO: 2704 - DNA, 24 bp, synthetic construct
  misc_feature 1..24: note = Description of Artificial Sequence: Syntheticoligonucleotide
  source 1..24: mol_type = other DNA
cagcgactctagctagagtcgctg

SEQ ID NO: 2705 - DNA, 24 bp, synthetic construct
  misc_feature 1..24: note = Description of Artificial Sequence: Syntheticoligonucleotide
  source 1..24: mol_type = other DNA
cgacgactctagctagagtcgtcg

SEQ ID NO: 2706 - DNA, 24 bp, synthetic construct
  misc_feature 1..24: note = Description of Artificial Sequence: Syntheticoligonucleotide
  source 1..24: mol_type = other DNA
cggagactctagctagagtctccg

SEQ ID NO: 2707 - DNA, 24 bp, synthetic construct
  misc_feature 1..24: note = Description of Artificial Sequence: Syntheticoligonucleotide
  source 1..24: mol_type = other DNA
ctgcgactctagctagagtcgcag

SEQ ID NO: 2708 - DNA, 24 bp, synthetic construct
  misc_feature 1..24: note = Description of Artificial Sequence: Syntheticoligonucleotide
  source 1..24: mol_type = other DNA
cggtgactctagctagagtcaccg

SEQ ID NO: 2709 - DNA, 24 bp, synthetic construct
  misc_feature 1..24: note = Description of Artificial Sequence: Syntheticoligonucleotide
  source 1..24: mol_type = other DNA
cacggactctagctagagtccgtg

SEQ ID NO: 2710 - DNA, 24 bp, synthetic construct
  misc_feature 1..24: note = Description of Artificial Sequence: Syntheticoligonucleotide
  source 1..24: mol_type = other DNA
cccagactctagctagagtctggg

SEQ ID NO: 2711 - DNA, 24 bp, synthetic construct
  misc_feature 1..24: note = Description of Artificial Sequence: Syntheticoligonucleotide
  source 1..24: mol_type = other DNA
ctcggactctagctagagtccgag

SEQ ID NO: 2712 - DNA, 24 bp, synthetic construct
  misc_feature 1..24: note = Description of Artificial Sequence: Syntheticoligonucleotide
  source 1..24: mol_type = other DNA
ccctgactctagctagagtcaggg

SEQ ID NO: 2713 - DNA, 24 bp, synthetic construct
  misc_feature 1..24: note = Description of Artificial Sequence: Syntheticoligonucleotide
  source 1..24: mol_type = other DNA
ccacgactctagctagagtcgtgg

SEQ ID NO: 2714 - DNA, 24 bp, synthetic construct
  misc_feature 1..24: note = Description of Artificial Sequence: Syntheticoligonucleotide
  source 1..24: mol_type = other DNA
agccgactctagctagagtcggct

SEQ ID NO: 2715 - DNA, 24 bp, synthetic construct
  misc_feature 1..24: note = Description of Artificial Sequence: Syntheticoligonucleotide
  source 1..24: mol_type = other DNA
tgccgactctagctagagtcggca

SEQ ID NO: 2716 - DNA, 24 bp, synthetic construct
  misc_feature 1..24: note = Description of Artificial Sequence: Syntheticoligonucleotide
  source 1..24: mol_type = other DNA
gcgagactctagctagagtctcgc

SEQ ID NO: 2717 - DNA, 24 bp, synthetic construct
  misc_feature 1..24: note = Description of Artificial Sequence: Syntheticoligonucleotide
  source 1..24: mol_type = other DNA
gcgtgactctagctagagtcacgc

SEQ ID NO: 2718 - DNA, 24 bp, synthetic construct
  misc_feature 1..24: note = Description of Artificial Sequence: Syntheticoligonucleotide
  source 1..24: mol_type = other DNA
gcaggactctagctagagtcctgc

SEQ ID NO: 2719 - DNA, 24 bp, synthetic construct
  misc_feature 1..24: note = Description of Artificial Sequence: Syntheticoligonucleotide
  source 1..24: mol_type = other DNA
gctggactctagctagagtccagc

SEQ ID NO: 2720 - DNA, 24 bp, synthetic construct
  misc_feature 1..24: note = Description of Artificial Sequence: Syntheticoligonucleotide
  source 1..24: mol_type = other DNA
cgaggactctagctagagtcctcg

SEQ ID NO: 2721 - DNA, 24 bp, synthetic construct
  misc_feature 1..24: note = Description of Artificial Sequence: Syntheticoligonucleotide
  source 1..24: mol_type = other DNA
cgtggactctagctagagtccacg

SEQ ID NO: 2722 - DNA, 24 bp, synthetic construct
  misc_feature 1..24: note = Description of Artificial Sequence: Syntheticoligonucleotide
  source 1..24: mol_type = other DNA
caccgactctagctagagtcggtg

SEQ ID NO: 2723 - DNA, 24 bp, synthetic construct
  misc_feature 1..24: note = Description of Artificial Sequence: Syntheticoligonucleotide
  source 1..24: mol_type = other DNA
ctccgactctagctagagtcggag

SEQ ID NO: 2724 - DNA, 24 bp, synthetic construct
  misc_feature 1..24: note = Description of Artificial Sequence: Syntheticoligonucleotide
  source 1..24: mol_type = other DNA
gcgggactctagctagagtcccgc

SEQ ID NO: 2725 - DNA, 24 bp, synthetic construct
  misc_feature 1..24: note = Description of Artificial Sequence: Syntheticoligonucleotide
  source 1..24: mol_type = other DNA
gagggactctagctagagtccctc

SEQ ID NO: 2726 - DNA, 24 bp, synthetic construct
  misc_feature 1..24: note = Description of Artificial Sequence: Syntheticoligonucleotide
  source 1..24: mol_type = other DNA
gtgggactctagctagagtcccac

SEQ ID NO: 2727 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactctacgtagagtcnnnn

SEQ ID NO: 2728 - DNA, 24 bp, synthetic construct
  misc_feature 1..24: note = Description of Artificial Sequence: Syntheticoligonucleotide
  source 1..24: mol_type = other DNA
ggcggactctacgtagagtccgcc

SEQ ID NO: 2729 - DNA, 24 bp, synthetic construct
  misc_feature 1..24: note = Description of Artificial Sequence: Syntheticoligonucleotide
  source 1..24: mol_type = other DNA
agcggactctacgtagagtccgct

SEQ ID NO: 2730 - DNA, 24 bp, synthetic construct
  misc_feature 1..24: note = Description of Artificial Sequence: Syntheticoligonucleotide
  source 1..24: mol_type = other DNA
gacggactctacgtagagtccgtc

SEQ ID NO: 2731 - DNA, 24 bp, synthetic construct
  misc_feature 1..24: note = Description of Artificial Sequence: Syntheticoligonucleotide
  source 1..24: mol_type = other DNA
ggaggactctacgtagagtcctcc

SEQ ID NO: 2732 - DNA, 24 bp, synthetic construct
  misc_feature 1..24: note = Description of Artificial Sequence: Syntheticoligonucleotide
  source 1..24: mol_type = other DNA
ggcagactctacgtagagtctgcc

SEQ ID NO: 2733 - DNA, 24 bp, synthetic construct
  misc_feature 1..24: note = Description of Artificial Sequence: Syntheticoligonucleotide
  source 1..24: mol_type = other DNA
tgcggactctacgtagagtccgca

SEQ ID NO: 2734 - DNA, 24 bp, synthetic construct
  misc_feature 1..24: note = Description of Artificial Sequence: Syntheticoligonucleotide
  source 1..24: mol_type = other DNA
gtcggactctacgtagagtccgac

SEQ ID NO: 2735 - DNA, 24 bp, synthetic construct
  misc_feature 1..24: note = Description of Artificial Sequence: Syntheticoligonucleotide
  source 1..24: mol_type = other DNA
ggtggactctacgtagagtccacc

SEQ ID NO: 2736 - DNA, 24 bp, synthetic construct
  misc_feature 1..24: note = Description of Artificial Sequence: Syntheticoligonucleotide
  source 1..24: mol_type = other DNA
ggctgactctacgtagagtcagcc

SEQ ID NO: 2737 - DNA, 24 bp, synthetic construct
  misc_feature 1..24: note = Description of Artificial Sequence: Syntheticoligonucleotide
  source 1..24: mol_type = other DNA
gcccgactctacgtagagtcgggc

SEQ ID NO: 2738 - DNA, 24 bp, synthetic construct
  misc_feature 1..24: note = Description of Artificial Sequence: Syntheticoligonucleotide
  source 1..24: mol_type = other DNA
acccgactctacgtagagtcgggt

SEQ ID NO: 2739 - DNA, 24 bp, synthetic construct
  misc_feature 1..24: note = Description of Artificial Sequence: Syntheticoligonucleotide
  source 1..24: mol_type = other DNA
gaccgactctacgtagagtcggtc

SEQ ID NO: 2740 - DNA, 24 bp, synthetic construct
  misc_feature 1..24: note = Description of Artificial Sequence: Syntheticoligonucleotide
  source 1..24: mol_type = other DNA
gcacgactctacgtagagtcgtgc

SEQ ID NO: 2741 - DNA, 24 bp, synthetic construct
  misc_feature 1..24: note = Description of Artificial Sequence: Syntheticoligonucleotide
  source 1..24: mol_type = other DNA
gccagactctacgtagagtctggc

SEQ ID NO: 2742 - DNA, 24 bp, synthetic construct
  misc_feature 1..24: note = Description of Artificial Sequence: Syntheticoligonucleotide
  source 1..24: mol_type = other DNA
tcccgactctacgtagagtcggga

SEQ ID NO: 2743 - DNA, 24 bp, synthetic construct
  misc_feature 1..24: note = Description of Artificial Sequence: Syntheticoligonucleotide
  source 1..24: mol_type = other DNA
gtccgactctacgtagagtcggac

SEQ ID NO: 2744 - DNA, 24 bp, synthetic construct
  misc_feature 1..24: note = Description of Artificial Sequence: Syntheticoligonucleotide
  source 1..24: mol_type = other DNA
gcctgactctacgtagagtcaggc

SEQ ID NO: 2745 - DNA, 24 bp, synthetic construct
  misc_feature 1..24: note = Description of Artificial Sequence: Syntheticoligonucleotide
  source 1..24: mol_type = other DNA
gggcgactctacgtagagtcgccc

SEQ ID NO: 2746 - DNA, 24 bp, synthetic construct
  misc_feature 1..24: note = Description of Artificial Sequence: Syntheticoligonucleotide
  source 1..24: mol_type = other DNA
aggcgactctacgtagagtcgcct

SEQ ID NO: 2747 - DNA, 24 bp, synthetic construct
  misc_feature 1..24: note = Description of Artificial Sequence: Syntheticoligonucleotide
  source 1..24: mol_type = other DNA
gagcgactctacgtagagtcgctc

SEQ ID NO: 2748 - DNA, 24 bp, synthetic construct
  misc_feature 1..24: note = Description of Artificial Sequence: Syntheticoligonucleotide
  source 1..24: mol_type = other DNA
ggacgactctacgtagagtcgtcc

SEQ ID NO: 2749 - DNA, 24 bp, synthetic construct
  misc_feature 1..24: note = Description of Artificial Sequence: Syntheticoligonucleotide
  source 1..24: mol_type = other DNA
gggagactctacgtagagtctccc

SEQ ID NO: 2750 - DNA, 24 bp, synthetic construct
  misc_feature 1..24: note = Description of Artificial Sequence: Syntheticoligonucleotide
  source 1..24: mol_type = other DNA
tggcgactctacgtagagtcgcca

SEQ ID NO: 2751 - DNA, 24 bp, synthetic construct
  misc_feature 1..24: note = Description of Artificial Sequence: Syntheticoligonucleotide
  source 1..24: mol_type = other DNA
gtgcgactctacgtagagtcgcac

SEQ ID NO: 2752 - DNA, 24 bp, synthetic construct
  misc_feature 1..24: note = Description of Artificial Sequence: Syntheticoligonucleotide
  source 1..24: mol_type = other DNA
gggtgactctacgtagagtcaccc

SEQ ID NO: 2753 - DNA, 24 bp, synthetic construct
  misc_feature 1..24: note = Description of Artificial Sequence: Syntheticoligonucleotide
  source 1..24: mol_type = other DNA
acgggactctacgtagagtcccgt

SEQ ID NO: 2754 - DNA, 24 bp, synthetic construct
  misc_feature 1..24: note = Description of Artificial Sequence: Syntheticoligonucleotide
  source 1..24: mol_type = other DNA
cagggactctacgtagagtccctg

SEQ ID NO: 2755 - DNA, 24 bp, synthetic construct
  misc_feature 1..24: note = Description of Artificial Sequence: Syntheticoligonucleotide
  source 1..24: mol_type = other DNA
ccaggactctacgtagagtcctgg

SEQ ID NO: 2756 - DNA, 24 bp, synthetic construct
  misc_feature 1..24: note = Description of Artificial Sequence: Syntheticoligonucleotide
  source 1..24: mol_type = other DNA
ccgagactctacgtagagtctcgg

SEQ ID NO: 2757 - DNA, 24 bp, synthetic construct
  misc_feature 1..24: note = Description of Artificial Sequence: Syntheticoligonucleotide
  source 1..24: mol_type = other DNA
tcgggactctacgtagagtcccga

SEQ ID NO: 2758 - DNA, 24 bp, synthetic construct
  misc_feature 1..24: note = Description of Artificial Sequence: Syntheticoligonucleotide
  source 1..24: mol_type = other DNA
ctgggactctacgtagagtcccag

SEQ ID NO: 2759 - DNA, 24 bp, synthetic construct
  misc_feature 1..24: note = Description of Artificial Sequence: Syntheticoligonucleotide
  source 1..24: mol_type = other DNA
cctggactctacgtagagtccagg

SEQ ID NO: 2760 - DNA, 24 bp, synthetic construct
  misc_feature 1..24: note = Description of Artificial Sequence: Syntheticoligonucleotide
  source 1..24: mol_type = other DNA
ccgtgactctacgtagagtcacgg

SEQ ID NO: 2761 - DNA, 24 bp, synthetic construct
  misc_feature 1..24: note = Description of Artificial Sequence: Syntheticoligonucleotide
  source 1..24: mol_type = other DNA
cggcgactctacgtagagtcgccg

SEQ ID NO: 2762 - DNA, 24 bp, synthetic construct
  misc_feature 1..24: note = Description of Artificial Sequence: Syntheticoligonucleotide
  source 1..24: mol_type = other DNA
cagcgactctacgtagagtcgctg

SEQ ID NO: 2763 - DNA, 24 bp, synthetic construct
  misc_feature 1..24: note = Description of Artificial Sequence: Syntheticoligonucleotide
  source 1..24: mol_type = other DNA
cgacgactctacgtagagtcgtcg

SEQ ID NO: 2764 - DNA, 24 bp, synthetic construct
  misc_feature 1..24: note = Description of Artificial Sequence: Syntheticoligonucleotide
  source 1..24: mol_type = other DNA
cggagactctacgtagagtctccg

SEQ ID NO: 2765 - DNA, 24 bp, synthetic construct
  misc_feature 1..24: note = Description of Artificial Sequence: Syntheticoligonucleotide
  source 1..24: mol_type = other DNA
ctgcgactctacgtagagtcgcag

SEQ ID NO: 2766 - DNA, 24 bp, synthetic construct
  misc_feature 1..24: note = Description of Artificial Sequence: Syntheticoligonucleotide
  source 1..24: mol_type = other DNA
cggtgactctacgtagagtcaccg

SEQ ID NO: 2767 - DNA, 24 bp, synthetic construct
  misc_feature 1..24: note = Description of Artificial Sequence: Syntheticoligonucleotide
  source 1..24: mol_type = other DNA
cacggactctacgtagagtccgtg

SEQ ID NO: 2768 - DNA, 24 bp, synthetic construct
  misc_feature 1..24: note = Description of Artificial Sequence: Syntheticoligonucleotide
  source 1..24: mol_type = other DNA
cccagactctacgtagagtctggg

SEQ ID NO: 2769 - DNA, 24 bp, synthetic construct
  misc_feature 1..24: note = Description of Artificial Sequence: Syntheticoligonucleotide
  source 1..24: mol_type = other DNA
ctcggactctacgtagagtccgag

SEQ ID NO: 2770 - DNA, 24 bp, synthetic construct
  misc_feature 1..24: note = Description of Artificial Sequence: Syntheticoligonucleotide
  source 1..24: mol_type = other DNA
ccctgactctacgtagagtcaggg

SEQ ID NO: 2771 - DNA, 24 bp, synthetic construct
  misc_feature 1..24: note = Description of Artificial Sequence: Syntheticoligonucleotide
  source 1..24: mol_type = other DNA
ccacgactctacgtagagtcgtgg

SEQ ID NO: 2772 - DNA, 24 bp, synthetic construct
  misc_feature 1..24: note = Description of Artificial Sequence: Syntheticoligonucleotide
  source 1..24: mol_type = other DNA
agccgactctacgtagagtcggct

SEQ ID NO: 2773 - DNA, 24 bp, synthetic construct
  misc_feature 1..24: note = Description of Artificial Sequence: Syntheticoligonucleotide
  source 1..24: mol_type = other DNA
tgccgactctacgtagagtcggca

SEQ ID NO: 2774 - DNA, 24 bp, synthetic construct
  misc_feature 1..24: note = Description of Artificial Sequence: Syntheticoligonucleotide
  source 1..24: mol_type = other DNA
gcgagactctacgtagagtctcgc

SEQ ID NO: 2775 - DNA, 24 bp, synthetic construct
  misc_feature 1..24: note = Description of Artificial Sequence: Syntheticoligonucleotide
  source 1..24: mol_type = other DNA
gcgtgactctacgtagagtcacgc

SEQ ID NO: 2776 - DNA, 24 bp, synthetic construct
  misc_feature 1..24: note = Description of Artificial Sequence: Syntheticoligonucleotide
  source 1..24: mol_type = other DNA
gcaggactctacgtagagtcctgc

SEQ ID NO: 2777 - DNA, 24 bp, synthetic construct
  misc_feature 1..24: note = Description of Artificial Sequence: Syntheticoligonucleotide
  source 1..24: mol_type = other DNA
gctggactctacgtagagtccagc

SEQ ID NO: 2778 - DNA, 24 bp, synthetic construct
  misc_feature 1..24: note = Description of Artificial Sequence: Syntheticoligonucleotide
  source 1..24: mol_type = other DNA
cgaggactctacgtagagtcctcg

SEQ ID NO: 2779 - DNA, 24 bp, synthetic construct
  misc_feature 1..24: note = Description of Artificial Sequence: Syntheticoligonucleotide
  source 1..24: mol_type = other DNA
cgtggactctacgtagagtccacg

SEQ ID NO: 2780 - DNA, 24 bp, synthetic construct
  misc_feature 1..24: note = Description of Artificial Sequence: Syntheticoligonucleotide
  source 1..24: mol_type = other DNA
caccgactctacgtagagtcggtg

SEQ ID NO: 2781 - DNA, 24 bp, synthetic construct
  misc_feature 1..24: note = Description of Artificial Sequence: Syntheticoligonucleotide
  source 1..24: mol_type = other DNA
ctccgactctacgtagagtcggag

SEQ ID NO: 2782 - DNA, 24 bp, synthetic construct
  misc_feature 1..24: note = Description of Artificial Sequence: Syntheticoligonucleotide
  source 1..24: mol_type = other DNA
gcgggactctacgtagagtcccgc

SEQ ID NO: 2783 - DNA, 24 bp, synthetic construct
  misc_feature 1..24: note = Description of Artificial Sequence: Syntheticoligonucleotide
  source 1..24: mol_type = other DNA
gagggactctacgtagagtccctc

SEQ ID NO: 2784 - DNA, 24 bp, synthetic construct
  misc_feature 1..24: note = Description of Artificial Sequence: Syntheticoligonucleotide
  source 1..24: mol_type = other DNA
gtgggactctacgtagagtcccac

SEQ ID NO: 2785 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcatatatgagtcnnnn

SEQ ID NO: 2786 - DNA, 24 bp, synthetic construct
  misc_feature 1..24: note = Description of Artificial Sequence: Syntheticoligonucleotide
  source 1..24: mol_type = other DNA
ggcggactcatatatgagtccgcc

SEQ ID NO: 2787 - DNA, 24 bp, synthetic construct
  misc_feature 1..24: note = Description of Artificial Sequence: Syntheticoligonucleotide
  source 1..24: mol_type = other DNA
agcggactcatatatgagtccgct

SEQ ID NO: 2788 - DNA, 24 bp, synthetic construct
  misc_feature 1..24: note = Description of Artificial Sequence: Syntheticoligonucleotide
  source 1..24: mol_type = other DNA
gacggactcatatatgagtccgtc

SEQ ID NO: 2789 - DNA, 24 bp, synthetic construct
  misc_feature 1..24: note = Description of Artificial Sequence: Syntheticoligonucleotide
  source 1..24: mol_type = other DNA
ggaggactcatatatgagtcctcc

SEQ ID NO: 2790 - DNA, 24 bp, synthetic construct
  misc_feature 1..24: note = Description of Artificial Sequence: Syntheticoligonucleotide
  source 1..24: mol_type = other DNA
ggcagactcatatatgagtctgcc

SEQ ID NO: 2791 - DNA, 24 bp, synthetic construct
  misc_feature 1..24: note = Description of Artificial Sequence: Syntheticoligonucleotide
  source 1..24: mol_type = other DNA
tgcggactcatatatgagtccgca

SEQ ID NO: 2792 - DNA, 24 bp, synthetic construct
  misc_feature 1..24: note = Description of Artificial Sequence: Syntheticoligonucleotide
  source 1..24: mol_type = other DNA
gtcggactcatatatgagtccgac

SEQ ID NO: 2793 - DNA, 24 bp, synthetic construct
  misc_feature 1..24: note = Description of Artificial Sequence: Syntheticoligonucleotide
  source 1..24: mol_type = other DNA
ggtggactcatatatgagtccacc

SEQ ID NO: 2794 - DNA, 24 bp, synthetic construct
  misc_feature 1..24: note = Description of Artificial Sequence: Syntheticoligonucleotide
  source 1..24: mol_type = other DNA
ggctgactcatatatgagtcagcc

SEQ ID NO: 2795 - DNA, 24 bp, synthetic construct
  misc_feature 1..24: note = Description of Artificial Sequence: Syntheticoligonucleotide
  source 1..24: mol_type = other DNA
gcccgactcatatatgagtcgggc

SEQ ID NO: 2796 - DNA, 24 bp, synthetic construct
  misc_feature 1..24: note = Description of Artificial Sequence: Syntheticoligonucleotide
  source 1..24: mol_type = other DNA
acccgactcatatatgagtcgggt

SEQ ID NO: 2797 - DNA, 24 bp, synthetic construct
  misc_feature 1..24: note = Description of Artificial Sequence: Syntheticoligonucleotide
  source 1..24: mol_type = other DNA
gaccgactcatatatgagtcggtc

SEQ ID NO: 2798 - DNA, 24 bp, synthetic construct
  misc_feature 1..24: note = Description of Artificial Sequence: Syntheticoligonucleotide
  source 1..24: mol_type = other DNA
gcacgactcatatatgagtcgtgc

SEQ ID NO: 2799 - DNA, 24 bp, synthetic construct
  misc_feature 1..24: note = Description of Artificial Sequence: Syntheticoligonucleotide
  source 1..24: mol_type = other DNA
gccagactcatatatgagtctggc

SEQ ID NO: 2800 - DNA, 24 bp, synthetic construct
  misc_feature 1..24: note = Description of Artificial Sequence: Syntheticoligonucleotide
  source 1..24: mol_type = other DNA
tcccgactcatatatgagtcggga

SEQ ID NO: 2801 - DNA, 24 bp, synthetic construct
  misc_feature 1..24: note = Description of Artificial Sequence: Syntheticoligonucleotide
  source 1..24: mol_type = other DNA
gtccgactcatatatgagtcggac

SEQ ID NO: 2802 - DNA, 24 bp, synthetic construct
  misc_feature 1..24: note = Description of Artificial Sequence: Syntheticoligonucleotide
  source 1..24: mol_type = other DNA
gcctgactcatatatgagtcaggc

SEQ ID NO: 2803 - DNA, 24 bp, synthetic construct
  misc_feature 1..24: note = Description of Artificial Sequence: Syntheticoligonucleotide
  source 1..24: mol_type = other DNA
gggcgactcatatatgagtcgccc

SEQ ID NO: 2804 - DNA, 24 bp, synthetic construct
  misc_feature 1..24: note = Description of Artificial Sequence: Syntheticoligonucleotide
  source 1..24: mol_type = other DNA
aggcgactcatatatgagtcgcct

SEQ ID NO: 2805 - DNA, 24 bp, synthetic construct
  misc_feature 1..24: note = Description of Artificial Sequence: Syntheticoligonucleotide
  source 1..24: mol_type = other DNA
gagcgactcatatatgagtcgctc

SEQ ID NO: 2806 - DNA, 24 bp, synthetic construct
  misc_feature 1..24: note = Description of Artificial Sequence: Syntheticoligonucleotide
  source 1..24: mol_type = other DNA
ggacgactcatatatgagtcgtcc

SEQ ID NO: 2807 - DNA, 24 bp, synthetic construct
  misc_feature 1..24: note = Description of Artificial Sequence: Syntheticoligonucleotide
  source 1..24: mol_type = other DNA
gggagactcatatatgagtctccc

SEQ ID NO: 2808 - DNA, 24 bp, synthetic construct
  misc_feature 1..24: note = Description of Artificial Sequence: Syntheticoligonucleotide
  source 1..24: mol_type = other DNA
tggcgactcatatatgagtcgcca

SEQ ID NO: 2809 - DNA, 24 bp, synthetic construct
  misc_feature 1..24: note = Description of Artificial Sequence: Syntheticoligonucleotide
  source 1..24: mol_type = other DNA
gtgcgactcatatatgagtcgcac

SEQ ID NO: 2810 - DNA, 24 bp, synthetic construct
  misc_feature 1..24: note = Description of Artificial Sequence: Syntheticoligonucleotide
  source 1..24: mol_type = other DNA
gggtgactcatatatgagtcaccc

SEQ ID NO: 2811 - DNA, 24 bp, synthetic construct
  misc_feature 1..24: note = Description of Artificial Sequence: Syntheticoligonucleotide
  source 1..24: mol_type = other DNA
acgggactcatatatgagtcccgt

SEQ ID NO: 2812 - DNA, 24 bp, synthetic construct
  misc_feature 1..24: note = Description of Artificial Sequence: Syntheticoligonucleotide
  source 1..24: mol_type = other DNA
cagggactcatatatgagtccctg

SEQ ID NO: 2813 - DNA, 24 bp, synthetic construct
  misc_feature 1..24: note = Description of Artificial Sequence: Syntheticoligonucleotide
  source 1..24: mol_type = other DNA
ccaggactcatatatgagtcctgg

SEQ ID NO: 2814 - DNA, 24 bp, synthetic construct
  misc_feature 1..24: note = Description of Artificial Sequence: Syntheticoligonucleotide
  source 1..24: mol_type = other DNA
ccgagactcatatatgagtctcgg

SEQ ID NO: 2815 - DNA, 24 bp, synthetic construct
  misc_feature 1..24: note = Description of Artificial Sequence: Syntheticoligonucleotide
  source 1..24: mol_type = other DNA
tcgggactcatatatgagtcccga

SEQ ID NO: 2816 - DNA, 24 bp, synthetic construct
  misc_feature 1..24: note = Description of Artificial Sequence: Syntheticoligonucleotide
  source 1..24: mol_type = other DNA
ctgggactcatatatgagtcccag

SEQ ID NO: 2817 - DNA, 24 bp, synthetic construct
  misc_feature 1..24: note = Description of Artificial Sequence: Syntheticoligonucleotide
  source 1..24: mol_type = other DNA
cctggactcatatatgagtccagg

SEQ ID NO: 2818 - DNA, 24 bp, synthetic construct
  misc_feature 1..24: note = Description of Artificial Sequence: Syntheticoligonucleotide
  source 1..24: mol_type = other DNA
ccgtgactcatatatgagtcacgg

SEQ ID NO: 2819 - DNA, 24 bp, synthetic construct
  misc_feature 1..24: note = Description of Artificial Sequence: Syntheticoligonucleotide
  source 1..24: mol_type = other DNA
cggcgactcatatatgagtcgccg

SEQ ID NO: 2820 - DNA, 24 bp, synthetic construct
  misc_feature 1..24: note = Description of Artificial Sequence: Syntheticoligonucleotide
  source 1..24: mol_type = other DNA
cagcgactcatatatgagtcgctg

SEQ ID NO: 2821 - DNA, 24 bp, synthetic construct
  misc_feature 1..24: note = Description of Artificial Sequence: Syntheticoligonucleotide
  source 1..24: mol_type = other DNA
cgacgactcatatatgagtcgtcg

SEQ ID NO: 2822 - DNA, 24 bp, synthetic construct
  misc_feature 1..24: note = Description of Artificial Sequence: Syntheticoligonucleotide
  source 1..24: mol_type = other DNA
cggagactcatatatgagtctccg

SEQ ID NO: 2823 - DNA, 24 bp, synthetic construct
  misc_feature 1..24: note = Description of Artificial Sequence: Syntheticoligonucleotide
  source 1..24: mol_type = other DNA
ctgcgactcatatatgagtcgcag

SEQ ID NO: 2824 - DNA, 24 bp, synthetic construct
  misc_feature 1..24: note = Description of Artificial Sequence: Syntheticoligonucleotide
  source 1..24: mol_type = other DNA
cggtgactcatatatgagtcaccg

SEQ ID NO: 2825 - DNA, 24 bp, synthetic construct
  misc_feature 1..24: note = Description of Artificial Sequence: Syntheticoligonucleotide
  source 1..24: mol_type = other DNA
cacggactcatatatgagtccgtg

SEQ ID NO: 2826 - DNA, 24 bp, synthetic construct
  misc_feature 1..24: note = Description of Artificial Sequence: Syntheticoligonucleotide
  source 1..24: mol_type = other DNA
cccagactcatatatgagtctggg

SEQ ID NO: 2827 - DNA, 24 bp, synthetic construct
  misc_feature 1..24: note = Description of Artificial Sequence: Syntheticoligonucleotide
  source 1..24: mol_type = other DNA
ctcggactcatatatgagtccgag

SEQ ID NO: 2828 - DNA, 24 bp, synthetic construct
  misc_feature 1..24: note = Description of Artificial Sequence: Syntheticoligonucleotide
  source 1..24: mol_type = other DNA
ccctgactcatatatgagtcaggg

SEQ ID NO: 2829 - DNA, 24 bp, synthetic construct
  misc_feature 1..24: note = Description of Artificial Sequence: Syntheticoligonucleotide
  source 1..24: mol_type = other DNA
ccacgactcatatatgagtcgtgg

SEQ ID NO: 2830 - DNA, 24 bp, synthetic construct
  misc_feature 1..24: note = Description of Artificial Sequence: Syntheticoligonucleotide
  source 1..24: mol_type = other DNA
agccgactcatatatgagtcggct

SEQ ID NO: 2831 - DNA, 24 bp, synthetic construct
  misc_feature 1..24: note = Description of Artificial Sequence: Syntheticoligonucleotide
  source 1..24: mol_type = other DNA
tgccgactcatatatgagtcggca

SEQ ID NO: 2832 - DNA, 24 bp, synthetic construct
  misc_feature 1..24: note = Description of Artificial Sequence: Syntheticoligonucleotide
  source 1..24: mol_type = other DNA
gcgagactcatatatgagtctcgc

SEQ ID NO: 2833 - DNA, 24 bp, synthetic construct
  misc_feature 1..24: note = Description of Artificial Sequence: Syntheticoligonucleotide
  source 1..24: mol_type = other DNA
gcgtgactcatatatgagtcacgc

SEQ ID NO: 2834 - DNA, 24 bp, synthetic construct
  misc_feature 1..24: note = Description of Artificial Sequence: Syntheticoligonucleotide
  source 1..24: mol_type = other DNA
gcaggactcatatatgagtcctgc

SEQ ID NO: 2835 - DNA, 24 bp, synthetic construct
  misc_feature 1..24: note = Description of Artificial Sequence: Syntheticoligonucleotide
  source 1..24: mol_type = other DNA
gctggactcatatatgagtccagc

SEQ ID NO: 2836 - DNA, 24 bp, synthetic construct
  misc_feature 1..24: note = Description of Artificial Sequence: Syntheticoligonucleotide
  source 1..24: mol_type = other DNA
cgaggactcatatatgagtcctcg

SEQ ID NO: 2837 - DNA, 24 bp, synthetic construct
  misc_feature 1..24: note = Description of Artificial Sequence: Syntheticoligonucleotide
  source 1..24: mol_type = other DNA
cgtggactcatatatgagtccacg

SEQ ID NO: 2838 - DNA, 24 bp, synthetic construct
  misc_feature 1..24: note = Description of Artificial Sequence: Syntheticoligonucleotide
  source 1..24: mol_type = other DNA
caccgactcatatatgagtcggtg

SEQ ID NO: 2839 - DNA, 24 bp, synthetic construct
  misc_feature 1..24: note = Description of Artificial Sequence: Syntheticoligonucleotide
  source 1..24: mol_type = other DNA
ctccgactcatatatgagtcggag

SEQ ID NO: 2840 - DNA, 24 bp, synthetic construct
  misc_feature 1..24: note = Description of Artificial Sequence: Syntheticoligonucleotide
  source 1..24: mol_type = other DNA
gcgggactcatatatgagtcccgc

SEQ ID NO: 2841 - DNA, 24 bp, synthetic construct
  misc_feature 1..24: note = Description of Artificial Sequence: Syntheticoligonucleotide
  source 1..24: mol_type = other DNA
gagggactcatatatgagtccctc

SEQ ID NO: 2842 - DNA, 24 bp, synthetic construct
  misc_feature 1..24: note = Description of Artificial Sequence: Syntheticoligonucleotide
  source 1..24: mol_type = other DNA
gtgggactcatatatgagtcccac

SEQ ID NO: 2843 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcattaatgagtcnnnn

SEQ ID NO: 2844 - DNA, 24 bp, synthetic construct
  misc_feature 1..24: note = Description of Artificial Sequence: Syntheticoligonucleotide
  source 1..24: mol_type = other DNA
ggcggactcattaatgagtccgcc

SEQ ID NO: 2845 - DNA, 24 bp, synthetic construct
  misc_feature 1..24: note = Description of Artificial Sequence: Syntheticoligonucleotide
  source 1..24: mol_type = other DNA
agcggactcattaatgagtccgct

SEQ ID NO: 2846 - DNA, 24 bp, synthetic construct
  misc_feature 1..24: note = Description of Artificial Sequence: Syntheticoligonucleotide
  source 1..24: mol_type = other DNA
gacggactcattaatgagtccgtc

SEQ ID NO: 2847 - DNA, 24 bp, synthetic construct
  misc_feature 1..24: note = Description of Artificial Sequence: Syntheticoligonucleotide
  source 1..24: mol_type = other DNA
ggaggactcattaatgagtcctcc

SEQ ID NO: 2848 - DNA, 24 bp, synthetic construct
  misc_feature 1..24: note = Description of Artificial Sequence: Syntheticoligonucleotide
  source 1..24: mol_type = other DNA
ggcagactcattaatgagtctgcc

SEQ ID NO: 2849 - DNA, 24 bp, synthetic construct
  misc_feature 1..24: note = Description of Artificial Sequence: Syntheticoligonucleotide
  source 1..24: mol_type = other DNA
tgcggactcattaatgagtccgca

SEQ ID NO: 2850 - DNA, 24 bp, synthetic construct
  misc_feature 1..24: note = Description of Artificial Sequence: Syntheticoligonucleotide
  source 1..24: mol_type = other DNA
gtcggactcattaatgagtccgac

SEQ ID NO: 2851 - DNA, 24 bp, synthetic construct
  misc_feature 1..24: note = Description of Artificial Sequence: Syntheticoligonucleotide
  source 1..24: mol_type = other DNA
ggtggactcattaatgagtccacc

SEQ ID NO: 2852 - DNA, 24 bp, synthetic construct
  misc_feature 1..24: note = Description of Artificial Sequence: Syntheticoligonucleotide
  source 1..24: mol_type = other DNA
ggctgactcattaatgagtcagcc

SEQ ID NO: 2853 - DNA, 24 bp, synthetic construct
  misc_feature 1..24: note = Description of Artificial Sequence: Syntheticoligonucleotide
  source 1..24: mol_type = other DNA
gcccgactcattaatgagtcgggc

SEQ ID NO: 2854 - DNA, 24 bp, synthetic construct
  misc_feature 1..24: note = Description of Artificial Sequence: Syntheticoligonucleotide
  source 1..24: mol_type = other DNA
acccgactcattaatgagtcgggt

SEQ ID NO: 2855 - DNA, 24 bp, synthetic construct
  misc_feature 1..24: note = Description of Artificial Sequence: Syntheticoligonucleotide
  source 1..24: mol_type = other DNA
gaccgactcattaatgagtcggtc

SEQ ID NO: 2856 - DNA, 24 bp, synthetic construct
  misc_feature 1..24: note = Description of Artificial Sequence: Syntheticoligonucleotide
  source 1..24: mol_type = other DNA
gcacgactcattaatgagtcgtgc

SEQ ID NO: 2857 - DNA, 24 bp, synthetic construct
  misc_feature 1..24: note = Description of Artificial Sequence: Syntheticoligonucleotide
  source 1..24: mol_type = other DNA
gccagactcattaatgagtctggc

SEQ ID NO: 2858 - DNA, 24 bp, synthetic construct
  misc_feature 1..24: note = Description of Artificial Sequence: Syntheticoligonucleotide
  source 1..24: mol_type = other DNA
tcccgactcattaatgagtcggga

SEQ ID NO: 2859 - DNA, 24 bp, synthetic construct
  misc_feature 1..24: note = Description of Artificial Sequence: Syntheticoligonucleotide
  source 1..24: mol_type = other DNA
gtccgactcattaatgagtcggac

SEQ ID NO: 2860 - DNA, 24 bp, synthetic construct
  misc_feature 1..24: note = Description of Artificial Sequence: Syntheticoligonucleotide
  source 1..24: mol_type = other DNA
gcctgactcattaatgagtcaggc

SEQ ID NO: 2861 - DNA, 24 bp, synthetic construct
  misc_feature 1..24: note = Description of Artificial Sequence: Syntheticoligonucleotide
  source 1..24: mol_type = other DNA
gggcgactcattaatgagtcgccc

SEQ ID NO: 2862 - DNA, 24 bp, synthetic construct
  misc_feature 1..24: note = Description of Artificial Sequence: Syntheticoligonucleotide
  source 1..24: mol_type = other DNA
aggcgactcattaatgagtcgcct

SEQ ID NO: 2863 - DNA, 24 bp, synthetic construct
  misc_feature 1..24: note = Description of Artificial Sequence: Syntheticoligonucleotide
  source 1..24: mol_type = other DNA
gagcgactcattaatgagtcgctc

SEQ ID NO: 2864 - DNA, 24 bp, synthetic construct
  misc_feature 1..24: note = Description of Artificial Sequence: Syntheticoligonucleotide
  source 1..24: mol_type = other DNA
ggacgactcattaatgagtcgtcc

SEQ ID NO: 2865 - DNA, 24 bp, synthetic construct
  misc_feature 1..24: note = Description of Artificial Sequence: Syntheticoligonucleotide
  source 1..24: mol_type = other DNA
gggagactcattaatgagtctccc

SEQ ID NO: 2866 - DNA, 24 bp, synthetic construct
  misc_feature 1..24: note = Description of Artificial Sequence: Syntheticoligonucleotide
  source 1..24: mol_type = other DNA
tggcgactcattaatgagtcgcca

SEQ ID NO: 2867 - DNA, 24 bp, synthetic construct
  misc_feature 1..24: note = Description of Artificial Sequence: Syntheticoligonucleotide
  source 1..24: mol_type = other DNA
gtgcgactcattaatgagtcgcac

SEQ ID NO: 2868 - DNA, 24 bp, synthetic construct
  misc_feature 1..24: note = Description of Artificial Sequence: Syntheticoligonucleotide
  source 1..24: mol_type = other DNA
gggtgactcattaatgagtcaccc

SEQ ID NO: 2869 - DNA, 24 bp, synthetic construct
  misc_feature 1..24: note = Description of Artificial Sequence: Syntheticoligonucleotide
  source 1..24: mol_type = other DNA
acgggactcattaatgagtcccgt

SEQ ID NO: 2870 - DNA, 24 bp, synthetic construct
  misc_feature 1..24: note = Description of Artificial Sequence: Syntheticoligonucleotide
  source 1..24: mol_type = other DNA
cagggactcattaatgagtccctg

SEQ ID NO: 2871 - DNA, 24 bp, synthetic construct
  misc_feature 1..24: note = Description of Artificial Sequence: Syntheticoligonucleotide
  source 1..24: mol_type = other DNA
ccaggactcattaatgagtcctgg

SEQ ID NO: 2872 - DNA, 24 bp, synthetic construct
  misc_feature 1..24: note = Description of Artificial Sequence: Syntheticoligonucleotide
  source 1..24: mol_type = other DNA
ccgagactcattaatgagtctcgg

SEQ ID NO: 2873 - DNA, 24 bp, synthetic construct
  misc_feature 1..24: note = Description of Artificial Sequence: Syntheticoligonucleotide
  source 1..24: mol_type = other DNA
tcgggactcattaatgagtcccga

SEQ ID NO: 2874 - DNA, 24 bp, synthetic construct
  misc_feature 1..24: note = Description of Artificial Sequence: Syntheticoligonucleotide
  source 1..24: mol_type = other DNA
ctgggactcattaatgagtcccag

SEQ ID NO: 2875 - DNA, 24 bp, synthetic construct
  misc_feature 1..24: note = Description of Artificial Sequence: Syntheticoligonucleotide
  source 1..24: mol_type = other DNA
cctggactcattaatgagtccagg

SEQ ID NO: 2876 - DNA, 24 bp, synthetic construct
  misc_feature 1..24: note = Description of Artificial Sequence: Syntheticoligonucleotide
  source 1..24: mol_type = other DNA
ccgtgactcattaatgagtcacgg

SEQ ID NO: 2877 - DNA, 24 bp, synthetic construct
  misc_feature 1..24: note = Description of Artificial Sequence: Syntheticoligonucleotide
  source 1..24: mol_type = other DNA
cggcgactcattaatgagtcgccg

SEQ ID NO: 2878 - DNA, 24 bp, synthetic construct
  misc_feature 1..24: note = Description of Artificial Sequence: Syntheticoligonucleotide
  source 1..24: mol_type = other DNA
cagcgactcattaatgagtcgctg

SEQ ID NO: 2879 - DNA, 24 bp, synthetic construct
  misc_feature 1..24: note = Description of Artificial Sequence: Syntheticoligonucleotide
  source 1..24: mol_type = other DNA
cgacgactcattaatgagtcgtcg

SEQ ID NO: 2880 - DNA, 24 bp, synthetic construct
  misc_feature 1..24: note = Description of Artificial Sequence: Syntheticoligonucleotide
  source 1..24: mol_type = other DNA
cggagactcattaatgagtctccg

SEQ ID NO: 2881 - DNA, 24 bp, synthetic construct
  misc_feature 1..24: note = Description of Artificial Sequence: Syntheticoligonucleotide
  source 1..24: mol_type = other DNA
ctgcgactcattaatgagtcgcag

SEQ ID NO: 2882 - DNA, 24 bp, synthetic construct
  misc_feature 1..24: note = Description of Artificial Sequence: Syntheticoligonucleotide
  source 1..24: mol_type = other DNA
cggtgactcattaatgagtcaccg

SEQ ID NO: 2883 - DNA, 24 bp, synthetic construct
  misc_feature 1..24: note = Description of Artificial Sequence: Syntheticoligonucleotide
  source 1..24: mol_type = other DNA
cacggactcattaatgagtccgtg

SEQ ID NO: 2884 - DNA, 24 bp, synthetic construct
  misc_feature 1..24: note = Description of Artificial Sequence: Syntheticoligonucleotide
  source 1..24: mol_type = other DNA
cccagactcattaatgagtctggg

SEQ ID NO: 2885 - DNA, 24 bp, synthetic construct
  misc_feature 1..24: note = Description of Artificial Sequence: Syntheticoligonucleotide
  source 1..24: mol_type = other DNA
ctcggactcattaatgagtccgag

SEQ ID NO: 2886 - DNA, 24 bp, synthetic construct
  misc_feature 1..24: note = Description of Artificial Sequence: Syntheticoligonucleotide
  source 1..24: mol_type = other DNA
ccctgactcattaatgagtcaggg

SEQ ID NO: 2887 - DNA, 24 bp, synthetic construct
  misc_feature 1..24: note = Description of Artificial Sequence: Syntheticoligonucleotide
  source 1..24: mol_type = other DNA
ccacgactcattaatgagtcgtgg

SEQ ID NO: 2888 - DNA, 24 bp, synthetic construct
  misc_feature 1..24: note = Description of Artificial Sequence: Syntheticoligonucleotide
  source 1..24: mol_type = other DNA
agccgactcattaatgagtcggct

SEQ ID NO: 2889 - DNA, 24 bp, synthetic construct
  misc_feature 1..24: note = Description of Artificial Sequence: Syntheticoligonucleotide
  source 1..24: mol_type = other DNA
tgccgactcattaatgagtcggca

SEQ ID NO: 2890 - DNA, 24 bp, synthetic construct
  misc_feature 1..24: note = Description of Artificial Sequence: Syntheticoligonucleotide
  source 1..24: mol_type = other DNA
gcgagactcattaatgagtctcgc

SEQ ID NO: 2891 - DNA, 24 bp, synthetic construct
  misc_feature 1..24: note = Description of Artificial Sequence: Syntheticoligonucleotide
  source 1..24: mol_type = other DNA
gcgtgactcattaatgagtcacgc

SEQ ID NO: 2892 - DNA, 24 bp, synthetic construct
  misc_feature 1..24: note = Description of Artificial Sequence: Syntheticoligonucleotide
  source 1..24: mol_type = other DNA
gcaggactcattaatgagtcctgc

SEQ ID NO: 2893 - DNA, 24 bp, synthetic construct
  misc_feature 1..24: note = Description of Artificial Sequence: Syntheticoligonucleotide
  source 1..24: mol_type = other DNA
gctggactcattaatgagtccagc

SEQ ID NO: 2894 - DNA, 24 bp, synthetic construct
  misc_feature 1..24: note = Description of Artificial Sequence: Syntheticoligonucleotide
  source 1..24: mol_type = other DNA
cgaggactcattaatgagtcctcg

SEQ ID NO: 2895 - DNA, 24 bp, synthetic construct
  misc_feature 1..24: note = Description of Artificial Sequence: Syntheticoligonucleotide
  source 1..24: mol_type = other DNA
cgtggactcattaatgagtccacg

SEQ ID NO: 2896 - DNA, 24 bp, synthetic construct
  misc_feature 1..24: note = Description of Artificial Sequence: Syntheticoligonucleotide
  source 1..24: mol_type = other DNA
caccgactcattaatgagtcggtg

SEQ ID NO: 2897 - DNA, 24 bp, synthetic construct
  misc_feature 1..24: note = Description of Artificial Sequence: Syntheticoligonucleotide
  source 1..24: mol_type = other DNA
ctccgactcattaatgagtcggag

SEQ ID NO: 2898 - DNA, 24 bp, synthetic construct
  misc_feature 1..24: note = Description of Artificial Sequence: Syntheticoligonucleotide
  source 1..24: mol_type = other DNA
gcgggactcattaatgagtcccgc

SEQ ID NO: 2899 - DNA, 24 bp, synthetic construct
  misc_feature 1..24: note = Description of Artificial Sequence: Syntheticoligonucleotide
  source 1..24: mol_type = other DNA
gagggactcattaatgagtccctc

SEQ ID NO: 2900 - DNA, 24 bp, synthetic construct
  misc_feature 1..24: note = Description of Artificial Sequence: Syntheticoligonucleotide
  source 1..24: mol_type = other DNA
gtgggactcattaatgagtcccac

SEQ ID NO: 2901 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcatgcatgagtcnnnn

SEQ ID NO: 2902 - DNA, 24 bp, synthetic construct
  misc_feature 1..24: note = Description of Artificial Sequence: Syntheticoligonucleotide
  source 1..24: mol_type = other DNA
ggcggactcatgcatgagtccgcc

SEQ ID NO: 2903 - DNA, 24 bp, synthetic construct
  misc_feature 1..24: note = Description of Artificial Sequence: Syntheticoligonucleotide
  source 1..24: mol_type = other DNA
agcggactcatgcatgagtccgct

SEQ ID NO: 2904 - DNA, 24 bp, synthetic construct
  misc_feature 1..24: note = Description of Artificial Sequence: Syntheticoligonucleotide
  source 1..24: mol_type = other DNA
gacggactcatgcatgagtccgtc

SEQ ID NO: 2905 - DNA, 24 bp, synthetic construct
  misc_feature 1..24: note = Description of Artificial Sequence: Syntheticoligonucleotide
  source 1..24: mol_type = other DNA
ggaggactcatgcatgagtcctcc

SEQ ID NO: 2906 - DNA, 24 bp, synthetic construct
  misc_feature 1..24: note = Description of Artificial Sequence: Syntheticoligonucleotide
  source 1..24: mol_type = other DNA
ggcagactcatgcatgagtctgcc

SEQ ID NO: 2907 - DNA, 24 bp, synthetic construct
  misc_feature 1..24: note = Description of Artificial Sequence: Syntheticoligonucleotide
  source 1..24: mol_type = other DNA
tgcggactcatgcatgagtccgca

SEQ ID NO: 2908 - DNA, 24 bp, synthetic construct
  misc_feature 1..24: note = Description of Artificial Sequence: Syntheticoligonucleotide
  source 1..24: mol_type = other DNA
gtcggactcatgcatgagtccgac

SEQ ID NO: 2909 - DNA, 24 bp, synthetic construct
  misc_feature 1..24: note = Description of Artificial Sequence: Syntheticoligonucleotide
  source 1..24: mol_type = other DNA
ggtggactcatgcatgagtccacc

SEQ ID NO: 2910 - DNA, 24 bp, synthetic construct
  misc_feature 1..24: note = Description of Artificial Sequence: Syntheticoligonucleotide
  source 1..24: mol_type = other DNA
ggctgactcatgcatgagtcagcc

SEQ ID NO: 2911 - DNA, 24 bp, synthetic construct
  misc_feature 1..24: note = Description of Artificial Sequence: Syntheticoligonucleotide
  source 1..24: mol_type = other DNA
gcccgactcatgcatgagtcgggc

SEQ ID NO: 2912 - DNA, 24 bp, synthetic construct
  misc_feature 1..24: note = Description of Artificial Sequence: Syntheticoligonucleotide
  source 1..24: mol_type = other DNA
acccgactcatgcatgagtcgggt

SEQ ID NO: 2913 - DNA, 24 bp, synthetic construct
  misc_feature 1..24: note = Description of Artificial Sequence: Syntheticoligonucleotide
  source 1..24: mol_type = other DNA
gaccgactcatgcatgagtcggtc

SEQ ID NO: 2914 - DNA, 24 bp, synthetic construct
  misc_feature 1..24: note = Description of Artificial Sequence: Syntheticoligonucleotide
  source 1..24: mol_type = other DNA
gcacgactcatgcatgagtcgtgc

SEQ ID NO: 2915 - DNA, 24 bp, synthetic construct
  misc_feature 1..24: note = Description of Artificial Sequence: Syntheticoligonucleotide
  source 1..24: mol_type = other DNA
gccagactcatgcatgagtctggc

SEQ ID NO: 2916 - DNA, 24 bp, synthetic construct
  misc_feature 1..24: note = Description of Artificial Sequence: Syntheticoligonucleotide
  source 1..24: mol_type = other DNA
tcccgactcatgcatgagtcggga

SEQ ID NO: 2917 - DNA, 24 bp, synthetic construct
  misc_feature 1..24: note = Description of Artificial Sequence: Syntheticoligonucleotide
  source 1..24: mol_type = other DNA
gtccgactcatgcatgagtcggac

SEQ ID NO: 2918 - DNA, 24 bp, synthetic construct
  misc_feature 1..24: note = Description of Artificial Sequence: Syntheticoligonucleotide
  source 1..24: mol_type = other DNA
gcctgactcatgcatgagtcaggc

SEQ ID NO: 2919 - DNA, 24 bp, synthetic construct
  misc_feature 1..24: note = Description of Artificial Sequence: Syntheticoligonucleotide
  source 1..24: mol_type = other DNA
gggcgactcatgcatgagtcgccc

SEQ ID NO: 2920 - DNA, 24 bp, synthetic construct
  misc_feature 1..24: note = Description of Artificial Sequence: Syntheticoligonucleotide
  source 1..24: mol_type = other DNA
aggcgactcatgcatgagtcgcct

SEQ ID NO: 2921 - DNA, 24 bp, synthetic construct
  misc_feature 1..24: note = Description of Artificial Sequence: Syntheticoligonucleotide
  source 1..24: mol_type = other DNA
gagcgactcatgcatgagtcgctc

SEQ ID NO: 2922 - DNA, 24 bp, synthetic construct
  misc_feature 1..24: note = Description of Artificial Sequence: Syntheticoligonucleotide
  source 1..24: mol_type = other DNA
ggacgactcatgcatgagtcgtcc

SEQ ID NO: 2923 - DNA, 24 bp, synthetic construct
  misc_feature 1..24: note = Description of Artificial Sequence: Syntheticoligonucleotide
  source 1..24: mol_type = other DNA
gggagactcatgcatgagtctccc

SEQ ID NO: 2924 - DNA, 24 bp, synthetic construct
  misc_feature 1..24: note = Description of Artificial Sequence: Syntheticoligonucleotide
  source 1..24: mol_type = other DNA
tggcgactcatgcatgagtcgcca

SEQ ID NO: 2925 - DNA, 24 bp, synthetic construct
  misc_feature 1..24: note = Description of Artificial Sequence: Syntheticoligonucleotide
  source 1..24: mol_type = other DNA
gtgcgactcatgcatgagtcgcac

SEQ ID NO: 2926 - DNA, 24 bp, synthetic construct
  misc_feature 1..24: note = Description of Artificial Sequence: Syntheticoligonucleotide
  source 1..24: mol_type = other DNA
gggtgactcatgcatgagtcaccc

SEQ ID NO: 2927 - DNA, 24 bp, synthetic construct
  misc_feature 1..24: note = Description of Artificial Sequence: Syntheticoligonucleotide
  source 1..24: mol_type = other DNA
acgggactcatgcatgagtcccgt

SEQ ID NO: 2928 - DNA, 24 bp, synthetic construct
  misc_feature 1..24: note = Description of Artificial Sequence: Syntheticoligonucleotide
  source 1..24: mol_type = other DNA
cagggactcatgcatgagtccctg

SEQ ID NO: 2929 - DNA, 24 bp, synthetic construct
  misc_feature 1..24: note = Description of Artificial Sequence: Syntheticoligonucleotide
  source 1..24: mol_type = other DNA
ccaggactcatgcatgagtcctgg

SEQ ID NO: 2930 - DNA, 24 bp, synthetic construct
  misc_feature 1..24: note = Description of Artificial Sequence: Syntheticoligonucleotide
  source 1..24: mol_type = other DNA
ccgagactcatgcatgagtctcgg

SEQ ID NO: 2931 - DNA, 24 bp, synthetic construct
  misc_feature 1..24: note = Description of Artificial Sequence: Syntheticoligonucleotide
  source 1..24: mol_type = other DNA
tcgggactcatgcatgagtcccga

SEQ ID NO: 2932 - DNA, 24 bp, synthetic construct
  misc_feature 1..24: note = Description of Artificial Sequence: Syntheticoligonucleotide
  source 1..24: mol_type = other DNA
ctgggactcatgcatgagtcccag

SEQ ID NO: 2933 - DNA, 24 bp, synthetic construct
  misc_feature 1..24: note = Description of Artificial Sequence: Syntheticoligonucleotide
  source 1..24: mol_type = other DNA
cctggactcatgcatgagtccagg

SEQ ID NO: 2934 - DNA, 24 bp, synthetic construct
  misc_feature 1..24: note = Description of Artificial Sequence: Syntheticoligonucleotide
  source 1..24: mol_type = other DNA
ccgtgactcatgcatgagtcacgg

SEQ ID NO: 2935 - DNA, 24 bp, synthetic construct
  misc_feature 1..24: note = Description of Artificial Sequence: Syntheticoligonucleotide
  source 1..24: mol_type = other DNA
cggcgactcatgcatgagtcgccg

SEQ ID NO: 2936 - DNA, 24 bp, synthetic construct
  misc_feature 1..24: note = Description of Artificial Sequence: Syntheticoligonucleotide
  source 1..24: mol_type = other DNA
cagcgactcatgcatgagtcgctg

SEQ ID NO: 2937 - DNA, 24 bp, synthetic construct
  misc_feature 1..24: note = Description of Artificial Sequence: Syntheticoligonucleotide
  source 1..24: mol_type = other DNA
cgacgactcatgcatgagtcgtcg

SEQ ID NO: 2938 - DNA, 24 bp, synthetic construct
  misc_feature 1..24: note = Description of Artificial Sequence: Syntheticoligonucleotide
  source 1..24: mol_type = other DNA
cggagactcatgcatgagtctccg

SEQ ID NO: 2939 - DNA, 24 bp, synthetic construct
  misc_feature 1..24: note = Description of Artificial Sequence: Syntheticoligonucleotide
  source 1..24: mol_type = other DNA
ctgcgactcatgcatgagtcgcag

SEQ ID NO: 2940 - DNA, 24 bp, synthetic construct
  misc_feature 1..24: note = Description of Artificial Sequence: Syntheticoligonucleotide
  source 1..24: mol_type = other DNA
cggtgactcatgcatgagtcaccg

SEQ ID NO: 2941 - DNA, 24 bp, synthetic construct
  misc_feature 1..24: note = Description of Artificial Sequence: Syntheticoligonucleotide
  source 1..24: mol_type = other DNA
cacggactcatgcatgagtccgtg

SEQ ID NO: 2942 - DNA, 24 bp, synthetic construct
  misc_feature 1..24: note = Description of Artificial Sequence: Syntheticoligonucleotide
  source 1..24: mol_type = other DNA
cccagactcatgcatgagtctggg

SEQ ID NO: 2943 - DNA, 24 bp, synthetic construct
  misc_feature 1..24: note = Description of Artificial Sequence: Syntheticoligonucleotide
  source 1..24: mol_type = other DNA
ctcggactcatgcatgagtccgag

SEQ ID NO: 2944 - DNA, 24 bp, synthetic construct
  misc_feature 1..24: note = Description of Artificial Sequence: Syntheticoligonucleotide
  source 1..24: mol_type = other DNA
ccctgactcatgcatgagtcaggg

SEQ ID NO: 2945 - DNA, 24 bp, synthetic construct
  misc_feature 1..24: note = Description of Artificial Sequence: Syntheticoligonucleotide
  source 1..24: mol_type = other DNA
ccacgactcatgcatgagtcgtgg

SEQ ID NO: 2946 - DNA, 24 bp, synthetic construct
  misc_feature 1..24: note = Description of Artificial Sequence: Syntheticoligonucleotide
  source 1..24: mol_type = other DNA
agccgactcatgcatgagtcggct

SEQ ID NO: 2947 - DNA, 24 bp, synthetic construct
  misc_feature 1..24: note = Description of Artificial Sequence: Syntheticoligonucleotide
  source 1..24: mol_type = other DNA
tgccgactcatgcatgagtcggca

SEQ ID NO: 2948 - DNA, 24 bp, synthetic construct
  misc_feature 1..24: note = Description of Artificial Sequence: Syntheticoligonucleotide
  source 1..24: mol_type = other DNA
gcgagactcatgcatgagtctcgc

SEQ ID NO: 2949 - DNA, 24 bp, synthetic construct
  misc_feature 1..24: note = Description of Artificial Sequence: Syntheticoligonucleotide
  source 1..24: mol_type = other DNA
gcgtgactcatgcatgagtcacgc

SEQ ID NO: 2950 - DNA, 24 bp, synthetic construct
  misc_feature 1..24: note = Description of Artificial Sequence: Syntheticoligonucleotide
  source 1..24: mol_type = other DNA
gcaggactcatgcatgagtcctgc

SEQ ID NO: 2951 - DNA, 24 bp, synthetic construct
  misc_feature 1..24: note = Description of Artificial Sequence: Syntheticoligonucleotide
  source 1..24: mol_type = other DNA
gctggactcatgcatgagtccagc

SEQ ID NO: 2952 - DNA, 24 bp, synthetic construct
  misc_feature 1..24: note = Description of Artificial Sequence: Syntheticoligonucleotide
  source 1..24: mol_type = other DNA
cgaggactcatgcatgagtcctcg

SEQ ID NO: 2953 - DNA, 24 bp, synthetic construct
  misc_feature 1..24: note = Description of Artificial Sequence: Syntheticoligonucleotide
  source 1..24: mol_type = other DNA
cgtggactcatgcatgagtccacg

SEQ ID NO: 2954 - DNA, 24 bp, synthetic construct
  misc_feature 1..24: note = Description of Artificial Sequence: Syntheticoligonucleotide
  source 1..24: mol_type = other DNA
caccgactcatgcatgagtcggtg

SEQ ID NO: 2955 - DNA, 24 bp, synthetic construct
  misc_feature 1..24: note = Description of Artificial Sequence: Syntheticoligonucleotide
  source 1..24: mol_type = other DNA
ctccgactcatgcatgagtcggag

SEQ ID NO: 2956 - DNA, 24 bp, synthetic construct
  misc_feature 1..24: note = Description of Artificial Sequence: Syntheticoligonucleotide
  source 1..24: mol_type = other DNA
gcgggactcatgcatgagtcccgc

SEQ ID NO: 2957 - DNA, 24 bp, synthetic construct
  misc_feature 1..24: note = Description of Artificial Sequence: Syntheticoligonucleotide
  source 1..24: mol_type = other DNA
gagggactcatgcatgagtccctc

SEQ ID NO: 2958 - DNA, 24 bp, synthetic construct
  misc_feature 1..24: note = Description of Artificial Sequence: Syntheticoligonucleotide
  source 1..24: mol_type = other DNA
gtgggactcatgcatgagtcccac

SEQ ID NO: 2959 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcatcgatgagtcnnnn

SEQ ID NO: 2960 - DNA, 24 bp, synthetic construct
  misc_feature 1..24: note = Description of Artificial Sequence: Syntheticoligonucleotide
  source 1..24: mol_type = other DNA
ggcggactcatcgatgagtccgcc

SEQ ID NO: 2961 - DNA, 24 bp, synthetic construct
  misc_feature 1..24: note = Description of Artificial Sequence: Syntheticoligonucleotide
  source 1..24: mol_type = other DNA
agcggactcatcgatgagtccgct

SEQ ID NO: 2962 - DNA, 24 bp, synthetic construct
  misc_feature 1..24: note = Description of Artificial Sequence: Syntheticoligonucleotide
  source 1..24: mol_type = other DNA
gacggactcatcgatgagtccgtc

SEQ ID NO: 2963 - DNA, 24 bp, synthetic construct
  misc_feature 1..24: note = Description of Artificial Sequence: Syntheticoligonucleotide
  source 1..24: mol_type = other DNA
ggaggactcatcgatgagtcctcc

SEQ ID NO: 2964 - DNA, 24 bp, synthetic construct
  misc_feature 1..24: note = Description of Artificial Sequence: Syntheticoligonucleotide
  source 1..24: mol_type = other DNA
ggcagactcatcgatgagtctgcc

SEQ ID NO: 2965 - DNA, 24 bp, synthetic construct
  misc_feature 1..24: note = Description of Artificial Sequence: Syntheticoligonucleotide
  source 1..24: mol_type = other DNA
tgcggactcatcgatgagtccgca

SEQ ID NO: 2966 - DNA, 24 bp, synthetic construct
  misc_feature 1..24: note = Description of Artificial Sequence: Syntheticoligonucleotide
  source 1..24: mol_type = other DNA
gtcggactcatcgatgagtccgac

SEQ ID NO: 2967 - DNA, 24 bp, synthetic construct
  misc_feature 1..24: note = Description of Artificial Sequence: Syntheticoligonucleotide
  source 1..24: mol_type = other DNA
ggtggactcatcgatgagtccacc

SEQ ID NO: 2968 - DNA, 24 bp, synthetic construct
  misc_feature 1..24: note = Description of Artificial Sequence: Syntheticoligonucleotide
  source 1..24: mol_type = other DNA
ggctgactcatcgatgagtcagcc

SEQ ID NO: 2969 - DNA, 24 bp, synthetic construct
  misc_feature 1..24: note = Description of Artificial Sequence: Syntheticoligonucleotide
  source 1..24: mol_type = other DNA
gcccgactcatcgatgagtcgggc

SEQ ID NO: 2970 - DNA, 24 bp, synthetic construct
  misc_feature 1..24: note = Description of Artificial Sequence: Syntheticoligonucleotide
  source 1..24: mol_type = other DNA
acccgactcatcgatgagtcgggt

SEQ ID NO: 2971 - DNA, 24 bp, synthetic construct
  misc_feature 1..24: note = Description of Artificial Sequence: Syntheticoligonucleotide
  source 1..24: mol_type = other DNA
gaccgactcatcgatgagtcggtc

SEQ ID NO: 2972 - DNA, 24 bp, synthetic construct
  misc_feature 1..24: note = Description of Artificial Sequence: Syntheticoligonucleotide
  source 1..24: mol_type = other DNA
gcacgactcatcgatgagtcgtgc

SEQ ID NO: 2973 - DNA, 24 bp, synthetic construct
  misc_feature 1..24: note = Description of Artificial Sequence: Syntheticoligonucleotide
  source 1..24: mol_type = other DNA
gccagactcatcgatgagtctggc

SEQ ID NO: 2974 - DNA, 24 bp, synthetic construct
  misc_feature 1..24: note = Description of Artificial Sequence: Syntheticoligonucleotide
  source 1..24: mol_type = other DNA
tcccgactcatcgatgagtcggga

SEQ ID NO: 2975 - DNA, 24 bp, synthetic construct
  misc_feature 1..24: note = Description of Artificial Sequence: Syntheticoligonucleotide
  source 1..24: mol_type = other DNA
gtccgactcatcgatgagtcggac

SEQ ID NO: 2976 - DNA, 24 bp, synthetic construct
  misc_feature 1..24: note = Description of Artificial Sequence: Syntheticoligonucleotide
  source 1..24: mol_type = other DNA
gcctgactcatcgatgagtcaggc

SEQ ID NO: 2977 - DNA, 24 bp, synthetic construct
  misc_feature 1..24: note = Description of Artificial Sequence: Syntheticoligonucleotide
  source 1..24: mol_type = other DNA
gggcgactcatcgatgagtcgccc

SEQ ID NO: 2978 - DNA, 24 bp, synthetic construct
  misc_feature 1..24: note = Description of Artificial Sequence: Syntheticoligonucleotide
  source 1..24: mol_type = other DNA
aggcgactcatcgatgagtcgcct

SEQ ID NO: 2979 - DNA, 24 bp, synthetic construct
  misc_feature 1..24: note = Description of Artificial Sequence: Syntheticoligonucleotide
  source 1..24: mol_type = other DNA
gagcgactcatcgatgagtcgctc

SEQ ID NO: 2980 - DNA, 24 bp, synthetic construct
  misc_feature 1..24: note = Description of Artificial Sequence: Syntheticoligonucleotide
  source 1..24: mol_type = other DNA
ggacgactcatcgatgagtcgtcc

SEQ ID NO: 2981 - DNA, 24 bp, synthetic construct
  misc_feature 1..24: note = Description of Artificial Sequence: Syntheticoligonucleotide
  source 1..24: mol_type = other DNA
gggagactcatcgatgagtctccc

SEQ ID NO: 2982 - DNA, 24 bp, synthetic construct
  misc_feature 1..24: note = Description of Artificial Sequence: Syntheticoligonucleotide
  source 1..24: mol_type = other DNA
tggcgactcatcgatgagtcgcca

SEQ ID NO: 2983 - DNA, 24 bp, synthetic construct
  misc_feature 1..24: note = Description of Artificial Sequence: Syntheticoligonucleotide
  source 1..24: mol_type = other DNA
gtgcgactcatcgatgagtcgcac

SEQ ID NO: 2984 - DNA, 24 bp, synthetic construct
  misc_feature 1..24: note = Description of Artificial Sequence: Syntheticoligonucleotide
  source 1..24: mol_type = other DNA
gggtgactcatcgatgagtcaccc

SEQ ID NO: 2985 - DNA, 24 bp, synthetic construct
  misc_feature 1..24: note = Description of Artificial Sequence: Syntheticoligonucleotide
  source 1..24: mol_type = other DNA
acgggactcatcgatgagtcccgt

SEQ ID NO: 2986 - DNA, 24 bp, synthetic construct
  misc_feature 1..24: note = Description of Artificial Sequence: Syntheticoligonucleotide
  source 1..24: mol_type = other DNA
cagggactcatcgatgagtccctg

SEQ ID NO: 2987 - DNA, 24 bp, synthetic construct
  misc_feature 1..24: note = Description of Artificial Sequence: Syntheticoligonucleotide
  source 1..24: mol_type = other DNA
ccaggactcatcgatgagtcctgg

SEQ ID NO: 2988 - DNA, 24 bp, synthetic construct
  misc_feature 1..24: note = Description of Artificial Sequence: Syntheticoligonucleotide
  source 1..24: mol_type = other DNA
ccgagactcatcgatgagtctcgg

SEQ ID NO: 2989 - DNA, 24 bp, synthetic construct
  misc_feature 1..24: note = Description of Artificial Sequence: Syntheticoligonucleotide
  source 1..24: mol_type = other DNA
tcgggactcatcgatgagtcccga

SEQ ID NO: 2990 - DNA, 24 bp, synthetic construct
  misc_feature 1..24: note = Description of Artificial Sequence: Syntheticoligonucleotide
  source 1..24: mol_type = other DNA
ctgggactcatcgatgagtcccag

SEQ ID NO: 2991 - DNA, 24 bp, synthetic construct
  misc_feature 1..24: note = Description of Artificial Sequence: Syntheticoligonucleotide
  source 1..24: mol_type = other DNA
cctggactcatcgatgagtccagg

SEQ ID NO: 2992 - DNA, 24 bp, synthetic construct
  misc_feature 1..24: note = Description of Artificial Sequence: Syntheticoligonucleotide
  source 1..24: mol_type = other DNA
ccgtgactcatcgatgagtcacgg

SEQ ID NO: 2993 - DNA, 24 bp, synthetic construct
  misc_feature 1..24: note = Description of Artificial Sequence: Syntheticoligonucleotide
  source 1..24: mol_type = other DNA
cggcgactcatcgatgagtcgccg

SEQ ID NO: 2994 - DNA, 24 bp, synthetic construct
  misc_feature 1..24: note = Description of Artificial Sequence: Syntheticoligonucleotide
  source 1..24: mol_type = other DNA
cagcgactcatcgatgagtcgctg

SEQ ID NO: 2995 - DNA, 24 bp, synthetic construct
  misc_feature 1..24: note = Description of Artificial Sequence: Syntheticoligonucleotide
  source 1..24: mol_type = other DNA
cgacgactcatcgatgagtcgtcg

SEQ ID NO: 2996 - DNA, 24 bp, synthetic construct
  misc_feature 1..24: note = Description of Artificial Sequence: Syntheticoligonucleotide
  source 1..24: mol_type = other DNA
cggagactcatcgatgagtctccg

SEQ ID NO: 2997 - DNA, 24 bp, synthetic construct
  misc_feature 1..24: note = Description of Artificial Sequence: Syntheticoligonucleotide
  source 1..24: mol_type = other DNA
ctgcgactcatcgatgagtcgcag

SEQ ID NO: 2998 - DNA, 24 bp, synthetic construct
  misc_feature 1..24: note = Description of Artificial Sequence: Syntheticoligonucleotide
  source 1..24: mol_type = other DNA
cggtgactcatcgatgagtcaccg

SEQ ID NO: 2999 - DNA, 24 bp, synthetic construct
  misc_feature 1..24: note = Description of Artificial Sequence: Syntheticoligonucleotide
  source 1..24: mol_type = other DNA
cacggactcatcgatgagtccgtg

SEQ ID NO: 3000 - DNA, 24 bp, synthetic construct
  misc_feature 1..24: note = Description of Artificial Sequence: Syntheticoligonucleotide
  source 1..24: mol_type = other DNA
cccagactcatcgatgagtctggg

SEQ ID NO: 3001 - DNA, 24 bp, synthetic construct
  misc_feature 1..24: note = Description of Artificial Sequence: Syntheticoligonucleotide
  source 1..24: mol_type = other DNA
ctcggactcatcgatgagtccgag

SEQ ID NO: 3002 - DNA, 24 bp, synthetic construct
  misc_feature 1..24: note = Description of Artificial Sequence: Syntheticoligonucleotide
  source 1..24: mol_type = other DNA
ccctgactcatcgatgagtcaggg

SEQ ID NO: 3003 - DNA, 24 bp, synthetic construct
  misc_feature 1..24: note = Description of Artificial Sequence: Syntheticoligonucleotide
  source 1..24: mol_type = other DNA
ccacgactcatcgatgagtcgtgg

SEQ ID NO: 3004 - DNA, 24 bp, synthetic construct
  misc_feature 1..24: note = Description of Artificial Sequence: Syntheticoligonucleotide
  source 1..24: mol_type = other DNA
agccgactcatcgatgagtcggct

SEQ ID NO: 3005 - DNA, 24 bp, synthetic construct
  misc_feature 1..24: note = Description of Artificial Sequence: Syntheticoligonucleotide
  source 1..24: mol_type = other DNA
tgccgactcatcgatgagtcggca

SEQ ID NO: 3006 - DNA, 24 bp, synthetic construct
  misc_feature 1..24: note = Description of Artificial Sequence: Syntheticoligonucleotide
  source 1..24: mol_type = other DNA
gcgagactcatcgatgagtctcgc

SEQ ID NO: 3007 - DNA, 24 bp, synthetic construct
  misc_feature 1..24: note = Description of Artificial Sequence: Syntheticoligonucleotide
  source 1..24: mol_type = other DNA
gcgtgactcatcgatgagtcacgc

SEQ ID NO: 3008 - DNA, 24 bp, synthetic construct
  misc_feature 1..24: note = Description of Artificial Sequence: Syntheticoligonucleotide
  source 1..24: mol_type = other DNA
gcaggactcatcgatgagtcctgc

SEQ ID NO: 3009 - DNA, 24 bp, synthetic construct
  misc_feature 1..24: note = Description of Artificial Sequence: Syntheticoligonucleotide
  source 1..24: mol_type = other DNA
gctggactcatcgatgagtccagc

SEQ ID NO: 3010 - DNA, 24 bp, synthetic construct
  misc_feature 1..24: note = Description of Artificial Sequence: Syntheticoligonucleotide
  source 1..24: mol_type = other DNA
cgaggactcatcgatgagtcctcg

SEQ ID NO: 3011 - DNA, 24 bp, synthetic construct
  misc_feature 1..24: note = Description of Artificial Sequence: Syntheticoligonucleotide
  source 1..24: mol_type = other DNA
cgtggactcatcgatgagtccacg

SEQ ID NO: 3012 - DNA, 24 bp, synthetic construct
  misc_feature 1..24: note = Description of Artificial Sequence: Syntheticoligonucleotide
  source 1..24: mol_type = other DNA
caccgactcatcgatgagtcggtg

SEQ ID NO: 3013 - DNA, 24 bp, synthetic construct
  misc_feature 1..24: note = Description of Artificial Sequence: Syntheticoligonucleotide
  source 1..24: mol_type = other DNA
ctccgactcatcgatgagtcggag

SEQ ID NO: 3014 - DNA, 24 bp, synthetic construct
  misc_feature 1..24: note = Description of Artificial Sequence: Syntheticoligonucleotide
  source 1..24: mol_type = other DNA
gcgggactcatcgatgagtcccgc

SEQ ID NO: 3015 - DNA, 24 bp, synthetic construct
  misc_feature 1..24: note = Description of Artificial Sequence: Syntheticoligonucleotide
  source 1..24: mol_type = other DNA
gagggactcatcgatgagtccctc

SEQ ID NO: 3016 - DNA, 24 bp, synthetic construct
  misc_feature 1..24: note = Description of Artificial Sequence: Syntheticoligonucleotide
  source 1..24: mol_type = other DNA
gtgggactcatcgatgagtcccac

SEQ ID NO: 3017 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcttataagagtcnnnn

SEQ ID NO: 3018 - DNA, 24 bp, synthetic construct
  misc_feature 1..24: note = Description of Artificial Sequence: Syntheticoligonucleotide
  source 1..24: mol_type = other DNA
ggcggactcttataagagtccgcc

SEQ ID NO: 3019 - DNA, 24 bp, synthetic construct
  misc_feature 1..24: note = Description of Artificial Sequence: Syntheticoligonucleotide
  source 1..24: mol_type = other DNA
agcggactcttataagagtccgct

SEQ ID NO: 3020 - DNA, 24 bp, synthetic construct
  misc_feature 1..24: note = Description of Artificial Sequence: Syntheticoligonucleotide
  source 1..24: mol_type = other DNA
gacggactcttataagagtccgtc

SEQ ID NO: 3021 - DNA, 24 bp, synthetic construct
  misc_feature 1..24: note = Description of Artificial Sequence: Syntheticoligonucleotide
  source 1..24: mol_type = other DNA
ggaggactcttataagagtcctcc

SEQ ID NO: 3022 - DNA, 24 bp, synthetic construct
  misc_feature 1..24: note = Description of Artificial Sequence: Syntheticoligonucleotide
  source 1..24: mol_type = other DNA
ggcagactcttataagagtctgcc

SEQ ID NO: 3023 - DNA, 24 bp, synthetic construct
  misc_feature 1..24: note = Description of Artificial Sequence: Syntheticoligonucleotide
  source 1..24: mol_type = other DNA
tgcggactcttataagagtccgca

SEQ ID NO: 3024 - DNA, 24 bp, synthetic construct
  misc_feature 1..24: note = Description of Artificial Sequence: Syntheticoligonucleotide
  source 1..24: mol_type = other DNA
gtcggactcttataagagtccgac

SEQ ID NO: 3025 - DNA, 24 bp, synthetic construct
  misc_feature 1..24: note = Description of Artificial Sequence: Syntheticoligonucleotide
  source 1..24: mol_type = other DNA
ggtggactcttataagagtccacc

SEQ ID NO: 3026 - DNA, 24 bp, synthetic construct
  misc_feature 1..24: note = Description of Artificial Sequence: Syntheticoligonucleotide
  source 1..24: mol_type = other DNA
ggctgactcttataagagtcagcc

SEQ ID NO: 3027 - DNA, 24 bp, synthetic construct
  misc_feature 1..24: note = Description of Artificial Sequence: Syntheticoligonucleotide
  source 1..24: mol_type = other DNA
gcccgactcttataagagtcgggc

SEQ ID NO: 3028 - DNA, 24 bp, synthetic construct
  misc_feature 1..24: note = Description of Artificial Sequence: Syntheticoligonucleotide
  source 1..24: mol_type = other DNA
acccgactcttataagagtcgggt

SEQ ID NO: 3029 - DNA, 24 bp, synthetic construct
  misc_feature 1..24: note = Description of Artificial Sequence: Syntheticoligonucleotide
  source 1..24: mol_type = other DNA
gaccgactcttataagagtcggtc

SEQ ID NO: 3030 - DNA, 24 bp, synthetic construct
  misc_feature 1..24: note = Description of Artificial Sequence: Syntheticoligonucleotide
  source 1..24: mol_type = other DNA
gcacgactcttataagagtcgtgc

SEQ ID NO: 3031 - DNA, 24 bp, synthetic construct
  misc_feature 1..24: note = Description of Artificial Sequence: Syntheticoligonucleotide
  source 1..24: mol_type = other DNA
gccagactcttataagagtctggc

SEQ ID NO: 3032 - DNA, 24 bp, synthetic construct
  misc_feature 1..24: note = Description of Artificial Sequence: Syntheticoligonucleotide
  source 1..24: mol_type = other DNA
tcccgactcttataagagtcggga

SEQ ID NO: 3033 - DNA, 24 bp, synthetic construct
  misc_feature 1..24: note = Description of Artificial Sequence: Syntheticoligonucleotide
  source 1..24: mol_type = other DNA
gtccgactcttataagagtcggac

SEQ ID NO: 3034 - DNA, 24 bp, synthetic construct
  misc_feature 1..24: note = Description of Artificial Sequence: Syntheticoligonucleotide
  source 1..24: mol_type = other DNA
gcctgactcttataagagtcaggc

SEQ ID NO: 3035 - DNA, 24 bp, synthetic construct
  misc_feature 1..24: note = Description of Artificial Sequence: Syntheticoligonucleotide
  source 1..24: mol_type = other DNA
gggcgactcttataagagtcgccc

SEQ ID NO: 3036 - DNA, 24 bp, synthetic construct
  misc_feature 1..24: note = Description of Artificial Sequence: Syntheticoligonucleotide
  source 1..24: mol_type = other DNA
aggcgactcttataagagtcgcct

SEQ ID NO: 3037 - DNA, 24 bp, synthetic construct
  misc_feature 1..24: note = Description of Artificial Sequence: Syntheticoligonucleotide
  source 1..24: mol_type = other DNA
gagcgactcttataagagtcgctc

SEQ ID NO: 3038 - DNA, 24 bp, synthetic construct
  misc_feature 1..24: note = Description of Artificial Sequence: Syntheticoligonucleotide
  source 1..24: mol_type = other DNA
ggacgactcttataagagtcgtcc

SEQ ID NO: 3039 - DNA, 24 bp, synthetic construct
  misc_feature 1..24: note = Description of Artificial Sequence: Syntheticoligonucleotide
  source 1..24: mol_type = other DNA
gggagactcttataagagtctccc

SEQ ID NO: 3040 - DNA, 24 bp, synthetic construct
  misc_feature 1..24: note = Description of Artificial Sequence: Syntheticoligonucleotide
  source 1..24: mol_type = other DNA
tggcgactcttataagagtcgcca

SEQ ID NO: 3041 - DNA, 24 bp, synthetic construct
  misc_feature 1..24: note = Description of Artificial Sequence: Syntheticoligonucleotide
  source 1..24: mol_type = other DNA
gtgcgactcttataagagtcgcac

SEQ ID NO: 3042 - DNA, 24 bp, synthetic construct
  misc_feature 1..24: note = Description of Artificial Sequence: Syntheticoligonucleotide
  source 1..24: mol_type = other DNA
gggtgactcttataagagtcaccc

SEQ ID NO: 3043 - DNA, 24 bp, synthetic construct
  misc_feature 1..24: note = Description of Artificial Sequence: Syntheticoligonucleotide
  source 1..24: mol_type = other DNA
acgggactcttataagagtcccgt

SEQ ID NO: 3044 - DNA, 24 bp, synthetic construct
  misc_feature 1..24: note = Description of Artificial Sequence: Syntheticoligonucleotide
  source 1..24: mol_type = other DNA
cagggactcttataagagtccctg

SEQ ID NO: 3045 - DNA, 24 bp, synthetic construct
  misc_feature 1..24: note = Description of Artificial Sequence: Syntheticoligonucleotide
  source 1..24: mol_type = other DNA
ccaggactcttataagagtcctgg

SEQ ID NO: 3046 - DNA, 24 bp, synthetic construct
  misc_feature 1..24: note = Description of Artificial Sequence: Syntheticoligonucleotide
  source 1..24: mol_type = other DNA
ccgagactcttataagagtctcgg

SEQ ID NO: 3047 - DNA, 24 bp, synthetic construct
  misc_feature 1..24: note = Description of Artificial Sequence: Syntheticoligonucleotide
  source 1..24: mol_type = other DNA
tcgggactcttataagagtcccga

SEQ ID NO: 3048 - DNA, 24 bp, synthetic construct
  misc_feature 1..24: note = Description of Artificial Sequence: Syntheticoligonucleotide
  source 1..24: mol_type = other DNA
ctgggactcttataagagtcccag

SEQ ID NO: 3049 - DNA, 24 bp, synthetic construct
  misc_feature 1..24: note = Description of Artificial Sequence: Syntheticoligonucleotide
  source 1..24: mol_type = other DNA
cctggactcttataagagtccagg

SEQ ID NO: 3050 - DNA, 24 bp, synthetic construct
  misc_feature 1..24: note = Description of Artificial Sequence: Syntheticoligonucleotide
  source 1..24: mol_type = other DNA
ccgtgactcttataagagtcacgg

SEQ ID NO: 3051 - DNA, 24 bp, synthetic construct
  misc_feature 1..24: note = Description of Artificial Sequence: Syntheticoligonucleotide
  source 1..24: mol_type = other DNA
cggcgactcttataagagtcgccg

SEQ ID NO: 3052 - DNA, 24 bp, synthetic construct
  misc_feature 1..24: note = Description of Artificial Sequence: Syntheticoligonucleotide
  source 1..24: mol_type = other DNA
cagcgactcttataagagtcgctg

SEQ ID NO: 3053 - DNA, 24 bp, synthetic construct
  misc_feature 1..24: note = Description of Artificial Sequence: Syntheticoligonucleotide
  source 1..24: mol_type = other DNA
cgacgactcttataagagtcgtcg

SEQ ID NO: 3054 - DNA, 24 bp, synthetic construct
  misc_feature 1..24: note = Description of Artificial Sequence: Syntheticoligonucleotide
  source 1..24: mol_type = other DNA
cggagactcttataagagtctccg

SEQ ID NO: 3055 - DNA, 24 bp, synthetic construct
  misc_feature 1..24: note = Description of Artificial Sequence: Syntheticoligonucleotide
  source 1..24: mol_type = other DNA
ctgcgactcttataagagtcgcag

SEQ ID NO: 3056 - DNA, 24 bp, synthetic construct
  misc_feature 1..24: note = Description of Artificial Sequence: Syntheticoligonucleotide
  source 1..24: mol_type = other DNA
cggtgactcttataagagtcaccg

SEQ ID NO: 3057 - DNA, 24 bp, synthetic construct
  misc_feature 1..24: note = Description of Artificial Sequence: Syntheticoligonucleotide
  source 1..24: mol_type = other DNA
cacggactcttataagagtccgtg

SEQ ID NO: 3058 - DNA, 24 bp, synthetic construct
  misc_feature 1..24: note = Description of Artificial Sequence: Syntheticoligonucleotide
  source 1..24: mol_type = other DNA
cccagactcttataagagtctggg

SEQ ID NO: 3059 - DNA, 24 bp, synthetic construct
  misc_feature 1..24: note = Description of Artificial Sequence: Syntheticoligonucleotide
  source 1..24: mol_type = other DNA
ctcggactcttataagagtccgag

SEQ ID NO: 3060 - DNA, 24 bp, synthetic construct
  misc_feature 1..24: note = Description of Artificial Sequence: Syntheticoligonucleotide
  source 1..24: mol_type = other DNA
ccctgactcttataagagtcaggg

SEQ ID NO: 3061 - DNA, 24 bp, synthetic construct
  misc_feature 1..24: note = Description of Artificial Sequence: Syntheticoligonucleotide
  source 1..24: mol_type = other DNA
ccacgactcttataagagtcgtgg

SEQ ID NO: 3062 - DNA, 24 bp, synthetic construct
  misc_feature 1..24: note = Description of Artificial Sequence: Syntheticoligonucleotide
  source 1..24: mol_type = other DNA
agccgactcttataagagtcggct

SEQ ID NO: 3063 - DNA, 24 bp, synthetic construct
  misc_feature 1..24: note = Description of Artificial Sequence: Syntheticoligonucleotide
  source 1..24: mol_type = other DNA
tgccgactcttataagagtcggca

SEQ ID NO: 3064 - DNA, 24 bp, synthetic construct
  misc_feature 1..24: note = Description of Artificial Sequence: Syntheticoligonucleotide
  source 1..24: mol_type = other DNA
gcgagactcttataagagtctcgc

SEQ ID NO: 3065 - DNA, 24 bp, synthetic construct
  misc_feature 1..24: note = Description of Artificial Sequence: Syntheticoligonucleotide
  source 1..24: mol_type = other DNA
gcgtgactcttataagagtcacgc

SEQ ID NO: 3066 - DNA, 24 bp, synthetic construct
  misc_feature 1..24: note = Description of Artificial Sequence: Syntheticoligonucleotide
  source 1..24: mol_type = other DNA
gcaggactcttataagagtcctgc

SEQ ID NO: 3067 - DNA, 24 bp, synthetic construct
  misc_feature 1..24: note = Description of Artificial Sequence: Syntheticoligonucleotide
  source 1..24: mol_type = other DNA
gctggactcttataagagtccagc

SEQ ID NO: 3068 - DNA, 24 bp, synthetic construct
  misc_feature 1..24: note = Description of Artificial Sequence: Syntheticoligonucleotide
  source 1..24: mol_type = other DNA
cgaggactcttataagagtcctcg

SEQ ID NO: 3069 - DNA, 24 bp, synthetic construct
  misc_feature 1..24: note = Description of Artificial Sequence: Syntheticoligonucleotide
  source 1..24: mol_type = other DNA
cgtggactcttataagagtccacg

SEQ ID NO: 3070 - DNA, 24 bp, synthetic construct
  misc_feature 1..24: note = Description of Artificial Sequence: Syntheticoligonucleotide
  source 1..24: mol_type = other DNA
caccgactcttataagagtcggtg

SEQ ID NO: 3071 - DNA, 24 bp, synthetic construct
  misc_feature 1..24: note = Description of Artificial Sequence: Syntheticoligonucleotide
  source 1..24: mol_type = other DNA
ctccgactcttataagagtcggag

SEQ ID NO: 3072 - DNA, 24 bp, synthetic construct
  misc_feature 1..24: note = Description of Artificial Sequence: Syntheticoligonucleotide
  source 1..24: mol_type = other DNA
gcgggactcttataagagtcccgc

SEQ ID NO: 3073 - DNA, 24 bp, synthetic construct
  misc_feature 1..24: note = Description of Artificial Sequence: Syntheticoligonucleotide
  source 1..24: mol_type = other DNA
gagggactcttataagagtccctc

SEQ ID NO: 3074 - DNA, 24 bp, synthetic construct
  misc_feature 1..24: note = Description of Artificial Sequence: Syntheticoligonucleotide
  source 1..24: mol_type = other DNA
gtgggactcttataagagtcccac

SEQ ID NO: 3075 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactctttaaagagtcnnnn

SEQ ID NO: 3076 - DNA, 24 bp, synthetic construct
  misc_feature 1..24: note = Description of Artificial Sequence: Syntheticoligonucleotide
  source 1..24: mol_type = other DNA
ggcggactctttaaagagtccgcc

SEQ ID NO: 3077 - DNA, 24 bp, synthetic construct
  misc_feature 1..24: note = Description of Artificial Sequence: Syntheticoligonucleotide
  source 1..24: mol_type = other DNA
agcggactctttaaagagtccgct

SEQ ID NO: 3078 - DNA, 24 bp, synthetic construct
  misc_feature 1..24: note = Description of Artificial Sequence: Syntheticoligonucleotide
  source 1..24: mol_type = other DNA
gacggactctttaaagagtccgtc

SEQ ID NO: 3079 - DNA, 24 bp, synthetic construct
  misc_feature 1..24: note = Description of Artificial Sequence: Syntheticoligonucleotide
  source 1..24: mol_type = other DNA
ggaggactctttaaagagtcctcc

SEQ ID NO: 3080 - DNA, 24 bp, synthetic construct
  misc_feature 1..24: note = Description of Artificial Sequence: Syntheticoligonucleotide
  source 1..24: mol_type = other DNA
ggcagactctttaaagagtctgcc

SEQ ID NO: 3081 - DNA, 24 bp, synthetic construct
  misc_feature 1..24: note = Description of Artificial Sequence: Syntheticoligonucleotide
  source 1..24: mol_type = other DNA
tgcggactctttaaagagtccgca

SEQ ID NO: 3082 - DNA, 24 bp, synthetic construct
  misc_feature 1..24: note = Description of Artificial Sequence: Syntheticoligonucleotide
  source 1..24: mol_type = other DNA
gtcggactctttaaagagtccgac

SEQ ID NO: 3083 - DNA, 24 bp, synthetic construct
  misc_feature 1..24: note = Description of Artificial Sequence: Syntheticoligonucleotide
  source 1..24: mol_type = other DNA
ggtggactctttaaagagtccacc

SEQ ID NO: 3084 - DNA, 24 bp, synthetic construct
  misc_feature 1..24: note = Description of Artificial Sequence: Syntheticoligonucleotide
  source 1..24: mol_type = other DNA
ggctgactctttaaagagtcagcc

SEQ ID NO: 3085 - DNA, 24 bp, synthetic construct
  misc_feature 1..24: note = Description of Artificial Sequence: Syntheticoligonucleotide
  source 1..24: mol_type = other DNA
gcccgactctttaaagagtcgggc

SEQ ID NO: 3086 - DNA, 24 bp, synthetic construct
  misc_feature 1..24: note = Description of Artificial Sequence: Syntheticoligonucleotide
  source 1..24: mol_type = other DNA
acccgactctttaaagagtcgggt

SEQ ID NO: 3087 - DNA, 24 bp, synthetic construct
  misc_feature 1..24: note = Description of Artificial Sequence: Syntheticoligonucleotide
  source 1..24: mol_type = other DNA
gaccgactctttaaagagtcggtc

SEQ ID NO: 3088 - DNA, 24 bp, synthetic construct
  misc_feature 1..24: note = Description of Artificial Sequence: Syntheticoligonucleotide
  source 1..24: mol_type = other DNA
gcacgactctttaaagagtcgtgc

SEQ ID NO: 3089 - DNA, 24 bp, synthetic construct
  misc_feature 1..24: note = Description of Artificial Sequence: Syntheticoligonucleotide
  source 1..24: mol_type = other DNA
gccagactctttaaagagtctggc

SEQ ID NO: 3090 - DNA, 24 bp, synthetic construct
  misc_feature 1..24: note = Description of Artificial Sequence: Syntheticoligonucleotide
  source 1..24: mol_type = other DNA
tcccgactctttaaagagtcggga

SEQ ID NO: 3091 - DNA, 24 bp, synthetic construct
  misc_feature 1..24: note = Description of Artificial Sequence: Syntheticoligonucleotide
  source 1..24: mol_type = other DNA
gtccgactctttaaagagtcggac

SEQ ID NO: 3092 - DNA, 24 bp, synthetic construct
  misc_feature 1..24: note = Description of Artificial Sequence: Syntheticoligonucleotide
  source 1..24: mol_type = other DNA
gcctgactctttaaagagtcaggc

SEQ ID NO: 3093 - DNA, 24 bp, synthetic construct
  misc_feature 1..24: note = Description of Artificial Sequence: Syntheticoligonucleotide
  source 1..24: mol_type = other DNA
gggcgactctttaaagagtcgccc

SEQ ID NO: 3094 - DNA, 24 bp, synthetic construct
  misc_feature 1..24: note = Description of Artificial Sequence: Syntheticoligonucleotide
  source 1..24: mol_type = other DNA
aggcgactctttaaagagtcgcct

SEQ ID NO: 3095 - DNA, 24 bp, synthetic construct
  misc_feature 1..24: note = Description of Artificial Sequence: Syntheticoligonucleotide
  source 1..24: mol_type = other DNA
gagcgactctttaaagagtcgctc

SEQ ID NO: 3096 - DNA, 24 bp, synthetic construct
  misc_feature 1..24: note = Description of Artificial Sequence: Syntheticoligonucleotide
  source 1..24: mol_type = other DNA
ggacgactctttaaagagtcgtcc

SEQ ID NO: 3097 - DNA, 24 bp, synthetic construct
  misc_feature 1..24: note = Description of Artificial Sequence: Syntheticoligonucleotide
  source 1..24: mol_type = other DNA
gggagactctttaaagagtctccc

SEQ ID NO: 3098 - DNA, 24 bp, synthetic construct
  misc_feature 1..24: note = Description of Artificial Sequence: Syntheticoligonucleotide
  source 1..24: mol_type = other DNA
tggcgactctttaaagagtcgcca

SEQ ID NO: 3099 - DNA, 24 bp, synthetic construct
  misc_feature 1..24: note = Description of Artificial Sequence: Syntheticoligonucleotide
  source 1..24: mol_type = other DNA
gtgcgactctttaaagagtcgcac

SEQ ID NO: 3100 - DNA, 24 bp, synthetic construct
  misc_feature 1..24: note = Description of Artificial Sequence: Syntheticoligonucleotide
  source 1..24: mol_type = other DNA
gggtgactctttaaagagtcaccc

SEQ ID NO: 3101 - DNA, 24 bp, synthetic construct
  misc_feature 1..24: note = Description of Artificial Sequence: Syntheticoligonucleotide
  source 1..24: mol_type = other DNA
acgggactctttaaagagtcccgt

SEQ ID NO: 3102 - DNA, 24 bp, synthetic construct
  misc_feature 1..24: note = Description of Artificial Sequence: Syntheticoligonucleotide
  source 1..24: mol_type = other DNA
cagggactctttaaagagtccctg

SEQ ID NO: 3103 - DNA, 24 bp, synthetic construct
  misc_feature 1..24: note = Description of Artificial Sequence: Syntheticoligonucleotide
  source 1..24: mol_type = other DNA
ccaggactctttaaagagtcctgg

SEQ ID NO: 3104 - DNA, 24 bp, synthetic construct
  misc_feature 1..24: note = Description of Artificial Sequence: Syntheticoligonucleotide
  source 1..24: mol_type = other DNA
ccgagactctttaaagagtctcgg

SEQ ID NO: 3105 - DNA, 24 bp, synthetic construct
  misc_feature 1..24: note = Description of Artificial Sequence: Syntheticoligonucleotide
  source 1..24: mol_type = other DNA
tcgggactctttaaagagtcccga

SEQ ID NO: 3106 - DNA, 24 bp, synthetic construct
  misc_feature 1..24: note = Description of Artificial Sequence: Syntheticoligonucleotide
  source 1..24: mol_type = other DNA
ctgggactctttaaagagtcccag

SEQ ID NO: 3107 - DNA, 24 bp, synthetic construct
  misc_feature 1..24: note = Description of Artificial Sequence: Syntheticoligonucleotide
  source 1..24: mol_type = other DNA
cctggactctttaaagagtccagg

SEQ ID NO: 3108 - DNA, 24 bp, synthetic construct
  misc_feature 1..24: note = Description of Artificial Sequence: Syntheticoligonucleotide
  source 1..24: mol_type = other DNA
ccgtgactctttaaagagtcacgg

SEQ ID NO: 3109 - DNA, 24 bp, synthetic construct
  misc_feature 1..24: note = Description of Artificial Sequence: Syntheticoligonucleotide
  source 1..24: mol_type = other DNA
cggcgactctttaaagagtcgccg

SEQ ID NO: 3110 - DNA, 24 bp, synthetic construct
  misc_feature 1..24: note = Description of Artificial Sequence: Syntheticoligonucleotide
  source 1..24: mol_type = other DNA
cagcgactctttaaagagtcgctg

SEQ ID NO: 3111 - DNA, 24 bp, synthetic construct
  misc_feature 1..24: note = Description of Artificial Sequence: Syntheticoligonucleotide
  source 1..24: mol_type = other DNA
cgacgactctttaaagagtcgtcg

SEQ ID NO: 3112 - DNA, 24 bp, synthetic construct
  misc_feature 1..24: note = Description of Artificial Sequence: Syntheticoligonucleotide
  source 1..24: mol_type = other DNA
cggagactctttaaagagtctccg

SEQ ID NO: 3113 - DNA, 24 bp, synthetic construct
  misc_feature 1..24: note = Description of Artificial Sequence: Syntheticoligonucleotide
  source 1..24: mol_type = other DNA
ctgcgactctttaaagagtcgcag

SEQ ID NO: 3114 - DNA, 24 bp, synthetic construct
  misc_feature 1..24: note = Description of Artificial Sequence: Syntheticoligonucleotide
  source 1..24: mol_type = other DNA
cggtgactctttaaagagtcaccg

SEQ ID NO: 3115 - DNA, 24 bp, synthetic construct
  misc_feature 1..24: note = Description of Artificial Sequence: Syntheticoligonucleotide
  source 1..24: mol_type = other DNA
cacggactctttaaagagtccgtg

SEQ ID NO: 3116 - DNA, 24 bp, synthetic construct
  misc_feature 1..24: note = Description of Artificial Sequence: Syntheticoligonucleotide
  source 1..24: mol_type = other DNA
cccagactctttaaagagtctggg

SEQ ID NO: 3117 - DNA, 24 bp, synthetic construct
  misc_feature 1..24: note = Description of Artificial Sequence: Syntheticoligonucleotide
  source 1..24: mol_type = other DNA
ctcggactctttaaagagtccgag

SEQ ID NO: 3118 - DNA, 24 bp, synthetic construct
  misc_feature 1..24: note = Description of Artificial Sequence: Syntheticoligonucleotide
  source 1..24: mol_type = other DNA
ccctgactctttaaagagtcaggg

SEQ ID NO: 3119 - DNA, 24 bp, synthetic construct
  misc_feature 1..24: note = Description of Artificial Sequence: Syntheticoligonucleotide
  source 1..24: mol_type = other DNA
ccacgactctttaaagagtcgtgg

SEQ ID NO: 3120 - DNA, 24 bp, synthetic construct
  misc_feature 1..24: note = Description of Artificial Sequence: Syntheticoligonucleotide
  source 1..24: mol_type = other DNA
agccgactctttaaagagtcggct

SEQ ID NO: 3121 - DNA, 24 bp, synthetic construct
  misc_feature 1..24: note = Description of Artificial Sequence: Syntheticoligonucleotide
  source 1..24: mol_type = other DNA
tgccgactctttaaagagtcggca

SEQ ID NO: 3122 - DNA, 24 bp, synthetic construct
  misc_feature 1..24: note = Description of Artificial Sequence: Syntheticoligonucleotide
  source 1..24: mol_type = other DNA
gcgagactctttaaagagtctcgc

SEQ ID NO: 3123 - DNA, 24 bp, synthetic construct
  misc_feature 1..24: note = Description of Artificial Sequence: Syntheticoligonucleotide
  source 1..24: mol_type = other DNA
gcgtgactctttaaagagtcacgc

SEQ ID NO: 3124 - DNA, 24 bp, synthetic construct
  misc_feature 1..24: note = Description of Artificial Sequence: Syntheticoligonucleotide
  source 1..24: mol_type = other DNA
gcaggactctttaaagagtcctgc

SEQ ID NO: 3125 - DNA, 24 bp, synthetic construct
  misc_feature 1..24: note = Description of Artificial Sequence: Syntheticoligonucleotide
  source 1..24: mol_type = other DNA
gctggactctttaaagagtccagc

SEQ ID NO: 3126 - DNA, 24 bp, synthetic construct
  misc_feature 1..24: note = Description of Artificial Sequence: Syntheticoligonucleotide
  source 1..24: mol_type = other DNA
cgaggactctttaaagagtcctcg

SEQ ID NO: 3127 - DNA, 24 bp, synthetic construct
  misc_feature 1..24: note = Description of Artificial Sequence: Syntheticoligonucleotide
  source 1..24: mol_type = other DNA
cgtggactctttaaagagtccacg

SEQ ID NO: 3128 - DNA, 24 bp, synthetic construct
  misc_feature 1..24: note = Description of Artificial Sequence: Syntheticoligonucleotide
  source 1..24: mol_type = other DNA
caccgactctttaaagagtcggtg

SEQ ID NO: 3129 - DNA, 24 bp, synthetic construct
  misc_feature 1..24: note = Description of Artificial Sequence: Syntheticoligonucleotide
  source 1..24: mol_type = other DNA
ctccgactctttaaagagtcggag

SEQ ID NO: 3130 - DNA, 24 bp, synthetic construct
  misc_feature 1..24: note = Description of Artificial Sequence: Syntheticoligonucleotide
  source 1..24: mol_type = other DNA
gcgggactctttaaagagtcccgc

SEQ ID NO: 3131 - DNA, 24 bp, synthetic construct
  misc_feature 1..24: note = Description of Artificial Sequence: Syntheticoligonucleotide
  source 1..24: mol_type = other DNA
gagggactctttaaagagtccctc

SEQ ID NO: 3132 - DNA, 24 bp, synthetic construct
  misc_feature 1..24: note = Description of Artificial Sequence: Syntheticoligonucleotide
  source 1..24: mol_type = other DNA
gtgggactctttaaagagtcccac

SEQ ID NO: 3133 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcttgcaagagtcnnnn

SEQ ID NO: 3134 - DNA, 24 bp, synthetic construct
  misc_feature 1..24: note = Description of Artificial Sequence: Syntheticoligonucleotide
  source 1..24: mol_type = other DNA
ggcggactcttgcaagagtccgcc

SEQ ID NO: 3135 - DNA, 24 bp, synthetic construct
  misc_feature 1..24: note = Description of Artificial Sequence: Syntheticoligonucleotide
  source 1..24: mol_type = other DNA
agcggactcttgcaagagtccgct

SEQ ID NO: 3136 - DNA, 24 bp, synthetic construct
  misc_feature 1..24: note = Description of Artificial Sequence: Syntheticoligonucleotide
  source 1..24: mol_type = other DNA
gacggactcttgcaagagtccgtc

SEQ ID NO: 3137 - DNA, 24 bp, synthetic construct
  misc_feature 1..24: note = Description of Artificial Sequence: Syntheticoligonucleotide
  source 1..24: mol_type = other DNA
ggaggactcttgcaagagtcctcc

SEQ ID NO: 3138 - DNA, 24 bp, synthetic construct
  misc_feature 1..24: note = Description of Artificial Sequence: Syntheticoligonucleotide
  source 1..24: mol_type = other DNA
ggcagactcttgcaagagtctgcc

SEQ ID NO: 3139 - DNA, 24 bp, synthetic construct
  misc_feature 1..24: note = Description of Artificial Sequence: Syntheticoligonucleotide
  source 1..24: mol_type = other DNA
tgcggactcttgcaagagtccgca

SEQ ID NO: 3140 - DNA, 24 bp, synthetic construct
  misc_feature 1..24: note = Description of Artificial Sequence: Syntheticoligonucleotide
  source 1..24: mol_type = other DNA
gtcggactcttgcaagagtccgac

SEQ ID NO: 3141 - DNA, 24 bp, synthetic construct
  misc_feature 1..24: note = Description of Artificial Sequence: Syntheticoligonucleotide
  source 1..24: mol_type = other DNA
ggtggactcttgcaagagtccacc

SEQ ID NO: 3142 - DNA, 24 bp, synthetic construct
  misc_feature 1..24: note = Description of Artificial Sequence: Syntheticoligonucleotide
  source 1..24: mol_type = other DNA
ggctgactcttgcaagagtcagcc

SEQ ID NO: 3143 - DNA, 24 bp, synthetic construct
  misc_feature 1..24: note = Description of Artificial Sequence: Syntheticoligonucleotide
  source 1..24: mol_type = other DNA
gcccgactcttgcaagagtcgggc

SEQ ID NO: 3144 - DNA, 24 bp, synthetic construct
  misc_feature 1..24: note = Description of Artificial Sequence: Syntheticoligonucleotide
  source 1..24: mol_type = other DNA
acccgactcttgcaagagtcgggt

SEQ ID NO: 3145 - DNA, 24 bp, synthetic construct
  misc_feature 1..24: note = Description of Artificial Sequence: Syntheticoligonucleotide
  source 1..24: mol_type = other DNA
gaccgactcttgcaagagtcggtc

SEQ ID NO: 3146 - DNA, 24 bp, synthetic construct
  misc_feature 1..24: note = Description of Artificial Sequence: Syntheticoligonucleotide
  source 1..24: mol_type = other DNA
gcacgactcttgcaagagtcgtgc

SEQ ID NO: 3147 - DNA, 24 bp, synthetic construct
  misc_feature 1..24: note = Description of Artificial Sequence: Syntheticoligonucleotide
  source 1..24: mol_type = other DNA
gccagactcttgcaagagtctggc

SEQ ID NO: 3148 - DNA, 24 bp, synthetic construct
  misc_feature 1..24: note = Description of Artificial Sequence: Syntheticoligonucleotide
  source 1..24: mol_type = other DNA
tcccgactcttgcaagagtcggga

SEQ ID NO: 3149 - DNA, 24 bp, synthetic construct
  misc_feature 1..24: note = Description of Artificial Sequence: Syntheticoligonucleotide
  source 1..24: mol_type = other DNA
gtccgactcttgcaagagtcggac

SEQ ID NO: 3150 - DNA, 24 bp, synthetic construct
  misc_feature 1..24: note = Description of Artificial Sequence: Syntheticoligonucleotide
  source 1..24: mol_type = other DNA
gcctgactcttgcaagagtcaggc

SEQ ID NO: 3151 - DNA, 24 bp, synthetic construct
  misc_feature 1..24: note = Description of Artificial Sequence: Syntheticoligonucleotide
  source 1..24: mol_type = other DNA
gggcgactcttgcaagagtcgccc

SEQ ID NO: 3152 - DNA, 24 bp, synthetic construct
  misc_feature 1..24: note = Description of Artificial Sequence: Syntheticoligonucleotide
  source 1..24: mol_type = other DNA
aggcgactcttgcaagagtcgcct

SEQ ID NO: 3153 - DNA, 24 bp, synthetic construct
  misc_feature 1..24: note = Description of Artificial Sequence: Syntheticoligonucleotide
  source 1..24: mol_type = other DNA
gagcgactcttgcaagagtcgctc

SEQ ID NO: 3154 - DNA, 24 bp, synthetic construct
  misc_feature 1..24: note = Description of Artificial Sequence: Syntheticoligonucleotide
  source 1..24: mol_type = other DNA
ggacgactcttgcaagagtcgtcc

SEQ ID NO: 3155 - DNA, 24 bp, synthetic construct
  misc_feature 1..24: note = Description of Artificial Sequence: Syntheticoligonucleotide
  source 1..24: mol_type = other DNA
gggagactcttgcaagagtctccc

SEQ ID NO: 3156 - DNA, 24 bp, synthetic construct
  misc_feature 1..24: note = Description of Artificial Sequence: Syntheticoligonucleotide
  source 1..24: mol_type = other DNA
tggcgactcttgcaagagtcgcca

SEQ ID NO: 3157 - DNA, 24 bp, synthetic construct
  misc_feature 1..24: note = Description of Artificial Sequence: Syntheticoligonucleotide
  source 1..24: mol_type = other DNA
gtgcgactcttgcaagagtcgcac

SEQ ID NO: 3158 - DNA, 24 bp, synthetic construct
  misc_feature 1..24: note = Description of Artificial Sequence: Syntheticoligonucleotide
  source 1..24: mol_type = other DNA
gggtgactcttgcaagagtcaccc

SEQ ID NO: 3159 - DNA, 24 bp, synthetic construct
  misc_feature 1..24: note = Description of Artificial Sequence: Syntheticoligonucleotide
  source 1..24: mol_type = other DNA
acgggactcttgcaagagtcccgt

SEQ ID NO: 3160 - DNA, 24 bp, synthetic construct
  misc_feature 1..24: note = Description of Artificial Sequence: Syntheticoligonucleotide
  source 1..24: mol_type = other DNA
cagggactcttgcaagagtccctg

SEQ ID NO: 3161 - DNA, 24 bp, synthetic construct
  misc_feature 1..24: note = Description of Artificial Sequence: Syntheticoligonucleotide
  source 1..24: mol_type = other DNA
ccaggactcttgcaagagtcctgg

SEQ ID NO: 3162 - DNA, 24 bp, synthetic construct
  misc_feature 1..24: note = Description of Artificial Sequence: Syntheticoligonucleotide
  source 1..24: mol_type = other DNA
ccgagactcttgcaagagtctcgg

SEQ ID NO: 3163 - DNA, 24 bp, synthetic construct
  misc_feature 1..24: note = Description of Artificial Sequence: Syntheticoligonucleotide
  source 1..24: mol_type = other DNA
tcgggactcttgcaagagtcccga

SEQ ID NO: 3164 - DNA, 24 bp, synthetic construct
  misc_feature 1..24: note = Description of Artificial Sequence: Syntheticoligonucleotide
  source 1..24: mol_type = other DNA
ctgggactcttgcaagagtcccag

SEQ ID NO: 3165 - DNA, 24 bp, synthetic construct
  misc_feature 1..24: note = Description of Artificial Sequence: Syntheticoligonucleotide
  source 1..24: mol_type = other DNA
cctggactcttgcaagagtccagg

SEQ ID NO: 3166 - DNA, 24 bp, synthetic construct
  misc_feature 1..24: note = Description of Artificial Sequence: Syntheticoligonucleotide
  source 1..24: mol_type = other DNA
ccgtgactcttgcaagagtcacgg

SEQ ID NO: 3167 - DNA, 24 bp, synthetic construct
  misc_feature 1..24: note = Description of Artificial Sequence: Syntheticoligonucleotide
  source 1..24: mol_type = other DNA
cggcgactcttgcaagagtcgccg

SEQ ID NO: 3168 - DNA, 24 bp, synthetic construct
  misc_feature 1..24: note = Description of Artificial Sequence: Syntheticoligonucleotide
  source 1..24: mol_type = other DNA
cagcgactcttgcaagagtcgctg

SEQ ID NO: 3169 - DNA, 24 bp, synthetic construct
  misc_feature 1..24: note = Description of Artificial Sequence: Syntheticoligonucleotide
  source 1..24: mol_type = other DNA
cgacgactcttgcaagagtcgtcg

SEQ ID NO: 3170 - DNA, 24 bp, synthetic construct
  misc_feature 1..24: note = Description of Artificial Sequence: Syntheticoligonucleotide
  source 1..24: mol_type = other DNA
cggagactcttgcaagagtctccg

SEQ ID NO: 3171 - DNA, 24 bp, synthetic construct
  misc_feature 1..24: note = Description of Artificial Sequence: Syntheticoligonucleotide
  source 1..24: mol_type = other DNA
ctgcgactcttgcaagagtcgcag

SEQ ID NO: 3172 - DNA, 24 bp, synthetic construct
  misc_feature 1..24: note = Description of Artificial Sequence: Syntheticoligonucleotide
  source 1..24: mol_type = other DNA
cggtgactcttgcaagagtcaccg

SEQ ID NO: 3173 - DNA, 24 bp, synthetic construct
  misc_feature 1..24: note = Description of Artificial Sequence: Syntheticoligonucleotide
  source 1..24: mol_type = other DNA
cacggactcttgcaagagtccgtg

SEQ ID NO: 3174 - DNA, 24 bp, synthetic construct
  misc_feature 1..24: note = Description of Artificial Sequence: Syntheticoligonucleotide
  source 1..24: mol_type = other DNA
cccagactcttgcaagagtctggg

SEQ ID NO: 3175 - DNA, 24 bp, synthetic construct
  misc_feature 1..24: note = Description of Artificial Sequence: Syntheticoligonucleotide
  source 1..24: mol_type = other DNA
ctcggactcttgcaagagtccgag

SEQ ID NO: 3176 - DNA, 24 bp, synthetic construct
  misc_feature 1..24: note = Description of Artificial Sequence: Syntheticoligonucleotide
  source 1..24: mol_type = other DNA
ccctgactcttgcaagagtcaggg

SEQ ID NO: 3177 - DNA, 24 bp, synthetic construct
  misc_feature 1..24: note = Description of Artificial Sequence: Syntheticoligonucleotide
  source 1..24: mol_type = other DNA
ccacgactcttgcaagagtcgtgg

SEQ ID NO: 3178 - DNA, 24 bp, synthetic construct
  misc_feature 1..24: note = Description of Artificial Sequence: Syntheticoligonucleotide
  source 1..24: mol_type = other DNA
agccgactcttgcaagagtcggct

SEQ ID NO: 3179 - DNA, 24 bp, synthetic construct
  misc_feature 1..24: note = Description of Artificial Sequence: Syntheticoligonucleotide
  source 1..24: mol_type = other DNA
tgccgactcttgcaagagtcggca

SEQ ID NO: 3180 - DNA, 24 bp, synthetic construct
  misc_feature 1..24: note = Description of Artificial Sequence: Syntheticoligonucleotide
  source 1..24: mol_type = other DNA
gcgagactcttgcaagagtctcgc

SEQ ID NO: 3181 - DNA, 24 bp, synthetic construct
  misc_feature 1..24: note = Description of Artificial Sequence: Syntheticoligonucleotide
  source 1..24: mol_type = other DNA
gcgtgactcttgcaagagtcacgc

SEQ ID NO: 3182 - DNA, 24 bp, synthetic construct
  misc_feature 1..24: note = Description of Artificial Sequence: Syntheticoligonucleotide
  source 1..24: mol_type = other DNA
gcaggactcttgcaagagtcctgc

SEQ ID NO: 3183 - DNA, 24 bp, synthetic construct
  misc_feature 1..24: note = Description of Artificial Sequence: Syntheticoligonucleotide
  source 1..24: mol_type = other DNA
gctggactcttgcaagagtccagc

SEQ ID NO: 3184 - DNA, 24 bp, synthetic construct
  misc_feature 1..24: note = Description of Artificial Sequence: Syntheticoligonucleotide
  source 1..24: mol_type = other DNA
cgaggactcttgcaagagtcctcg

SEQ ID NO: 3185 - DNA, 24 bp, synthetic construct
  misc_feature 1..24: note = Description of Artificial Sequence: Syntheticoligonucleotide
  source 1..24: mol_type = other DNA
cgtggactcttgcaagagtccacg

SEQ ID NO: 3186 - DNA, 24 bp, synthetic construct
  misc_feature 1..24: note = Description of Artificial Sequence: Syntheticoligonucleotide
  source 1..24: mol_type = other DNA
caccgactcttgcaagagtcggtg

SEQ ID NO: 3187 - DNA, 24 bp, synthetic construct
  misc_feature 1..24: note = Description of Artificial Sequence: Syntheticoligonucleotide
  source 1..24: mol_type = other DNA
ctccgactcttgcaagagtcggag

SEQ ID NO: 3188 - DNA, 24 bp, synthetic construct
  misc_feature 1..24: note = Description of Artificial Sequence: Syntheticoligonucleotide
  source 1..24: mol_type = other DNA
gcgggactcttgcaagagtcccgc

SEQ ID NO: 3189 - DNA, 24 bp, synthetic construct
  misc_feature 1..24: note = Description of Artificial Sequence: Syntheticoligonucleotide
  source 1..24: mol_type = other DNA
gagggactcttgcaagagtccctc

SEQ ID NO: 3190 - DNA, 24 bp, synthetic construct
  misc_feature 1..24: note = Description of Artificial Sequence: Syntheticoligonucleotide
  source 1..24: mol_type = other DNA
gtgggactcttgcaagagtcccac

SEQ ID NO: 3191 - DNA, 24 bp, synthetic construct
  misc_feature 1..24: note = Description of Artificial Sequence: Syntheticoligonucleotide
  misc_difference 1..4: note = a, c, t, or g
  misc_difference 21..24: note = a, c, t, or g
  source 1..24: mol_type = other DNA
nnnngactcttcgaagagtcnnnn

SEQ ID NO: 3192 - DNA, 24 bp, synthetic construct
  misc_feature 1..24: note = Description of Artificial Sequence: Syntheticoligonucleotide
  source 1..24: mol_type = other DNA
ggcggactcttcgaagagtccgcc

SEQ ID NO: 3193 - DNA, 24 bp, synthetic construct
  misc_feature 1..24: note = Description of Artificial Sequence: Syntheticoligonucleotide
  source 1..24: mol_type = other DNA
agcggactcttcgaagagtccgct

SEQ ID NO: 3194 - DNA, 24 bp, synthetic construct
  misc_feature 1..24: note = Description of Artificial Sequence: Syntheticoligonucleotide
  source 1..24: mol_type = other DNA
gacggactcttcgaagagtccgtc

SEQ ID NO: 3195 - DNA, 24 bp, synthetic construct
  misc_feature 1..24: note = Description of Artificial Sequence: Syntheticoligonucleotide
  source 1..24: mol_type = other DNA
ggaggactcttcgaagagtcctcc

SEQ ID NO: 3196 - DNA, 24 bp, synthetic construct
  misc_feature 1..24: note = Description of Artificial Sequence: Syntheticoligonucleotide
  source 1..24: mol_type = other DNA
ggcagactcttcgaagagtctgcc

SEQ ID NO: 3197 - DNA, 24 bp, synthetic construct
  misc_feature 1..24: note = Description of Artificial Sequence: Syntheticoligonucleotide
  source 1..24: mol_type = other DNA
tgcggactcttcgaagagtccgca

SEQ ID NO: 3198 - DNA, 24 bp, synthetic construct
  misc_feature 1..24: note = Description of Artificial Sequence: Syntheticoligonucleotide
  source 1..24: mol_type = other DNA
gtcggactcttcgaagagtccgac

SEQ ID NO: 3199 - DNA, 24 bp, synthetic construct
  misc_feature 1..24: note = Description of Artificial Sequence: Syntheticoligonucleotide
  source 1..24: mol_type = other DNA
ggtggactcttcgaagagtccacc

SEQ ID NO: 3200 - DNA, 24 bp, synthetic construct
  misc_feature 1..24: note = Description of Artificial Sequence: Syntheticoligonucleotide
  source 1..24: mol_type = other DNA
ggctgactcttcgaagagtcagcc

SEQ ID NO: 3201 - DNA, 24 bp, synthetic construct
  misc_feature 1..24: note = Description of Artificial Sequence: Syntheticoligonucleotide
  source 1..24: mol_type = other DNA
gcccgactcttcgaagagtcgggc

SEQ ID NO: 3202 - DNA, 24 bp, synthetic construct
  misc_feature 1..24: note = Description of Artificial Sequence: Syntheticoligonucleotide
  source 1..24: mol_type = other DNA
acccgactcttcgaagagtcgggt

SEQ ID NO: 3203 - DNA, 24 bp, synthetic construct
  misc_feature 1..24: note = Description of Artificial Sequence: Syntheticoligonucleotide
  source 1..24: mol_type = other DNA
gaccgactcttcgaagagtcggtc

SEQ ID NO: 3204 - DNA, 24 bp, synthetic construct
  misc_feature 1..24: note = Description of Artificial Sequence: Syntheticoligonucleotide
  source 1..24: mol_type = other DNA
gcacgactcttcgaagagtcgtgc

SEQ ID NO: 3205 - DNA, 24 bp, synthetic construct
  misc_feature 1..24: note = Description of Artificial Sequence: Syntheticoligonucleotide
  source 1..24: mol_type = other DNA
gccagactcttcgaagagtctggc

SEQ ID NO: 3206 - DNA, 24 bp, synthetic construct
  misc_feature 1..24: note = Description of Artificial Sequence: Syntheticoligonucleotide
  source 1..24: mol_type = other DNA
tcccgactcttcgaagagtcggga

SEQ ID NO: 3207 - DNA, 24 bp, synthetic construct
  misc_feature 1..24: note = Description of Artificial Sequence: Syntheticoligonucleotide
  source 1..24: mol_type = other DNA
gtccgactcttcgaagagtcggac

SEQ ID NO: 3208 - DNA, 24 bp, synthetic construct
  misc_feature 1..24: note = Description of Artificial Sequence: Syntheticoligonucleotide
  source 1..24: mol_type = other DNA
gcctgactcttcgaagagtcaggc

SEQ ID NO: 3209 - DNA, 24 bp, synthetic construct
  misc_feature 1..24: note = Description of Artificial Sequence: Syntheticoligonucleotide
  source 1..24: mol_type = other DNA
gggcgactcttcgaagagtcgccc

SEQ ID NO: 3210 - DNA, 24 bp, synthetic construct
  misc_feature 1..24: note = Description of Artificial Sequence: Syntheticoligonucleotide
  source 1..24: mol_type = other DNA
aggcgactcttcgaagagtcgcct

SEQ ID NO: 3211 - DNA, 24 bp, synthetic construct
  misc_feature 1..24: note = Description of Artificial Sequence: Syntheticoligonucleotide
  source 1..24: mol_type = other DNA
gagcgactcttcgaagagtcgctc

SEQ ID NO: 3212 - DNA, 24 bp, synthetic construct
  misc_feature 1..24: note = Description of Artificial Sequence: Syntheticoligonucleotide
  source 1..24: mol_type = other DNA
ggacgactcttcgaagagtcgtcc

SEQ ID NO: 3213 - DNA, 24 bp, synthetic construct
  misc_feature 1..24: note = Description of Artificial Sequence: Syntheticoligonucleotide
  source 1..24: mol_type = other DNA
gggagactcttcgaagagtctccc

SEQ ID NO: 3214 - DNA, 24 bp, synthetic construct
  misc_feature 1..24: note = Description of Artificial Sequence: Syntheticoligonucleotide
  source 1..24: mol_type = other DNA
tggcgactcttcgaagagtcgcca

SEQ ID NO: 3215 - DNA, 24 bp, synthetic construct
  misc_feature 1..24: note = Description of Artificial Sequence: Syntheticoligonucleotide
  source 1..24: mol_type = other DNA
gtgcgactcttcgaagagtcgcac

SEQ ID NO: 3216 - DNA, 24 bp, synthetic construct
  misc_feature 1..24: note = Description of Artificial Sequence: Syntheticoligonucleotide
  source 1..24: mol_type = other DNA
gggtgactcttcgaagagtcaccc

SEQ ID NO: 3217 - DNA, 24 bp, synthetic construct
  misc_feature 1..24: note = Description of Artificial Sequence: Syntheticoligonucleotide
  source 1..24: mol_type = other DNA
acgggactcttcgaagagtcccgt

SEQ ID NO: 3218 - DNA, 24 bp, synthetic construct
  misc_feature 1..24: note = Description of Artificial Sequence: Syntheticoligonucleotide
  source 1..24: mol_type = other DNA
cagggactcttcgaagagtccctg

SEQ ID NO: 3219 - DNA, 24 bp, synthetic construct
  misc_feature 1..24: note = Description of Artificial Sequence: Syntheticoligonucleotide
  source 1..24: mol_type = other DNA
ccaggactcttcgaagagtcctgg

SEQ ID NO: 3220 - DNA, 24 bp, synthetic construct
  misc_feature 1..24: note = Description of Artificial Sequence: Syntheticoligonucleotide
  source 1..24: mol_type = other DNA
ccgagactcttcgaagagtctcgg

SEQ ID NO: 3221 - DNA, 24 bp, synthetic construct
  misc_feature 1..24: note = Description of Artificial Sequence: Syntheticoligonucleotide
  source 1..24: mol_type = other DNA
tcgggactcttcgaagagtcccga

SEQ ID NO: 3222 - DNA, 24 bp, synthetic construct
  misc_feature 1..24: note = Description of Artificial Sequence: Syntheticoligonucleotide
  source 1..24: mol_type = other DNA
ctgggactcttcgaagagtcccag

SEQ ID NO: 3223 - DNA, 24 bp, synthetic construct
  misc_feature 1..24: note = Description of Artificial Sequence: Syntheticoligonucleotide
  source 1..24: mol_type = other DNA
cctggactcttcgaagagtccagg

SEQ ID NO: 3224 - DNA, 24 bp, synthetic construct
  misc_feature 1..24: note = Description of Artificial Sequence: Syntheticoligonucleotide
  source 1..24: mol_type = other DNA
ccgtgactcttcgaagagtcacgg

SEQ ID NO: 3225 - DNA, 24 bp, synthetic construct
  misc_feature 1..24: note = Description of Artificial Sequence: Syntheticoligonucleotide
  source 1..24: mol_type = other DNA
cggcgactcttcgaagagtcgccg

SEQ ID NO: 3226 - DNA, 24 bp, synthetic construct
  misc_feature 1..24: note = Description of Artificial Sequence: Syntheticoligonucleotide
  source 1..24: mol_type = other DNA
cagcgactcttcgaagagtcgctg

SEQ ID NO: 3227 - DNA, 24 bp, synthetic construct
  misc_feature 1..24: note = Description of Artificial Sequence: Syntheticoligonucleotide
  source 1..24: mol_type = other DNA
cgacgactcttcgaagagtcgtcg

SEQ ID NO: 3228 - DNA, 24 bp, synthetic construct
  misc_feature 1..24: note = Description of Artificial Sequence: Syntheticoligonucleotide
  source 1..24: mol_type = other DNA
cggagactcttcgaagagtctccg

SEQ ID NO: 3229 - DNA, 24 bp, synthetic construct
  misc_feature 1..24: note = Description of Artificial Sequence: Syntheticoligonucleotide
  source 1..24: mol_type = other DNA
ctgcgactcttcgaagagtcgcag

SEQ ID NO: 3230 - DNA, 24 bp, synthetic construct
  misc_feature 1..24: note = Description of Artificial Sequence: Syntheticoligonucleotide
  source 1..24: mol_type = other DNA
cggtgactcttcgaagagtcaccg

SEQ ID NO: 3231 - DNA, 24 bp, synthetic construct
  misc_feature 1..24: note = Description of Artificial Sequence: Syntheticoligonucleotide
  source 1..24: mol_type = other DNA
cacggactcttcgaagagtccgtg

SEQ ID NO: 3232 - DNA, 24 bp, synthetic construct
  misc_feature 1..24: note = Description of Artificial Sequence: Syntheticoligonucleotide
  source 1..24: mol_type = other DNA
cccagactcttcgaagagtctggg

SEQ ID NO: 3233 - DNA, 24 bp, synthetic construct
  misc_feature 1..24: note = Description of Artificial Sequence: Syntheticoligonucleotide
  source 1..24: mol_type = other DNA
ctcggactcttcgaagagtccgag

SEQ ID NO: 3234 - DNA, 24 bp, synthetic construct
  misc_feature 1..24: note = Description of Artificial Sequence: Syntheticoligonucleotide
  source 1..24: mol_type = other DNA
ccctgactcttcgaagagtcaggg

SEQ ID NO: 3235 - DNA, 24 bp, synthetic construct
  misc_feature 1..24: note = Description of Artificial Sequence: Syntheticoligonucleotide
  source 1..24: mol_type = other DNA
ccacgactcttcgaagagtcgtgg

SEQ ID NO: 3236 - DNA, 24 bp, synthetic construct
  misc_feature 1..24: note = Description of Artificial Sequence: Syntheticoligonucleotide
  source 1..24: mol_type = other DNA
agccgactcttcgaagagtcggct

SEQ ID NO: 3237 - DNA, 24 bp, synthetic construct
  misc_feature 1..24: note = Description of Artificial Sequence: Syntheticoligonucleotide
  source 1..24: mol_type = other DNA
tgccgactcttcgaagagtcggca

SEQ ID NO: 3238 - DNA, 24 bp, synthetic construct
  misc_feature 1..24: note = Description of Artificial Sequence: Syntheticoligonucleotide
  source 1..24: mol_type = other DNA
gcgagactcttcgaagagtctcgc

SEQ ID NO: 3239 - DNA, 24 bp, synthetic construct
  misc_feature 1..24: note = Description of Artificial Sequence: Syntheticoligonucleotide
  source 1..24: mol_type = other DNA
gcgtgactcttcgaagagtcacgc

SEQ ID NO: 3240 - DNA, 24 bp, synthetic construct
  misc_feature 1..24: note = Description of Artificial Sequence: Syntheticoligonucleotide
  source 1..24: mol_type = other DNA
gcaggactcttcgaagagtcctgc

SEQ ID NO: 3241 - DNA, 24 bp, synthetic construct
  misc_feature 1..24: note = Description of Artificial Sequence: Syntheticoligonucleotide
  source 1..24: mol_type = other DNA
gctggactcttcgaagagtccagc

SEQ ID NO: 3242 - DNA, 24 bp, synthetic construct
  misc_feature 1..24: note = Description of Artificial Sequence: Syntheticoligonucleotide
  source 1..24: mol_type = other DNA
cgaggactcttcgaagagtcctcg

SEQ ID NO: 3243 - DNA, 24 bp, synthetic construct
  misc_feature 1..24: note = Description of Artificial Sequence: Syntheticoligonucleotide
  source 1..24: mol_type = other DNA
cgtggactcttcgaagagtccacg

SEQ ID NO: 3244 - DNA, 24 bp, synthetic construct
  misc_feature 1..24: note = Description of Artificial Sequence: Syntheticoligonucleotide
  source 1..24: mol_type = other DNA
caccgactcttcgaagagtcggtg

SEQ ID NO: 3245 - DNA, 24 bp, synthetic construct
  misc_feature 1..24: note = Description of Artificial Sequence: Syntheticoligonucleotide
  source 1..24: mol_type = other DNA
ctccgactcttcgaagagtcggag

SEQ ID NO: 3246 - DNA, 24 bp, synthetic construct
  misc_feature 1..24: note = Description of Artificial Sequence: Syntheticoligonucleotide
  source 1..24: mol_type = other DNA
gcgggactcttcgaagagtcccgc

SEQ ID NO: 3247 - DNA, 24 bp, synthetic construct
  misc_feature 1..24: note = Description of Artificial Sequence: Syntheticoligonucleotide
  source 1..24: mol_type = other DNA
gagggactcttcgaagagtccctc

SEQ ID NO: 3248 - DNA, 24 bp, synthetic construct
  misc_feature 1..24: note = Description of Artificial Sequence: Syntheticoligonucleotide
  source 1..24: mol_type = other DNA
gtgggactcttcgaagagtcccac

SEQ ID NO: 3249 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactccgatcggagtcnnnn

SEQ ID NO: 3250 - DNA, 23 bp, synthetic construct
  misc_feature 1..23: note = Description of Artificial Sequence: Syntheticoligonucleotide
  source 1..23: mol_type = other DNA
gcggactccgatcggagtccgcc

SEQ ID NO: 3251 - DNA, 23 bp, synthetic construct
  misc_feature 1..23: note = Description of Artificial Sequence: Syntheticoligonucleotide
  source 1..23: mol_type = other DNA
gcggactccgatcggagtccgct

SEQ ID NO: 3252 - DNA, 23 bp, synthetic construct
  misc_feature 1..23: note = Description of Artificial Sequence: Syntheticoligonucleotide
  source 1..23: mol_type = other DNA
acggactccgatcggagtccgtc

SEQ ID NO: 3253 - DNA, 23 bp, synthetic construct
  misc_feature 1..23: note = Description of Artificial Sequence: Syntheticoligonucleotide
  source 1..23: mol_type = other DNA
gaggactccgatcggagtcctcc

SEQ ID NO: 3254 - DNA, 23 bp, synthetic construct
  misc_feature 1..23: note = Description of Artificial Sequence: Syntheticoligonucleotide
  source 1..23: mol_type = other DNA
gcagactccgatcggagtctgcc

SEQ ID NO: 3255 - DNA, 23 bp, synthetic construct
  misc_feature 1..23: note = Description of Artificial Sequence: Syntheticoligonucleotide
  source 1..23: mol_type = other DNA
gcggactccgatcggagtccgca

SEQ ID NO: 3256 - DNA, 23 bp, synthetic construct
  misc_feature 1..23: note = Description of Artificial Sequence: Syntheticoligonucleotide
  source 1..23: mol_type = other DNA
tcggactccgatcggagtccgac

SEQ ID NO: 3257 - DNA, 23 bp, synthetic construct
  misc_feature 1..23: note = Description of Artificial Sequence: Syntheticoligonucleotide
  source 1..23: mol_type = other DNA
gtggactccgatcggagtccacc

SEQ ID NO: 3258 - DNA, 23 bp, synthetic construct
  misc_feature 1..23: note = Description of Artificial Sequence: Syntheticoligonucleotide
  source 1..23: mol_type = other DNA
gctgactccgatcggagtcagcc

SEQ ID NO: 3259 - DNA, 23 bp, synthetic construct
  misc_feature 1..23: note = Description of Artificial Sequence: Syntheticoligonucleotide
  source 1..23: mol_type = other DNA
cccgactccgatcggagtcgggc

SEQ ID NO: 3260 - DNA, 23 bp, synthetic construct
  misc_feature 1..23: note = Description of Artificial Sequence: Syntheticoligonucleotide
  source 1..23: mol_type = other DNA
cccgactccgatcggagtcgggt

SEQ ID NO: 3261 - DNA, 23 bp, synthetic construct
  misc_feature 1..23: note = Description of Artificial Sequence: Syntheticoligonucleotide
  source 1..23: mol_type = other DNA
accgactccgatcggagtcggtc

SEQ ID NO: 3262 - DNA, 23 bp, synthetic construct
  misc_feature 1..23: note = Description of Artificial Sequence: Syntheticoligonucleotide
  source 1..23: mol_type = other DNA
cacgactccgatcggagtcgtgc

SEQ ID NO: 3263 - DNA, 23 bp, synthetic construct
  misc_feature 1..23: note = Description of Artificial Sequence: Syntheticoligonucleotide
  source 1..23: mol_type = other DNA
ccagactccgatcggagtctggc

SEQ ID NO: 3264 - DNA, 23 bp, synthetic construct
  misc_feature 1..23: note = Description of Artificial Sequence: Syntheticoligonucleotide
  source 1..23: mol_type = other DNA
cccgactccgatcggagtcggga

SEQ ID NO: 3265 - DNA, 23 bp, synthetic construct
  misc_feature 1..23: note = Description of Artificial Sequence: Syntheticoligonucleotide
  source 1..23: mol_type = other DNA
tccgactccgatcggagtcggac

SEQ ID NO: 3266 - DNA, 23 bp, synthetic construct
  misc_feature 1..23: note = Description of Artificial Sequence: Syntheticoligonucleotide
  source 1..23: mol_type = other DNA
cctgactccgatcggagtcaggc

SEQ ID NO: 3267 - DNA, 23 bp, synthetic construct
  misc_feature 1..23: note = Description of Artificial Sequence: Syntheticoligonucleotide
  source 1..23: mol_type = other DNA
ggcgactccgatcggagtcgccc

SEQ ID NO: 3268 - DNA, 23 bp, synthetic construct
  misc_feature 1..23: note = Description of Artificial Sequence: Syntheticoligonucleotide
  source 1..23: mol_type = other DNA
ggcgactccgatcggagtcgcct

SEQ ID NO: 3269 - DNA, 23 bp, synthetic construct
  misc_feature 1..23: note = Description of Artificial Sequence: Syntheticoligonucleotide
  source 1..23: mol_type = other DNA
agcgactccgatcggagtcgctc

SEQ ID NO: 3270 - DNA, 23 bp, synthetic construct
  misc_feature 1..23: note = Description of Artificial Sequence: Syntheticoligonucleotide
  source 1..23: mol_type = other DNA
gacgactccgatcggagtcgtcc

SEQ ID NO: 3271 - DNA, 23 bp, synthetic construct
  misc_feature 1..23: note = Description of Artificial Sequence: Syntheticoligonucleotide
  source 1..23: mol_type = other DNA
ggagactccgatcggagtctccc

SEQ ID NO: 3272 - DNA, 23 bp, synthetic construct
  misc_feature 1..23: note = Description of Artificial Sequence: Syntheticoligonucleotide
  source 1..23: mol_type = other DNA
ggcgactccgatcggagtcgcca

SEQ ID NO: 3273 - DNA, 23 bp, synthetic construct
  misc_feature 1..23: note = Description of Artificial Sequence: Syntheticoligonucleotide
  source 1..23: mol_type = other DNA
tgcgactccgatcggagtcgcac

SEQ ID NO: 3274 - DNA, 23 bp, synthetic construct
  misc_feature 1..23: note = Description of Artificial Sequence: Syntheticoligonucleotide
  source 1..23: mol_type = other DNA
ggtgactccgatcggagtcaccc

SEQ ID NO: 3275 - DNA, 23 bp, synthetic construct
  misc_feature 1..23: note = Description of Artificial Sequence: Syntheticoligonucleotide
  source 1..23: mol_type = other DNA
cgggactccgatcggagtcccgt

SEQ ID NO: 3276 - DNA, 23 bp, synthetic construct
  misc_feature 1..23: note = Description of Artificial Sequence: Syntheticoligonucleotide
  source 1..23: mol_type = other DNA
agggactccgatcggagtccctg

SEQ ID NO: 3277 - DNA, 23 bp, synthetic construct
  misc_feature 1..23: note = Description of Artificial Sequence: Syntheticoligonucleotide
  source 1..23: mol_type = other DNA
caggactccgatcggagtcctgg

SEQ ID NO: 3278 - DNA, 23 bp, synthetic construct
  misc_feature 1..23: note = Description of Artificial Sequence: Syntheticoligonucleotide
  source 1..23: mol_type = other DNA
cgagactccgatcggagtctcgg

SEQ ID NO: 3279 - DNA, 23 bp, synthetic construct
  misc_feature 1..23: note = Description of Artificial Sequence: Syntheticoligonucleotide
  source 1..23: mol_type = other DNA
cgggactccgatcggagtcccga

SEQ ID NO: 3280 - DNA, 23 bp, synthetic construct
  misc_feature 1..23: note = Description of Artificial Sequence: Syntheticoligonucleotide
  source 1..23: mol_type = other DNA
tgggactccgatcggagtcccag

SEQ ID NO: 3281 - DNA, 23 bp, synthetic construct
  misc_feature 1..23: note = Description of Artificial Sequence: Syntheticoligonucleotide
  source 1..23: mol_type = other DNA
ctggactccgatcggagtccagg

SEQ ID NO: 3282 - DNA, 23 bp, synthetic construct
  misc_feature 1..23: note = Description of Artificial Sequence: Syntheticoligonucleotide
  source 1..23: mol_type = other DNA
cgtgactccgatcggagtcacgg

SEQ ID NO: 3283 - DNA, 23 bp, synthetic construct
  misc_feature 1..23: note = Description of Artificial Sequence: Syntheticoligonucleotide
  source 1..23: mol_type = other DNA
ggcgactccgatcggagtcgccg

SEQ ID NO: 3284 - DNA, 23 bp, synthetic construct
  misc_feature 1..23: note = Description of Artificial Sequence: Syntheticoligonucleotide
  source 1..23: mol_type = other DNA
agcgactccgatcggagtcgctg

SEQ ID NO: 3285 - DNA, 23 bp, synthetic construct
  misc_feature 1..23: note = Description of Artificial Sequence: Syntheticoligonucleotide
  source 1..23: mol_type = other DNA
gacgactccgatcggagtcgtcg

SEQ ID NO: 3286 - DNA, 23 bp, synthetic construct
  misc_feature 1..23: note = Description of Artificial Sequence: Syntheticoligonucleotide
  source 1..23: mol_type = other DNA
ggagactccgatcggagtctccg

SEQ ID NO: 3287 - DNA, 23 bp, synthetic construct
  misc_feature 1..23: note = Description of Artificial Sequence: Syntheticoligonucleotide
  source 1..23: mol_type = other DNA
tgcgactccgatcggagtcgcag

SEQ ID NO: 3288 - DNA, 23 bp, synthetic construct
  misc_feature 1..23: note = Description of Artificial Sequence: Syntheticoligonucleotide
  source 1..23: mol_type = other DNA
ggtgactccgatcggagtcaccg

SEQ ID NO: 3289 - DNA, 23 bp, synthetic construct
  misc_feature 1..23: note = Description of Artificial Sequence: Syntheticoligonucleotide
  source 1..23: mol_type = other DNA
acggactccgatcggagtccgtg

SEQ ID NO: 3290 - DNA, 23 bp, synthetic construct
  misc_feature 1..23: note = Description of Artificial Sequence: Syntheticoligonucleotide
  source 1..23: mol_type = other DNA
ccagactccgatcggagtctggg

SEQ ID NO: 3291 - DNA, 23 bp, synthetic construct
  misc_feature 1..23: note = Description of Artificial Sequence: Syntheticoligonucleotide
  source 1..23: mol_type = other DNA
tcggactccgatcggagtccgag

SEQ ID NO: 3292 - DNA, 23 bp, synthetic construct
  misc_feature 1..23: note = Description of Artificial Sequence: Syntheticoligonucleotide
  source 1..23: mol_type = other DNA
cctgactccgatcggagtcaggg

SEQ ID NO: 3293 - DNA, 23 bp, synthetic construct
  misc_feature 1..23: note = Description of Artificial Sequence: Syntheticoligonucleotide
  source 1..23: mol_type = other DNA
cacgactccgatcggagtcgtgg

SEQ ID NO: 3294 - DNA, 23 bp, synthetic construct
  misc_feature 1..23: note = Description of Artificial Sequence: Syntheticoligonucleotide
  source 1..23: mol_type = other DNA
gccgactccgatcggagtcggct

SEQ ID NO: 3295 - DNA, 23 bp, synthetic construct
  misc_feature 1..23: note = Description of Artificial Sequence: Syntheticoligonucleotide
  source 1..23: mol_type = other DNA
gccgactccgatcggagtcggca

SEQ ID NO: 3296 - DNA, 23 bp, synthetic construct
  misc_feature 1..23: note = Description of Artificial Sequence: Syntheticoligonucleotide
  source 1..23: mol_type = other DNA
cgagactccgatcggagtctcgc

SEQ ID NO: 3297 - DNA, 23 bp, synthetic construct
  misc_feature 1..23: note = Description of Artificial Sequence: Syntheticoligonucleotide
  source 1..23: mol_type = other DNA
cgtgactccgatcggagtcacgc

SEQ ID NO: 3298 - DNA, 23 bp, synthetic construct
  misc_feature 1..23: note = Description of Artificial Sequence: Syntheticoligonucleotide
  source 1..23: mol_type = other DNA
caggactccgatcggagtcctgc

SEQ ID NO: 3299 - DNA, 23 bp, synthetic construct
  misc_feature 1..23: note = Description of Artificial Sequence: Syntheticoligonucleotide
  source 1..23: mol_type = other DNA
ctggactccgatcggagtccagc

SEQ ID NO: 3300 - DNA, 23 bp, synthetic construct
  misc_feature 1..23: note = Description of Artificial Sequence: Syntheticoligonucleotide
  source 1..23: mol_type = other DNA
gaggactccgatcggagtcctcg

SEQ ID NO: 3301 - DNA, 23 bp, synthetic construct
  misc_feature 1..23: note = Description of Artificial Sequence: Syntheticoligonucleotide
  source 1..23: mol_type = other DNA
gtggactccgatcggagtccacg

SEQ ID NO: 3302 - DNA, 23 bp, synthetic construct
  misc_feature 1..23: note = Description of Artificial Sequence: Syntheticoligonucleotide
  source 1..23: mol_type = other DNA
accgactccgatcggagtcggtg

SEQ ID NO: 3303 - DNA, 23 bp, synthetic construct
  misc_feature 1..23: note = Description of Artificial Sequence: Syntheticoligonucleotide
  source 1..23: mol_type = other DNA
tccgactccgatcggagtcggag

SEQ ID NO: 3304 - DNA, 23 bp, synthetic construct
  misc_feature 1..23: note = Description of Artificial Sequence: Syntheticoligonucleotide
  source 1..23: mol_type = other DNA
cgggactccgatcggagtcccgc

SEQ ID NO: 3305 - DNA, 23 bp, synthetic construct
  misc_feature 1..23: note = Description of Artificial Sequence: Syntheticoligonucleotide
  source 1..23: mol_type = other DNA
agggactccgatcggagtccctc

SEQ ID NO: 3306 - DNA, 23 bp, synthetic construct
  misc_feature 1..23: note = Description of Artificial Sequence: Syntheticoligonucleotide
  source 1..23: mol_type = other DNA
tgggactccgatcggagtcccac

SEQ ID NO: 3307 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactccgtacggagtcnnnn

SEQ ID NO: 3308 - DNA, 23 bp, synthetic construct
  misc_feature 1..23: note = Description of Artificial Sequence: Syntheticoligonucleotide
  source 1..23: mol_type = other DNA
gcggactccgtacggagtccgcc

SEQ ID NO: 3309 - DNA, 23 bp, synthetic construct
  misc_feature 1..23: note = Description of Artificial Sequence: Syntheticoligonucleotide
  source 1..23: mol_type = other DNA
gcggactccgtacggagtccgct

SEQ ID NO: 3310 - DNA, 23 bp, synthetic construct
  misc_feature 1..23: note = Description of Artificial Sequence: Syntheticoligonucleotide
  source 1..23: mol_type = other DNA
acggactccgtacggagtccgtc

SEQ ID NO: 3311 - DNA, 23 bp, synthetic construct
  misc_feature 1..23: note = Description of Artificial Sequence: Syntheticoligonucleotide
  source 1..23: mol_type = other DNA
gaggactccgtacggagtcctcc

SEQ ID NO: 3312 - DNA, 23 bp, synthetic construct
  misc_feature 1..23: note = Description of Artificial Sequence: Syntheticoligonucleotide
  source 1..23: mol_type = other DNA
gcagactccgtacggagtctgcc

SEQ ID NO: 3313 - DNA, 23 bp, synthetic construct
  misc_feature 1..23: note = Description of Artificial Sequence: Syntheticoligonucleotide
  source 1..23: mol_type = other DNA
gcggactccgtacggagtccgca

SEQ ID NO: 3314 - DNA, 23 bp, synthetic construct
  misc_feature 1..23: note = Description of Artificial Sequence: Syntheticoligonucleotide
  source 1..23: mol_type = other DNA
tcggactccgtacggagtccgac

SEQ ID NO: 3315 - DNA, 23 bp, synthetic construct
  misc_feature 1..23: note = Description of Artificial Sequence: Syntheticoligonucleotide
  source 1..23: mol_type = other DNA
gtggactccgtacggagtccacc

SEQ ID NO: 3316 - DNA, 23 bp, synthetic construct
  misc_feature 1..23: note = Description of Artificial Sequence: Syntheticoligonucleotide
  source 1..23: mol_type = other DNA
gctgactccgtacggagtcagcc

SEQ ID NO: 3317 - DNA, 23 bp, synthetic construct
  misc_feature 1..23: note = Description of Artificial Sequence: Syntheticoligonucleotide
  source 1..23: mol_type = other DNA
cccgactccgtacggagtcgggc

SEQ ID NO: 3318 - DNA, 23 bp, synthetic construct
  misc_feature 1..23: note = Description of Artificial Sequence: Syntheticoligonucleotide
  source 1..23: mol_type = other DNA
cccgactccgtacggagtcgggt

SEQ ID NO: 3319 - DNA, 23 bp, synthetic construct
  misc_feature 1..23: note = Description of Artificial Sequence: Syntheticoligonucleotide
  source 1..23: mol_type = other DNA
accgactccgtacggagtcggtc

SEQ ID NO: 3320 - DNA, 23 bp, synthetic construct
  misc_feature 1..23: note = Description of Artificial Sequence: Syntheticoligonucleotide
  source 1..23: mol_type = other DNA
cacgactccgtacggagtcgtgc

SEQ ID NO: 3321 - DNA, 23 bp, synthetic construct
  misc_feature 1..23: note = Description of Artificial Sequence: Syntheticoligonucleotide
  source 1..23: mol_type = other DNA
ccagactccgtacggagtctggc

SEQ ID NO: 3322 - DNA, 23 bp, synthetic construct
  misc_feature 1..23: note = Description of Artificial Sequence: Syntheticoligonucleotide
  source 1..23: mol_type = other DNA
cccgactccgtacggagtcggga

SEQ ID NO: 3323 - DNA, 23 bp, synthetic construct
  misc_feature 1..23: note = Description of Artificial Sequence: Syntheticoligonucleotide
  source 1..23: mol_type = other DNA
tccgactccgtacggagtcggac

SEQ ID NO: 3324 - DNA, 23 bp, synthetic construct
  misc_feature 1..23: note = Description of Artificial Sequence: Syntheticoligonucleotide
  source 1..23: mol_type = other DNA
cctgactccgtacggagtcaggc

SEQ ID NO: 3325 - DNA, 23 bp, synthetic construct
  misc_feature 1..23: note = Description of Artificial Sequence: Syntheticoligonucleotide
  source 1..23: mol_type = other DNA
ggcgactccgtacggagtcgccc

SEQ ID NO: 3326 - DNA, 23 bp, synthetic construct
  misc_feature 1..23: note = Description of Artificial Sequence: Syntheticoligonucleotide
  source 1..23: mol_type = other DNA
ggcgactccgtacggagtcgcct

SEQ ID NO: 3327 - DNA, 23 bp, synthetic construct
  misc_feature 1..23: note = Description of Artificial Sequence: Syntheticoligonucleotide
  source 1..23: mol_type = other DNA
agcgactccgtacggagtcgctc

SEQ ID NO: 3328 - DNA, 23 bp, synthetic construct
  misc_feature 1..23: note = Description of Artificial Sequence: Syntheticoligonucleotide
  source 1..23: mol_type = other DNA
gacgactccgtacggagtcgtcc

SEQ ID NO: 3329 - DNA, 23 bp, synthetic construct
  misc_feature 1..23: note = Description of Artificial Sequence: Syntheticoligonucleotide
  source 1..23: mol_type = other DNA
ggagactccgtacggagtctccc

SEQ ID NO: 3330 - DNA, 23 bp, synthetic construct
  misc_feature 1..23: note = Description of Artificial Sequence: Syntheticoligonucleotide
  source 1..23: mol_type = other DNA
ggcgactccgtacggagtcgcca

SEQ ID NO: 3331 - DNA, 23 bp, synthetic construct
  misc_feature 1..23: note = Description of Artificial Sequence: Syntheticoligonucleotide
  source 1..23: mol_type = other DNA
tgcgactccgtacggagtcgcac

SEQ ID NO: 3332 - DNA, 23 bp, synthetic construct
  misc_feature 1..23: note = Description of Artificial Sequence: Syntheticoligonucleotide
  source 1..23: mol_type = other DNA
ggtgactccgtacggagtcaccc

SEQ ID NO: 3333 - DNA, 23 bp, synthetic construct
  misc_feature 1..23: note = Description of Artificial Sequence: Syntheticoligonucleotide
  source 1..23: mol_type = other DNA
cgggactccgtacggagtcccgt

SEQ ID NO: 3334 - DNA, 23 bp, synthetic construct
  misc_feature 1..23: note = Description of Artificial Sequence: Syntheticoligonucleotide
  source 1..23: mol_type = other DNA
agggactccgtacggagtccctg

SEQ ID NO: 3335 - DNA, 23 bp, synthetic construct
  misc_feature 1..23: note = Description of Artificial Sequence: Syntheticoligonucleotide
  source 1..23: mol_type = other DNA
caggactccgtacggagtcctgg

SEQ ID NO: 3336 - DNA, 23 bp, synthetic construct
  misc_feature 1..23: note = Description of Artificial Sequence: Syntheticoligonucleotide
  source 1..23: mol_type = other DNA
cgagactccgtacggagtctcgg

SEQ ID NO: 3337 - DNA, 23 bp, synthetic construct
  misc_feature 1..23: note = Description of Artificial Sequence: Syntheticoligonucleotide
  source 1..23: mol_type = other DNA
cgggactccgtacggagtcccga

SEQ ID NO: 3338 - DNA, 23 bp, synthetic construct
  misc_feature 1..23: note = Description of Artificial Sequence: Syntheticoligonucleotide
  source 1..23: mol_type = other DNA
tgggactccgtacggagtcccag

SEQ ID NO: 3339 - DNA, 23 bp, synthetic construct
  misc_feature 1..23: note = Description of Artificial Sequence: Syntheticoligonucleotide
  source 1..23: mol_type = other DNA
ctggactccgtacggagtccagg

SEQ ID NO: 3340 - DNA, 23 bp, synthetic construct
  misc_feature 1..23: note = Description of Artificial Sequence: Syntheticoligonucleotide
  source 1..23: mol_type = other DNA
cgtgactccgtacggagtcacgg

SEQ ID NO: 3341 - DNA, 23 bp, synthetic construct
  misc_feature 1..23: note = Description of Artificial Sequence: Syntheticoligonucleotide
  source 1..23: mol_type = other DNA
ggcgactccgtacggagtcgccg

SEQ ID NO: 3342 - DNA, 23 bp, synthetic construct
  misc_feature 1..23: note = Description of Artificial Sequence: Syntheticoligonucleotide
  source 1..23: mol_type = other DNA
agcgactccgtacggagtcgctg

SEQ ID NO: 3343 - DNA, 23 bp, synthetic construct
  misc_feature 1..23: note = Description of Artificial Sequence: Syntheticoligonucleotide
  source 1..23: mol_type = other DNA
gacgactccgtacggagtcgtcg

SEQ ID NO: 3344 - DNA, 23 bp, synthetic construct
  misc_feature 1..23: note = Description of Artificial Sequence: Syntheticoligonucleotide
  source 1..23: mol_type = other DNA
ggagactccgtacggagtctccg

SEQ ID NO: 3345 - DNA, 23 bp, synthetic construct
  misc_feature 1..23: note = Description of Artificial Sequence: Syntheticoligonucleotide
  source 1..23: mol_type = other DNA
tgcgactccgtacggagtcgcag

SEQ ID NO: 3346 - DNA, 23 bp, synthetic construct
  misc_feature 1..23: note = Description of Artificial Sequence: Syntheticoligonucleotide
  source 1..23: mol_type = other DNA
ggtgactccgtacggagtcaccg

SEQ ID NO: 3347 - DNA, 23 bp, synthetic construct
  misc_feature 1..23: note = Description of Artificial Sequence: Syntheticoligonucleotide
  source 1..23: mol_type = other DNA
acggactccgtacggagtccgtg

SEQ ID NO: 3348 - DNA, 23 bp, synthetic construct
  misc_feature 1..23: note = Description of Artificial Sequence: Syntheticoligonucleotide
  source 1..23: mol_type = other DNA
ccagactccgtacggagtctggg

SEQ ID NO: 3349 - DNA, 23 bp, synthetic construct
  misc_feature 1..23: note = Description of Artificial Sequence: Syntheticoligonucleotide
  source 1..23: mol_type = other DNA
tcggactccgtacggagtccgag

SEQ ID NO: 3350 - DNA, 23 bp, synthetic construct
  misc_feature 1..23: note = Description of Artificial Sequence: Syntheticoligonucleotide
  source 1..23: mol_type = other DNA
cctgactccgtacggagtcaggg

SEQ ID NO: 3351 - DNA, 23 bp, synthetic construct
  misc_feature 1..23: note = Description of Artificial Sequence: Syntheticoligonucleotide
  source 1..23: mol_type = other DNA
cacgactccgtacggagtcgtgg

SEQ ID NO: 3352 - DNA, 23 bp, synthetic construct
  misc_feature 1..23: note = Description of Artificial Sequence: Syntheticoligonucleotide
  source 1..23: mol_type = other DNA
gccgactccgtacggagtcggct

SEQ ID NO: 3353 - DNA, 23 bp, synthetic construct
  misc_feature 1..23: note = Description of Artificial Sequence: Syntheticoligonucleotide
  source 1..23: mol_type = other DNA
gccgactccgtacggagtcggca

SEQ ID NO: 3354 - DNA, 23 bp, synthetic construct
  misc_feature 1..23: note = Description of Artificial Sequence: Syntheticoligonucleotide
  source 1..23: mol_type = other DNA
cgagactccgtacggagtctcgc

SEQ ID NO: 3355 - DNA, 23 bp, synthetic construct
  misc_feature 1..23: note = Description of Artificial Sequence: Syntheticoligonucleotide
  source 1..23: mol_type = other DNA
cgtgactccgtacggagtcacgc

SEQ ID NO: 3356 - DNA, 23 bp, synthetic construct
  misc_feature 1..23: note = Description of Artificial Sequence: Syntheticoligonucleotide
  source 1..23: mol_type = other DNA
caggactccgtacggagtcctgc

SEQ ID NO: 3357 - DNA, 23 bp, synthetic construct
  misc_feature 1..23: note = Description of Artificial Sequence: Syntheticoligonucleotide
  source 1..23: mol_type = other DNA
ctggactccgtacggagtccagc

SEQ ID NO: 3358 - DNA, 23 bp, synthetic construct
  misc_feature 1..23: note = Description of Artificial Sequence: Syntheticoligonucleotide
  source 1..23: mol_type = other DNA
gaggactccgtacggagtcctcg

SEQ ID NO: 3359 - DNA, 23 bp, synthetic construct
  misc_feature 1..23: note = Description of Artificial Sequence: Syntheticoligonucleotide
  source 1..23: mol_type = other DNA
gtggactccgtacggagtccacg

SEQ ID NO: 3360 - DNA, 23 bp, synthetic construct
  misc_feature 1..23: note = Description of Artificial Sequence: Syntheticoligonucleotide
  source 1..23: mol_type = other DNA
accgactccgtacggagtcggtg

SEQ ID NO: 3361 - DNA, 23 bp, synthetic construct
  misc_feature 1..23: note = Description of Artificial Sequence: Syntheticoligonucleotide
  source 1..23: mol_type = other DNA
tccgactccgtacggagtcggag

SEQ ID NO: 3362 - DNA, 23 bp, synthetic construct
  misc_feature 1..23: note = Description of Artificial Sequence: Syntheticoligonucleotide
  source 1..23: mol_type = other DNA
cgggactccgtacggagtcccgc

SEQ ID NO: 3363 - DNA, 23 bp, synthetic construct
  misc_feature 1..23: note = Description of Artificial Sequence: Syntheticoligonucleotide
  source 1..23: mol_type = other DNA
agggactccgtacggagtccctc

SEQ ID NO: 3364 - DNA, 23 bp, synthetic construct
  misc_feature 1..23: note = Description of Artificial Sequence: Syntheticoligonucleotide
  source 1..23: mol_type = other DNA
tgggactccgtacggagtcccac

SEQ ID NO: 3365 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactccggccggagtcnnnn

SEQ ID NO: 3366 - DNA, 23 bp, synthetic construct
  misc_feature 1..23: note = Description of Artificial Sequence: Syntheticoligonucleotide
  source 1..23: mol_type = other DNA
gcggactccggccggagtccgcc

SEQ ID NO: 3367 - DNA, 23 bp, synthetic construct
  misc_feature 1..23: note = Description of Artificial Sequence: Syntheticoligonucleotide
  source 1..23: mol_type = other DNA
gcggactccggccggagtccgct

SEQ ID NO: 3368 - DNA, 23 bp, synthetic construct
  misc_feature 1..23: note = Description of Artificial Sequence: Syntheticoligonucleotide
  source 1..23: mol_type = other DNA
acggactccggccggagtccgtc

SEQ ID NO: 3369 - DNA, 23 bp, synthetic construct
  misc_feature 1..23: note = Description of Artificial Sequence: Syntheticoligonucleotide
  source 1..23: mol_type = other DNA
gaggactccggccggagtcctcc

SEQ ID NO: 3370 - DNA, 23 bp, synthetic construct
  misc_feature 1..23: note = Description of Artificial Sequence: Syntheticoligonucleotide
  source 1..23: mol_type = other DNA
gcagactccggccggagtctgcc

SEQ ID NO: 3371 - DNA, 23 bp, synthetic construct
  misc_feature 1..23: note = Description of Artificial Sequence: Syntheticoligonucleotide
  source 1..23: mol_type = other DNA
gcggactccggccggagtccgca

SEQ ID NO: 3372 - DNA, 23 bp, synthetic construct
  misc_feature 1..23: note = Description of Artificial Sequence: Syntheticoligonucleotide
  source 1..23: mol_type = other DNA
tcggactccggccggagtccgac

SEQ ID NO: 3373 - DNA, 23 bp, synthetic construct
  misc_feature 1..23: note = Description of Artificial Sequence: Syntheticoligonucleotide
  source 1..23: mol_type = other DNA
gtggactccggccggagtccacc

SEQ ID NO: 3374 - DNA, 23 bp, synthetic construct
  misc_feature 1..23: note = Description of Artificial Sequence: Syntheticoligonucleotide
  source 1..23: mol_type = other DNA
gctgactccggccggagtcagcc

SEQ ID NO: 3375 - DNA, 23 bp, synthetic construct
  misc_feature 1..23: note = Description of Artificial Sequence: Syntheticoligonucleotide
  source 1..23: mol_type = other DNA
cccgactccggccggagtcgggc

SEQ ID NO: 3376 - DNA, 23 bp, synthetic construct
  misc_feature 1..23: note = Description of Artificial Sequence: Syntheticoligonucleotide
  source 1..23: mol_type = other DNA
cccgactccggccggagtcgggt

SEQ ID NO: 3377 - DNA, 23 bp, synthetic construct
  misc_feature 1..23: note = Description of Artificial Sequence: Syntheticoligonucleotide
  source 1..23: mol_type = other DNA
accgactccggccggagtcggtc

SEQ ID NO: 3378 - DNA, 23 bp, synthetic construct
  misc_feature 1..23: note = Description of Artificial Sequence: Syntheticoligonucleotide
  source 1..23: mol_type = other DNA
cacgactccggccggagtcgtgc

SEQ ID NO: 3379 - DNA, 23 bp, synthetic construct
  misc_feature 1..23: note = Description of Artificial Sequence: Syntheticoligonucleotide
  source 1..23: mol_type = other DNA
ccagactccggccggagtctggc

SEQ ID NO: 3380 - DNA, 23 bp, synthetic construct
  misc_feature 1..23: note = Description of Artificial Sequence: Syntheticoligonucleotide
  source 1..23: mol_type = other DNA
cccgactccggccggagtcggga

SEQ ID NO: 3381 - DNA, 23 bp, synthetic construct
  misc_feature 1..23: note = Description of Artificial Sequence: Syntheticoligonucleotide
  source 1..23: mol_type = other DNA
tccgactccggccggagtcggac

SEQ ID NO: 3382 - DNA, 23 bp, synthetic construct
  misc_feature 1..23: note = Description of Artificial Sequence: Syntheticoligonucleotide
  source 1..23: mol_type = other DNA
cctgactccggccggagtcaggc

SEQ ID NO: 3383 - DNA, 23 bp, synthetic construct
  misc_feature 1..23: note = Description of Artificial Sequence: Syntheticoligonucleotide
  source 1..23: mol_type = other DNA
ggcgactccggccggagtcgccc

SEQ ID NO: 3384 - DNA, 23 bp, synthetic construct
  misc_feature 1..23: note = Description of Artificial Sequence: Syntheticoligonucleotide
  source 1..23: mol_type = other DNA
ggcgactccggccggagtcgcct

SEQ ID NO: 3385 - DNA, 23 bp, synthetic construct
  misc_feature 1..23: note = Description of Artificial Sequence: Syntheticoligonucleotide
  source 1..23: mol_type = other DNA
agcgactccggccggagtcgctc

SEQ ID NO: 3386 - DNA, 23 bp, synthetic construct
  misc_feature 1..23: note = Description of Artificial Sequence: Syntheticoligonucleotide
  source 1..23: mol_type = other DNA
gacgactccggccggagtcgtcc

SEQ ID NO: 3387 - DNA, 23 bp, synthetic construct
  misc_feature 1..23: note = Description of Artificial Sequence: Syntheticoligonucleotide
  source 1..23: mol_type = other DNA
ggagactccggccggagtctccc

SEQ ID NO: 3388 - DNA, 23 bp, synthetic construct
  misc_feature 1..23: note = Description of Artificial Sequence: Syntheticoligonucleotide
  source 1..23: mol_type = other DNA
ggcgactccggccggagtcgcca

SEQ ID NO: 3389 - DNA, 23 bp, synthetic construct
  misc_feature 1..23: note = Description of Artificial Sequence: Syntheticoligonucleotide
  source 1..23: mol_type = other DNA
tgcgactccggccggagtcgcac

SEQ ID NO: 3390 - DNA, 23 bp, synthetic construct
  misc_feature 1..23: note = Description of Artificial Sequence: Syntheticoligonucleotide
  source 1..23: mol_type = other DNA
ggtgactccggccggagtcaccc

SEQ ID NO: 3391 - DNA, 23 bp, synthetic construct
  misc_feature 1..23: note = Description of Artificial Sequence: Syntheticoligonucleotide
  source 1..23: mol_type = other DNA
cgggactccggccggagtcccgt

SEQ ID NO: 3392 - DNA, 23 bp, synthetic construct
  misc_feature 1..23: note = Description of Artificial Sequence: Syntheticoligonucleotide
  source 1..23: mol_type = other DNA
agggactccggccggagtccctg

SEQ ID NO: 3393 - DNA, 23 bp, synthetic construct
  misc_feature 1..23: note = Description of Artificial Sequence: Syntheticoligonucleotide
  source 1..23: mol_type = other DNA
caggactccggccggagtcctgg

SEQ ID NO: 3394 - DNA, 23 bp, synthetic construct
  misc_feature 1..23: note = Description of Artificial Sequence: Syntheticoligonucleotide
  source 1..23: mol_type = other DNA
cgagactccggccggagtctcgg

SEQ ID NO: 3395 - DNA, 23 bp, synthetic construct
  misc_feature 1..23: note = Description of Artificial Sequence: Syntheticoligonucleotide
  source 1..23: mol_type = other DNA
cgggactccggccggagtcccga

SEQ ID NO: 3396 - DNA, 23 bp, synthetic construct
  misc_feature 1..23: note = Description of Artificial Sequence: Syntheticoligonucleotide
  source 1..23: mol_type = other DNA
tgggactccggccggagtcccag

SEQ ID NO: 3397 - DNA, 23 bp, synthetic construct
  misc_feature 1..23: note = Description of Artificial Sequence: Syntheticoligonucleotide
  source 1..23: mol_type = other DNA
ctggactccggccggagtccagg

SEQ ID NO: 3398 - DNA, 23 bp, synthetic construct
  misc_feature 1..23: note = Description of Artificial Sequence: Syntheticoligonucleotide
  source 1..23: mol_type = other DNA
cgtgactccggccggagtcacgg

SEQ ID NO: 3399 - DNA, 23 bp, synthetic construct
  misc_feature 1..23: note = Description of Artificial Sequence: Syntheticoligonucleotide
  source 1..23: mol_type = other DNA
ggcgactccggccggagtcgccg

SEQ ID NO: 3400 - DNA, 23 bp, synthetic construct
  misc_feature 1..23: note = Description of Artificial Sequence: Syntheticoligonucleotide
  source 1..23: mol_type = other DNA
agcgactccggccggagtcgctg

SEQ ID NO: 3401 - DNA, 23 bp, synthetic construct
  misc_feature 1..23: note = Description of Artificial Sequence: Syntheticoligonucleotide
  source 1..23: mol_type = other DNA
gacgactccggccggagtcgtcg

SEQ ID NO: 3402 - DNA, 23 bp, synthetic construct
  misc_feature 1..23: note = Description of Artificial Sequence: Syntheticoligonucleotide
  source 1..23: mol_type = other DNA
ggagactccggccggagtctccg

SEQ ID NO: 3403 - DNA, 23 bp, synthetic construct
  misc_feature 1..23: note = Description of Artificial Sequence: Syntheticoligonucleotide
  source 1..23: mol_type = other DNA
tgcgactccggccggagtcgcag

SEQ ID NO: 3404 - DNA, 23 bp, synthetic construct
  misc_feature 1..23: note = Description of Artificial Sequence: Syntheticoligonucleotide
  source 1..23: mol_type = other DNA
ggtgactccggccggagtcaccg

SEQ ID NO: 3405 - DNA, 23 bp, synthetic construct
  misc_feature 1..23: note = Description of Artificial Sequence: Syntheticoligonucleotide
  source 1..23: mol_type = other DNA
acggactccggccggagtccgtg

SEQ ID NO: 3406 - DNA, 23 bp, synthetic construct
  misc_feature 1..23: note = Description of Artificial Sequence: Syntheticoligonucleotide
  source 1..23: mol_type = other DNA
ccagactccggccggagtctggg

SEQ ID NO: 3407 - DNA, 23 bp, synthetic construct
  misc_feature 1..23: note = Description of Artificial Sequence: Syntheticoligonucleotide
  source 1..23: mol_type = other DNA
tcggactccggccggagtccgag

SEQ ID NO: 3408 - DNA, 23 bp, synthetic construct
  misc_feature 1..23: note = Description of Artificial Sequence: Syntheticoligonucleotide
  source 1..23: mol_type = other DNA
cctgactccggccggagtcaggg

SEQ ID NO: 3409 - DNA, 23 bp, synthetic construct
  misc_feature 1..23: note = Description of Artificial Sequence: Syntheticoligonucleotide
  source 1..23: mol_type = other DNA
cacgactccggccggagtcgtgg

SEQ ID NO: 3410 - DNA, 23 bp, synthetic construct
  misc_feature 1..23: note = Description of Artificial Sequence: Syntheticoligonucleotide
  source 1..23: mol_type = other DNA
gccgactccggccggagtcggct

SEQ ID NO: 3411 - DNA, 23 bp, synthetic construct
  misc_feature 1..23: note = Description of Artificial Sequence: Syntheticoligonucleotide
  source 1..23: mol_type = other DNA
gccgactccggccggagtcggca

SEQ ID NO: 3412 - DNA, 23 bp, synthetic construct
  misc_feature 1..23: note = Description of Artificial Sequence: Syntheticoligonucleotide
  source 1..23: mol_type = other DNA
cgagactccggccggagtctcgc

SEQ ID NO: 3413 - DNA, 23 bp, synthetic construct
  misc_feature 1..23: note = Description of Artificial Sequence: Syntheticoligonucleotide
  source 1..23: mol_type = other DNA
cgtgactccggccggagtcacgc

SEQ ID NO: 3414 - DNA, 23 bp, synthetic construct
  misc_feature 1..23: note = Description of Artificial Sequence: Syntheticoligonucleotide
  source 1..23: mol_type = other DNA
caggactccggccggagtcctgc

SEQ ID NO: 3415 - DNA, 23 bp, synthetic construct
  misc_feature 1..23: note = Description of Artificial Sequence: Syntheticoligonucleotide
  source 1..23: mol_type = other DNA
ctggactccggccggagtccagc

SEQ ID NO: 3416 - DNA, 23 bp, synthetic construct
  misc_feature 1..23: note = Description of Artificial Sequence: Syntheticoligonucleotide
  source 1..23: mol_type = other DNA
gaggactccggccggagtcctcg

SEQ ID NO: 3417 - DNA, 23 bp, synthetic construct
  misc_feature 1..23: note = Description of Artificial Sequence: Syntheticoligonucleotide
  source 1..23: mol_type = other DNA
gtggactccggccggagtccacg

SEQ ID NO: 3418 - DNA, 23 bp, synthetic construct
  misc_feature 1..23: note = Description of Artificial Sequence: Syntheticoligonucleotide
  source 1..23: mol_type = other DNA
accgactccggccggagtcggtg

SEQ ID NO: 3419 - DNA, 23 bp, synthetic construct
  misc_feature 1..23: note = Description of Artificial Sequence: Syntheticoligonucleotide
  source 1..23: mol_type = other DNA
tccgactccggccggagtcggag

SEQ ID NO: 3420 - DNA, 23 bp, synthetic construct
  misc_feature 1..23: note = Description of Artificial Sequence: Syntheticoligonucleotide
  source 1..23: mol_type = other DNA
cgggactccggccggagtcccgc

SEQ ID NO: 3421 - DNA, 23 bp, synthetic construct
  misc_feature 1..23: note = Description of Artificial Sequence: Syntheticoligonucleotide
  source 1..23: mol_type = other DNA
agggactccggccggagtccctc

SEQ ID NO: 3422 - DNA, 23 bp, synthetic construct
  misc_feature 1..23: note = Description of Artificial Sequence: Syntheticoligonucleotide
  source 1..23: mol_type = other DNA
tgggactccggccggagtcccac

SEQ ID NO: 3423 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactccgcgcggagtcnnnn

SEQ ID NO: 3424 - DNA, 23 bp, synthetic construct
  misc_feature 1..23: note = Description of Artificial Sequence: Syntheticoligonucleotide
  source 1..23: mol_type = other DNA
gcggactccgcgcggagtccgcc

SEQ ID NO: 3425 - DNA, 23 bp, synthetic construct
  misc_feature 1..23: note = Description of Artificial Sequence: Syntheticoligonucleotide
  source 1..23: mol_type = other DNA
gcggactccgcgcggagtccgct

SEQ ID NO: 3426 - DNA, 23 bp, synthetic construct
  misc_feature 1..23: note = Description of Artificial Sequence: Syntheticoligonucleotide
  source 1..23: mol_type = other DNA
acggactccgcgcggagtccgtc

SEQ ID NO: 3427 - DNA, 23 bp, synthetic construct
  misc_feature 1..23: note = Description of Artificial Sequence: Syntheticoligonucleotide
  source 1..23: mol_type = other DNA
gaggactccgcgcggagtcctcc

SEQ ID NO: 3428 - DNA, 23 bp, synthetic construct
  misc_feature 1..23: note = Description of Artificial Sequence: Syntheticoligonucleotide
  source 1..23: mol_type = other DNA
gcagactccgcgcggagtctgcc

SEQ ID NO: 3429 - DNA, 23 bp, synthetic construct
  misc_feature 1..23: note = Description of Artificial Sequence: Syntheticoligonucleotide
  source 1..23: mol_type = other DNA
gcggactccgcgcggagtccgca

SEQ ID NO: 3430 - DNA, 23 bp, synthetic construct
  misc_feature 1..23: note = Description of Artificial Sequence: Syntheticoligonucleotide
  source 1..23: mol_type = other DNA
tcggactccgcgcggagtccgac

SEQ ID NO: 3431 - DNA, 23 bp, synthetic construct
  misc_feature 1..23: note = Description of Artificial Sequence: Syntheticoligonucleotide
  source 1..23: mol_type = other DNA
gtggactccgcgcggagtccacc

SEQ ID NO: 3432 - DNA, 23 bp, synthetic construct
  misc_feature 1..23: note = Description of Artificial Sequence: Syntheticoligonucleotide
  source 1..23: mol_type = other DNA
gctgactccgcgcggagtcagcc

SEQ ID NO: 3433 - DNA, 23 bp, synthetic construct
  misc_feature 1..23: note = Description of Artificial Sequence: Syntheticoligonucleotide
  source 1..23: mol_type = other DNA
cccgactccgcgcggagtcgggc

SEQ ID NO: 3434 - DNA, 23 bp, synthetic construct
  misc_feature 1..23: note = Description of Artificial Sequence: Syntheticoligonucleotide
  source 1..23: mol_type = other DNA
cccgactccgcgcggagtcgggt

SEQ ID NO: 3435 - DNA, 23 bp, synthetic construct
  misc_feature 1..23: note = Description of Artificial Sequence: Syntheticoligonucleotide
  source 1..23: mol_type = other DNA
accgactccgcgcggagtcggtc

SEQ ID NO: 3436 - DNA, 23 bp, synthetic construct
  misc_feature 1..23: note = Description of Artificial Sequence: Syntheticoligonucleotide
  source 1..23: mol_type = other DNA
cacgactccgcgcggagtcgtgc

SEQ ID NO: 3437 - DNA, 23 bp, synthetic construct
  misc_feature 1..23: note = Description of Artificial Sequence: Syntheticoligonucleotide
  source 1..23: mol_type = other DNA
ccagactccgcgcggagtctggc

SEQ ID NO: 3438 - DNA, 23 bp, synthetic construct
  misc_feature 1..23: note = Description of Artificial Sequence: Syntheticoligonucleotide
  source 1..23: mol_type = other DNA
cccgactccgcgcggagtcggga

SEQ ID NO: 3439 - DNA, 23 bp, synthetic construct
  misc_feature 1..23: note = Description of Artificial Sequence: Syntheticoligonucleotide
  source 1..23: mol_type = other DNA
tccgactccgcgcggagtcggac

SEQ ID NO: 3440 - DNA, 23 bp, synthetic construct
  misc_feature 1..23: note = Description of Artificial Sequence: Syntheticoligonucleotide
  source 1..23: mol_type = other DNA
cctgactccgcgcggagtcaggc

SEQ ID NO: 3441 - DNA, 23 bp, synthetic construct
  misc_feature 1..23: note = Description of Artificial Sequence: Syntheticoligonucleotide
  source 1..23: mol_type = other DNA
ggcgactccgcgcggagtcgccc

SEQ ID NO: 3442 - DNA, 23 bp, synthetic construct
  misc_feature 1..23: note = Description of Artificial Sequence: Syntheticoligonucleotide
  source 1..23: mol_type = other DNA
ggcgactccgcgcggagtcgcct

SEQ ID NO: 3443 - DNA, 23 bp, synthetic construct
  misc_feature 1..23: note = Description of Artificial Sequence: Syntheticoligonucleotide
  source 1..23: mol_type = other DNA
agcgactccgcgcggagtcgctc

SEQ ID NO: 3444 - DNA, 23 bp, synthetic construct
  misc_feature 1..23: note = Description of Artificial Sequence: Syntheticoligonucleotide
  source 1..23: mol_type = other DNA
gacgactccgcgcggagtcgtcc

SEQ ID NO: 3445 - DNA, 23 bp, synthetic construct
  misc_feature 1..23: note = Description of Artificial Sequence: Syntheticoligonucleotide
  source 1..23: mol_type = other DNA
ggagactccgcgcggagtctccc

SEQ ID NO: 3446 - DNA, 23 bp, synthetic construct
  misc_feature 1..23: note = Description of Artificial Sequence: Syntheticoligonucleotide
  source 1..23: mol_type = other DNA
ggcgactccgcgcggagtcgcca

SEQ ID NO: 3447 - DNA, 23 bp, synthetic construct
  misc_feature 1..23: note = Description of Artificial Sequence: Syntheticoligonucleotide
  source 1..23: mol_type = other DNA
tgcgactccgcgcggagtcgcac

SEQ ID NO: 3448 - DNA, 23 bp, synthetic construct
  misc_feature 1..23: note = Description of Artificial Sequence: Syntheticoligonucleotide
  source 1..23: mol_type = other DNA
ggtgactccgcgcggagtcaccc

SEQ ID NO: 3449 - DNA, 23 bp, synthetic construct
  misc_feature 1..23: note = Description of Artificial Sequence: Syntheticoligonucleotide
  source 1..23: mol_type = other DNA
cgggactccgcgcggagtcccgt

SEQ ID NO: 3450 - DNA, 23 bp, synthetic construct
  misc_feature 1..23: note = Description of Artificial Sequence: Syntheticoligonucleotide
  source 1..23: mol_type = other DNA
agggactccgcgcggagtccctg

SEQ ID NO: 3451 - DNA, 23 bp, synthetic construct
  misc_feature 1..23: note = Description of Artificial Sequence: Syntheticoligonucleotide
  source 1..23: mol_type = other DNA
caggactccgcgcggagtcctgg

SEQ ID NO: 3452 - DNA, 23 bp, synthetic construct
  misc_feature 1..23: note = Description of Artificial Sequence: Syntheticoligonucleotide
  source 1..23: mol_type = other DNA
cgagactccgcgcggagtctcgg

SEQ ID NO: 3453 - DNA, 23 bp, synthetic construct
  misc_feature 1..23: note = Description of Artificial Sequence: Syntheticoligonucleotide
  source 1..23: mol_type = other DNA
cgggactccgcgcggagtcccga

SEQ ID NO: 3454 - DNA, 23 bp, synthetic construct
  misc_feature 1..23: note = Description of Artificial Sequence: Syntheticoligonucleotide
  source 1..23: mol_type = other DNA
tgggactccgcgcggagtcccag

SEQ ID NO: 3455 - DNA, 23 bp, synthetic construct
  misc_feature 1..23: note = Description of Artificial Sequence: Syntheticoligonucleotide
  source 1..23: mol_type = other DNA
ctggactccgcgcggagtccagg

SEQ ID NO: 3456 - DNA, 23 bp, synthetic construct
  misc_feature 1..23: note = Description of Artificial Sequence: Syntheticoligonucleotide
  source 1..23: mol_type = other DNA
cgtgactccgcgcggagtcacgg

SEQ ID NO: 3457 - DNA, 23 bp, synthetic construct
  misc_feature 1..23: note = Description of Artificial Sequence: Syntheticoligonucleotide
  source 1..23: mol_type = other DNA
ggcgactccgcgcggagtcgccg

SEQ ID NO: 3458 - DNA, 23 bp, synthetic construct
  misc_feature 1..23: note = Description of Artificial Sequence: Syntheticoligonucleotide
  source 1..23: mol_type = other DNA
agcgactccgcgcggagtcgctg

SEQ ID NO: 3459 - DNA, 23 bp, synthetic construct
  misc_feature 1..23: note = Description of Artificial Sequence: Syntheticoligonucleotide
  source 1..23: mol_type = other DNA
gacgactccgcgcggagtcgtcg

SEQ ID NO: 3460 - DNA, 23 bp, synthetic construct
  misc_feature 1..23: note = Description of Artificial Sequence: Syntheticoligonucleotide
  source 1..23: mol_type = other DNA
ggagactccgcgcggagtctccg

SEQ ID NO: 3461 - DNA, 23 bp, synthetic construct
  misc_feature 1..23: note = Description of Artificial Sequence: Syntheticoligonucleotide
  source 1..23: mol_type = other DNA
tgcgactccgcgcggagtcgcag

SEQ ID NO: 3462 - DNA, 23 bp, synthetic construct
  misc_feature 1..23: note = Description of Artificial Sequence: Syntheticoligonucleotide
  source 1..23: mol_type = other DNA
ggtgactccgcgcggagtcaccg

SEQ ID NO: 3463 - DNA, 23 bp, synthetic construct
  misc_feature 1..23: note = Description of Artificial Sequence: Syntheticoligonucleotide
  source 1..23: mol_type = other DNA
acggactccgcgcggagtccgtg

SEQ ID NO: 3464 - DNA, 23 bp, synthetic construct
  misc_feature 1..23: note = Description of Artificial Sequence: Syntheticoligonucleotide
  source 1..23: mol_type = other DNA
ccagactccgcgcggagtctggg

SEQ ID NO: 3465 - DNA, 23 bp, synthetic construct
  misc_feature 1..23: note = Description of Artificial Sequence: Syntheticoligonucleotide
  source 1..23: mol_type = other DNA
tcggactccgcgcggagtccgag

SEQ ID NO: 3466 - DNA, 23 bp, synthetic construct
  misc_feature 1..23: note = Description of Artificial Sequence: Syntheticoligonucleotide
  source 1..23: mol_type = other DNA
cctgactccgcgcggagtcaggg

SEQ ID NO: 3467 - DNA, 23 bp, synthetic construct
  misc_feature 1..23: note = Description of Artificial Sequence: Syntheticoligonucleotide
  source 1..23: mol_type = other DNA
cacgactccgcgcggagtcgtgg

SEQ ID NO: 3468 - DNA, 23 bp, synthetic construct
  misc_feature 1..23: note = Description of Artificial Sequence: Syntheticoligonucleotide
  source 1..23: mol_type = other DNA
gccgactccgcgcggagtcggct

SEQ ID NO: 3469 - DNA, 23 bp, synthetic construct
  misc_feature 1..23: note = Description of Artificial Sequence: Syntheticoligonucleotide
  source 1..23: mol_type = other DNA
gccgactccgcgcggagtcggca

SEQ ID NO: 3470 - DNA, 23 bp, synthetic construct
  misc_feature 1..23: note = Description of Artificial Sequence: Syntheticoligonucleotide
  source 1..23: mol_type = other DNA
cgagactccgcgcggagtctcgc

SEQ ID NO: 3471 - DNA, 23 bp, synthetic construct
  misc_feature 1..23: note = Description of Artificial Sequence: Syntheticoligonucleotide
  source 1..23: mol_type = other DNA
cgtgactccgcgcggagtcacgc

SEQ ID NO: 3472 - DNA, 23 bp, synthetic construct
  misc_feature 1..23: note = Description of Artificial Sequence: Syntheticoligonucleotide
  source 1..23: mol_type = other DNA
caggactccgcgcggagtcctgc

SEQ ID NO: 3473 - DNA, 23 bp, synthetic construct
  misc_feature 1..23: note = Description of Artificial Sequence: Syntheticoligonucleotide
  source 1..23: mol_type = other DNA
ctggactccgcgcggagtccagc

SEQ ID NO: 3474 - DNA, 23 bp, synthetic construct
  misc_feature 1..23: note = Description of Artificial Sequence: Syntheticoligonucleotide
  source 1..23: mol_type = other DNA
gaggactccgcgcggagtcctcg

SEQ ID NO: 3475 - DNA, 23 bp, synthetic construct
  misc_feature 1..23: note = Description of Artificial Sequence: Syntheticoligonucleotide
  source 1..23: mol_type = other DNA
gtggactccgcgcggagtccacg

SEQ ID NO: 3476 - DNA, 23 bp, synthetic construct
  misc_feature 1..23: note = Description of Artificial Sequence: Syntheticoligonucleotide
  source 1..23: mol_type = other DNA
accgactccgcgcggagtcggtg

SEQ ID NO: 3477 - DNA, 23 bp, synthetic construct
  misc_feature 1..23: note = Description of Artificial Sequence: Syntheticoligonucleotide
  source 1..23: mol_type = other DNA
tccgactccgcgcggagtcggag

SEQ ID NO: 3478 - DNA, 23 bp, synthetic construct
  misc_feature 1..23: note = Description of Artificial Sequence: Syntheticoligonucleotide
  source 1..23: mol_type = other DNA
cgggactccgcgcggagtcccgc

SEQ ID NO: 3479 - DNA, 23 bp, synthetic construct
  misc_feature 1..23: note = Description of Artificial Sequence: Syntheticoligonucleotide
  source 1..23: mol_type = other DNA
agggactccgcgcggagtccctc

SEQ ID NO: 3480 - DNA, 23 bp, synthetic construct
  misc_feature 1..23: note = Description of Artificial Sequence: Syntheticoligonucleotide
  source 1..23: mol_type = other DNA
tgggactccgcgcggagtcccac

SEQ ID NO: 3481 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactctgatcagagtcnnnn

SEQ ID NO: 3482 - DNA, 23 bp, synthetic construct
  misc_feature 1..23: note = Description of Artificial Sequence: Syntheticoligonucleotide
  source 1..23: mol_type = other DNA
gcggactctgatcagagtccgcc

SEQ ID NO: 3483 - DNA, 23 bp, synthetic construct
  misc_feature 1..23: note = Description of Artificial Sequence: Syntheticoligonucleotide
  source 1..23: mol_type = other DNA
gcggactctgatcagagtccgct

SEQ ID NO: 3484 - DNA, 23 bp, synthetic construct
  misc_feature 1..23: note = Description of Artificial Sequence: Syntheticoligonucleotide
  source 1..23: mol_type = other DNA
acggactctgatcagagtccgtc

SEQ ID NO: 3485 - DNA, 23 bp, synthetic construct
  misc_feature 1..23: note = Description of Artificial Sequence: Syntheticoligonucleotide
  source 1..23: mol_type = other DNA
gaggactctgatcagagtcctcc

SEQ ID NO: 3486 - DNA, 23 bp, synthetic construct
  misc_feature 1..23: note = Description of Artificial Sequence: Syntheticoligonucleotide
  source 1..23: mol_type = other DNA
gcagactctgatcagagtctgcc

SEQ ID NO: 3487 - DNA, 23 bp, synthetic construct
  misc_feature 1..23: note = Description of Artificial Sequence: Syntheticoligonucleotide
  source 1..23: mol_type = other DNA
gcggactctgatcagagtccgca

SEQ ID NO: 3488 - DNA, 23 bp, synthetic construct
  misc_feature 1..23: note = Description of Artificial Sequence: Syntheticoligonucleotide
  source 1..23: mol_type = other DNA
tcggactctgatcagagtccgac

SEQ ID NO: 3489 - DNA, 23 bp, synthetic construct
  misc_feature 1..23: note = Description of Artificial Sequence: Syntheticoligonucleotide
  source 1..23: mol_type = other DNA
gtggactctgatcagagtccacc

SEQ ID NO: 3490 - DNA, 23 bp, synthetic construct
  misc_feature 1..23: note = Description of Artificial Sequence: Syntheticoligonucleotide
  source 1..23: mol_type = other DNA
gctgactctgatcagagtcagcc

SEQ ID NO: 3491 - DNA, 23 bp, synthetic construct
  misc_feature 1..23: note = Description of Artificial Sequence: Syntheticoligonucleotide
  source 1..23: mol_type = other DNA
cccgactctgatcagagtcgggc

SEQ ID NO: 3492 - DNA, 23 bp, synthetic construct
  misc_feature 1..23: note = Description of Artificial Sequence: Syntheticoligonucleotide
  source 1..23: mol_type = other DNA
cccgactctgatcagagtcgggt

SEQ ID NO: 3493 - DNA, 23 bp, synthetic construct
  misc_feature 1..23: note = Description of Artificial Sequence: Syntheticoligonucleotide
  source 1..23: mol_type = other DNA
accgactctgatcagagtcggtc

SEQ ID NO: 3494 - DNA, 23 bp, synthetic construct
  misc_feature 1..23: note = Description of Artificial Sequence: Syntheticoligonucleotide
  source 1..23: mol_type = other DNA
cacgactctgatcagagtcgtgc

SEQ ID NO: 3495 - DNA, 23 bp, synthetic construct
  misc_feature 1..23: note = Description of Artificial Sequence: Syntheticoligonucleotide
  source 1..23: mol_type = other DNA
ccagactctgatcagagtctggc

SEQ ID NO: 3496 - DNA, 23 bp, synthetic construct
  misc_feature 1..23: note = Description of Artificial Sequence: Syntheticoligonucleotide
  source 1..23: mol_type = other DNA
cccgactctgatcagagtcggga

SEQ ID NO: 3497 - DNA, 23 bp, synthetic construct
  misc_feature 1..23: note = Description of Artificial Sequence: Syntheticoligonucleotide
  source 1..23: mol_type = other DNA
tccgactctgatcagagtcggac

SEQ ID NO: 3498 - DNA, 23 bp, synthetic construct
  misc_feature 1..23: note = Description of Artificial Sequence: Syntheticoligonucleotide
  source 1..23: mol_type = other DNA
cctgactctgatcagagtcaggc

SEQ ID NO: 3499 - DNA, 23 bp, synthetic construct
  misc_feature 1..23: note = Description of Artificial Sequence: Syntheticoligonucleotide
  source 1..23: mol_type = other DNA
ggcgactctgatcagagtcgccc

SEQ ID NO: 3500 - DNA, 23 bp, synthetic construct
  misc_feature 1..23: note = Description of Artificial Sequence: Syntheticoligonucleotide
  source 1..23: mol_type = other DNA
ggcgactctgatcagagtcgcct

SEQ ID NO: 3501 - DNA, 23 bp, synthetic construct
  misc_feature 1..23: note = Description of Artificial Sequence: Syntheticoligonucleotide
  source 1..23: mol_type = other DNA
agcgactctgatcagagtcgctc

SEQ ID NO: 3502 - DNA, 23 bp, synthetic construct
  misc_feature 1..23: note = Description of Artificial Sequence: Syntheticoligonucleotide
  source 1..23: mol_type = other DNA
gacgactctgatcagagtcgtcc

SEQ ID NO: 3503 - DNA, 23 bp, synthetic construct
  misc_feature 1..23: note = Description of Artificial Sequence: Syntheticoligonucleotide
  source 1..23: mol_type = other DNA
ggagactctgatcagagtctccc

SEQ ID NO: 3504 - DNA, 23 bp, synthetic construct
  misc_feature 1..23: note = Description of Artificial Sequence: Syntheticoligonucleotide
  source 1..23: mol_type = other DNA
ggcgactctgatcagagtcgcca

SEQ ID NO: 3505 - DNA, 23 bp, synthetic construct
  misc_feature 1..23: note = Description of Artificial Sequence: Syntheticoligonucleotide
  source 1..23: mol_type = other DNA
tgcgactctgatcagagtcgcac

SEQ ID NO: 3506 - DNA, 23 bp, synthetic construct
  misc_feature 1..23: note = Description of Artificial Sequence: Syntheticoligonucleotide
  source 1..23: mol_type = other DNA
ggtgactctgatcagagtcaccc

SEQ ID NO: 3507 - DNA, 23 bp, synthetic construct
  misc_feature 1..23: note = Description of Artificial Sequence: Syntheticoligonucleotide
  source 1..23: mol_type = other DNA
cgggactctgatcagagtcccgt

SEQ ID NO: 3508 - DNA, 23 bp, synthetic construct
  misc_feature 1..23: note = Description of Artificial Sequence: Syntheticoligonucleotide
  source 1..23: mol_type = other DNA
agggactctgatcagagtccctg

SEQ ID NO: 3509 - DNA, 23 bp, synthetic construct
  misc_feature 1..23: note = Description of Artificial Sequence: Syntheticoligonucleotide
  source 1..23: mol_type = other DNA
caggactctgatcagagtcctgg

SEQ ID NO: 3510 - DNA, 23 bp, synthetic construct
  misc_feature 1..23: note = Description of Artificial Sequence: Syntheticoligonucleotide
  source 1..23: mol_type = other DNA
cgagactctgatcagagtctcgg

SEQ ID NO: 3511 - DNA, 23 bp, synthetic construct
  misc_feature 1..23: note = Description of Artificial Sequence: Syntheticoligonucleotide
  source 1..23: mol_type = other DNA
cgggactctgatcagagtcccga

SEQ ID NO: 3512 - DNA, 23 bp, synthetic construct
  misc_feature 1..23: note = Description of Artificial Sequence: Syntheticoligonucleotide
  source 1..23: mol_type = other DNA
tgggactctgatcagagtcccag

SEQ ID NO: 3513 - DNA, 23 bp, synthetic construct
  misc_feature 1..23: note = Description of Artificial Sequence: Syntheticoligonucleotide
  source 1..23: mol_type = other DNA
ctggactctgatcagagtccagg

SEQ ID NO: 3514 - DNA, 23 bp, synthetic construct
  misc_feature 1..23: note = Description of Artificial Sequence: Syntheticoligonucleotide
  source 1..23: mol_type = other DNA
cgtgactctgatcagagtcacgg

SEQ ID NO: 3515 - DNA, 23 bp, synthetic construct
  misc_feature 1..23: note = Description of Artificial Sequence: Syntheticoligonucleotide
  source 1..23: mol_type = other DNA
ggcgactctgatcagagtcgccg

SEQ ID NO: 3516 - DNA, 23 bp, synthetic construct
  misc_feature 1..23: note = Description of Artificial Sequence: Syntheticoligonucleotide
  source 1..23: mol_type = other DNA
agcgactctgatcagagtcgctg

SEQ ID NO: 3517 - DNA, 23 bp, synthetic construct
  misc_feature 1..23: note = Description of Artificial Sequence: Syntheticoligonucleotide
  source 1..23: mol_type = other DNA
gacgactctgatcagagtcgtcg

SEQ ID NO: 3518 - DNA, 23 bp, synthetic construct
  misc_feature 1..23: note = Description of Artificial Sequence: Syntheticoligonucleotide
  source 1..23: mol_type = other DNA
ggagactctgatcagagtctccg

SEQ ID NO: 3519 - DNA, 23 bp, synthetic construct
  misc_feature 1..23: note = Description of Artificial Sequence: Syntheticoligonucleotide
  source 1..23: mol_type = other DNA
tgcgactctgatcagagtcgcag

SEQ ID NO: 3520 - DNA, 23 bp, synthetic construct
  misc_feature 1..23: note = Description of Artificial Sequence: Syntheticoligonucleotide
  source 1..23: mol_type = other DNA
ggtgactctgatcagagtcaccg

SEQ ID NO: 3521 - DNA, 23 bp, synthetic construct
  misc_feature 1..23: note = Description of Artificial Sequence: Syntheticoligonucleotide
  source 1..23: mol_type = other DNA
acggactctgatcagagtccgtg

SEQ ID NO: 3522 - DNA, 23 bp, synthetic construct
  misc_feature 1..23: note = Description of Artificial Sequence: Syntheticoligonucleotide
  source 1..23: mol_type = other DNA
ccagactctgatcagagtctggg

SEQ ID NO: 3523 - DNA, 23 bp, synthetic construct
  misc_feature 1..23: note = Description of Artificial Sequence: Syntheticoligonucleotide
  source 1..23: mol_type = other DNA
tcggactctgatcagagtccgag

SEQ ID NO: 3524 - DNA, 23 bp, synthetic construct
  misc_feature 1..23: note = Description of Artificial Sequence: Syntheticoligonucleotide
  source 1..23: mol_type = other DNA
cctgactctgatcagagtcaggg

SEQ ID NO: 3525 - DNA, 23 bp, synthetic construct
  misc_feature 1..23: note = Description of Artificial Sequence: Syntheticoligonucleotide
  source 1..23: mol_type = other DNA
cacgactctgatcagagtcgtgg

SEQ ID NO: 3526 - DNA, 23 bp, synthetic construct
  misc_feature 1..23: note = Description of Artificial Sequence: Syntheticoligonucleotide
  source 1..23: mol_type = other DNA
gccgactctgatcagagtcggct

SEQ ID NO: 3527 - DNA, 23 bp, synthetic construct
  misc_feature 1..23: note = Description of Artificial Sequence: Syntheticoligonucleotide
  source 1..23: mol_type = other DNA
gccgactctgatcagagtcggca

SEQ ID NO: 3528 - DNA, 23 bp, synthetic construct
  misc_feature 1..23: note = Description of Artificial Sequence: Syntheticoligonucleotide
  source 1..23: mol_type = other DNA
cgagactctgatcagagtctcgc

SEQ ID NO: 3529 - DNA, 23 bp, synthetic construct
  misc_feature 1..23: note = Description of Artificial Sequence: Syntheticoligonucleotide
  source 1..23: mol_type = other DNA
cgtgactctgatcagagtcacgc

SEQ ID NO: 3530 - DNA, 23 bp, synthetic construct
  misc_feature 1..23: note = Description of Artificial Sequence: Syntheticoligonucleotide
  source 1..23: mol_type = other DNA
caggactctgatcagagtcctgc

SEQ ID NO: 3531 - DNA, 23 bp, synthetic construct
  misc_feature 1..23: note = Description of Artificial Sequence: Syntheticoligonucleotide
  source 1..23: mol_type = other DNA
ctggactctgatcagagtccagc

SEQ ID NO: 3532 - DNA, 23 bp, synthetic construct
  misc_feature 1..23: note = Description of Artificial Sequence: Syntheticoligonucleotide
  source 1..23: mol_type = other DNA
gaggactctgatcagagtcctcg

SEQ ID NO: 3533 - DNA, 23 bp, synthetic construct
  misc_feature 1..23: note = Description of Artificial Sequence: Syntheticoligonucleotide
  source 1..23: mol_type = other DNA
gtggactctgatcagagtccacg

SEQ ID NO: 3534 - DNA, 23 bp, synthetic construct
  misc_feature 1..23: note = Description of Artificial Sequence: Syntheticoligonucleotide
  source 1..23: mol_type = other DNA
accgactctgatcagagtcggtg

SEQ ID NO: 3535 - DNA, 23 bp, synthetic construct
  misc_feature 1..23: note = Description of Artificial Sequence: Syntheticoligonucleotide
  source 1..23: mol_type = other DNA
tccgactctgatcagagtcggag

SEQ ID NO: 3536 - DNA, 23 bp, synthetic construct
  misc_feature 1..23: note = Description of Artificial Sequence: Syntheticoligonucleotide
  source 1..23: mol_type = other DNA
cgggactctgatcagagtcccgc

SEQ ID NO: 3537 - DNA, 23 bp, synthetic construct
  misc_feature 1..23: note = Description of Artificial Sequence: Syntheticoligonucleotide
  source 1..23: mol_type = other DNA
agggactctgatcagagtccctc

SEQ ID NO: 3538 - DNA, 23 bp, synthetic construct
  misc_feature 1..23: note = Description of Artificial Sequence: Syntheticoligonucleotide
  source 1..23: mol_type = other DNA
tgggactctgatcagagtcccac

SEQ ID NO: 3539 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactctgtacagagtcnnnn

SEQ ID NO: 3540 - DNA, 23 bp, synthetic construct
  misc_feature 1..23: note = Description of Artificial Sequence: Syntheticoligonucleotide
  source 1..23: mol_type = other DNA
gcggactctgtacagagtccgcc

SEQ ID NO: 3541 - DNA, 23 bp, synthetic construct
  misc_feature 1..23: note = Description of Artificial Sequence: Syntheticoligonucleotide
  source 1..23: mol_type = other DNA
gcggactctgtacagagtccgct

SEQ ID NO: 3542 - DNA, 23 bp, synthetic construct
  misc_feature 1..23: note = Description of Artificial Sequence: Syntheticoligonucleotide
  source 1..23: mol_type = other DNA
acggactctgtacagagtccgtc

SEQ ID NO: 3543 - DNA, 23 bp, synthetic construct
  misc_feature 1..23: note = Description of Artificial Sequence: Syntheticoligonucleotide
  source 1..23: mol_type = other DNA
gaggactctgtacagagtcctcc

SEQ ID NO: 3544 - DNA, 23 bp, synthetic construct
  misc_feature 1..23: note = Description of Artificial Sequence: Syntheticoligonucleotide
  source 1..23: mol_type = other DNA
gcagactctgtacagagtctgcc

SEQ ID NO: 3545 - DNA, 23 bp, synthetic construct
  misc_feature 1..23: note = Description of Artificial Sequence: Syntheticoligonucleotide
  source 1..23: mol_type = other DNA
gcggactctgtacagagtccgca

SEQ ID NO: 3546 - DNA, 23 bp, synthetic construct
  misc_feature 1..23: note = Description of Artificial Sequence: Syntheticoligonucleotide
  source 1..23: mol_type = other DNA
tcggactctgtacagagtccgac

SEQ ID NO: 3547 - DNA, 23 bp, synthetic construct
  misc_feature 1..23: note = Description of Artificial Sequence: Syntheticoligonucleotide
  source 1..23: mol_type = other DNA
gtggactctgtacagagtccacc

SEQ ID NO: 3548 - DNA, 23 bp, synthetic construct
  misc_feature 1..23: note = Description of Artificial Sequence: Syntheticoligonucleotide
  source 1..23: mol_type = other DNA
gctgactctgtacagagtcagcc

SEQ ID NO: 3549 - DNA, 23 bp, synthetic construct
  misc_feature 1..23: note = Description of Artificial Sequence: Syntheticoligonucleotide
  source 1..23: mol_type = other DNA
cccgactctgtacagagtcgggc

SEQ ID NO: 3550 - DNA, 23 bp, synthetic construct
  misc_feature 1..23: note = Description of Artificial Sequence: Syntheticoligonucleotide
  source 1..23: mol_type = other DNA
cccgactctgtacagagtcgggt

SEQ ID NO: 3551 - DNA, 23 bp, synthetic construct
  misc_feature 1..23: note = Description of Artificial Sequence: Syntheticoligonucleotide
  source 1..23: mol_type = other DNA
accgactctgtacagagtcggtc

SEQ ID NO: 3552 - DNA, 23 bp, synthetic construct
  misc_feature 1..23: note = Description of Artificial Sequence: Syntheticoligonucleotide
  source 1..23: mol_type = other DNA
cacgactctgtacagagtcgtgc

SEQ ID NO: 3553 - DNA, 23 bp, synthetic construct
  misc_feature 1..23: note = Description of Artificial Sequence: Syntheticoligonucleotide
  source 1..23: mol_type = other DNA
ccagactctgtacagagtctggc

SEQ ID NO: 3554 - DNA, 23 bp, synthetic construct
  misc_feature 1..23: note = Description of Artificial Sequence: Syntheticoligonucleotide
  source 1..23: mol_type = other DNA
cccgactctgtacagagtcggga

SEQ ID NO: 3555 - DNA, 23 bp, synthetic construct
  misc_feature 1..23: note = Description of Artificial Sequence: Syntheticoligonucleotide
  source 1..23: mol_type = other DNA
tccgactctgtacagagtcggac

SEQ ID NO: 3556 - DNA, 23 bp, synthetic construct
  misc_feature 1..23: note = Description of Artificial Sequence: Syntheticoligonucleotide
  source 1..23: mol_type = other DNA
cctgactctgtacagagtcaggc

SEQ ID NO: 3557 - DNA, 23 bp, synthetic construct
  misc_feature 1..23: note = Description of Artificial Sequence: Syntheticoligonucleotide
  source 1..23: mol_type = other DNA
ggcgactctgtacagagtcgccc

SEQ ID NO: 3558 - DNA, 23 bp, synthetic construct
  misc_feature 1..23: note = Description of Artificial Sequence: Syntheticoligonucleotide
  source 1..23: mol_type = other DNA
ggcgactctgtacagagtcgcct

SEQ ID NO: 3559 - DNA, 23 bp, synthetic construct
  misc_feature 1..23: note = Description of Artificial Sequence: Syntheticoligonucleotide
  source 1..23: mol_type = other DNA
agcgactctgtacagagtcgctc

SEQ ID NO: 3560 - DNA, 23 bp, synthetic construct
  misc_feature 1..23: note = Description of Artificial Sequence: Syntheticoligonucleotide
  source 1..23: mol_type = other DNA
gacgactctgtacagagtcgtcc

SEQ ID NO: 3561 - DNA, 23 bp, synthetic construct
  misc_feature 1..23: note = Description of Artificial Sequence: Syntheticoligonucleotide
  source 1..23: mol_type = other DNA
ggagactctgtacagagtctccc

SEQ ID NO: 3562 - DNA, 23 bp, synthetic construct
  misc_feature 1..23: note = Description of Artificial Sequence: Syntheticoligonucleotide
  source 1..23: mol_type = other DNA
ggcgactctgtacagagtcgcca

SEQ ID NO: 3563 - DNA, 23 bp, synthetic construct
  misc_feature 1..23: note = Description of Artificial Sequence: Syntheticoligonucleotide
  source 1..23: mol_type = other DNA
tgcgactctgtacagagtcgcac

SEQ ID NO: 3564 - DNA, 23 bp, synthetic construct
  misc_feature 1..23: note = Description of Artificial Sequence: Syntheticoligonucleotide
  source 1..23: mol_type = other DNA
ggtgactctgtacagagtcaccc

SEQ ID NO: 3565 - DNA, 23 bp, synthetic construct
  misc_feature 1..23: note = Description of Artificial Sequence: Syntheticoligonucleotide
  source 1..23: mol_type = other DNA
cgggactctgtacagagtcccgt

SEQ ID NO: 3566 - DNA, 23 bp, synthetic construct
  misc_feature 1..23: note = Description of Artificial Sequence: Syntheticoligonucleotide
  source 1..23: mol_type = other DNA
agggactctgtacagagtccctg

SEQ ID NO: 3567 - DNA, 23 bp, synthetic construct
  misc_feature 1..23: note = Description of Artificial Sequence: Syntheticoligonucleotide
  source 1..23: mol_type = other DNA
caggactctgtacagagtcctgg

SEQ ID NO: 3568 - DNA, 23 bp, synthetic construct
  misc_feature 1..23: note = Description of Artificial Sequence: Syntheticoligonucleotide
  source 1..23: mol_type = other DNA
cgagactctgtacagagtctcgg

SEQ ID NO: 3569 - DNA, 23 bp, synthetic construct
  misc_feature 1..23: note = Description of Artificial Sequence: Syntheticoligonucleotide
  source 1..23: mol_type = other DNA
cgggactctgtacagagtcccga

SEQ ID NO: 3570 - DNA, 23 bp, synthetic construct
  misc_feature 1..23: note = Description of Artificial Sequence: Syntheticoligonucleotide
  source 1..23: mol_type = other DNA
tgggactctgtacagagtcccag

SEQ ID NO: 3571 - DNA, 23 bp, synthetic construct
  misc_feature 1..23: note = Description of Artificial Sequence: Syntheticoligonucleotide
  source 1..23: mol_type = other DNA
ctggactctgtacagagtccagg

SEQ ID NO: 3572 - DNA, 23 bp, synthetic construct
  misc_feature 1..23: note = Description of Artificial Sequence: Syntheticoligonucleotide
  source 1..23: mol_type = other DNA
cgtgactctgtacagagtcacgg

SEQ ID NO: 3573 - DNA, 23 bp, synthetic construct
  misc_feature 1..23: note = Description of Artificial Sequence: Syntheticoligonucleotide
  source 1..23: mol_type = other DNA
ggcgactctgtacagagtcgccg

SEQ ID NO: 3574 - DNA, 23 bp, synthetic construct
  misc_feature 1..23: note = Description of Artificial Sequence: Syntheticoligonucleotide
  source 1..23: mol_type = other DNA
agcgactctgtacagagtcgctg

SEQ ID NO: 3575 - DNA, 23 bp, synthetic construct
  misc_feature 1..23: note = Description of Artificial Sequence: Syntheticoligonucleotide
  source 1..23: mol_type = other DNA
gacgactctgtacagagtcgtcg

SEQ ID NO: 3576 - DNA, 23 bp, synthetic construct
  misc_feature 1..23: note = Description of Artificial Sequence: Syntheticoligonucleotide
  source 1..23: mol_type = other DNA
ggagactctgtacagagtctccg

SEQ ID NO: 3577 - DNA, 23 bp, synthetic construct
  misc_feature 1..23: note = Description of Artificial Sequence: Syntheticoligonucleotide
  source 1..23: mol_type = other DNA
tgcgactctgtacagagtcgcag

SEQ ID NO: 3578 - DNA, 23 bp, synthetic construct
  misc_feature 1..23: note = Description of Artificial Sequence: Syntheticoligonucleotide
  source 1..23: mol_type = other DNA
ggtgactctgtacagagtcaccg

SEQ ID NO: 3579 - DNA, 23 bp, synthetic construct
  misc_feature 1..23: note = Description of Artificial Sequence: Syntheticoligonucleotide
  source 1..23: mol_type = other DNA
acggactctgtacagagtccgtg

SEQ ID NO: 3580 - DNA, 23 bp, synthetic construct
  misc_feature 1..23: note = Description of Artificial Sequence: Syntheticoligonucleotide
  source 1..23: mol_type = other DNA
ccagactctgtacagagtctggg

SEQ ID NO: 3581 - DNA, 23 bp, synthetic construct
  misc_feature 1..23: note = Description of Artificial Sequence: Syntheticoligonucleotide
  source 1..23: mol_type = other DNA
tcggactctgtacagagtccgag

SEQ ID NO: 3582 - DNA, 23 bp, synthetic construct
  misc_feature 1..23: note = Description of Artificial Sequence: Syntheticoligonucleotide
  source 1..23: mol_type = other DNA
cctgactctgtacagagtcaggg

SEQ ID NO: 3583 - DNA, 23 bp, synthetic construct
  misc_feature 1..23: note = Description of Artificial Sequence: Syntheticoligonucleotide
  source 1..23: mol_type = other DNA
cacgactctgtacagagtcgtgg

SEQ ID NO: 3584 - DNA, 23 bp, synthetic construct
  misc_feature 1..23: note = Description of Artificial Sequence: Syntheticoligonucleotide
  source 1..23: mol_type = other DNA
gccgactctgtacagagtcggct

SEQ ID NO: 3585 - DNA, 23 bp, synthetic construct
  misc_feature 1..23: note = Description of Artificial Sequence: Syntheticoligonucleotide
  source 1..23: mol_type = other DNA
gccgactctgtacagagtcggca

SEQ ID NO: 3586 - DNA, 23 bp, synthetic construct
  misc_feature 1..23: note = Description of Artificial Sequence: Syntheticoligonucleotide
  source 1..23: mol_type = other DNA
cgagactctgtacagagtctcgc

SEQ ID NO: 3587 - DNA, 23 bp, synthetic construct
  misc_feature 1..23: note = Description of Artificial Sequence: Syntheticoligonucleotide
  source 1..23: mol_type = other DNA
cgtgactctgtacagagtcacgc

SEQ ID NO: 3588 - DNA, 23 bp, synthetic construct
  misc_feature 1..23: note = Description of Artificial Sequence: Syntheticoligonucleotide
  source 1..23: mol_type = other DNA
caggactctgtacagagtcctgc

SEQ ID NO: 3589 - DNA, 23 bp, synthetic construct
  misc_feature 1..23: note = Description of Artificial Sequence: Syntheticoligonucleotide
  source 1..23: mol_type = other DNA
ctggactctgtacagagtccagc

SEQ ID NO: 3590 - DNA, 23 bp, synthetic construct
  misc_feature 1..23: note = Description of Artificial Sequence: Syntheticoligonucleotide
  source 1..23: mol_type = other DNA
gaggactctgtacagagtcctcg

SEQ ID NO: 3591 - DNA, 23 bp, synthetic construct
  misc_feature 1..23: note = Description of Artificial Sequence: Syntheticoligonucleotide
  source 1..23: mol_type = other DNA
gtggactctgtacagagtccacg

SEQ ID NO: 3592 - DNA, 23 bp, synthetic construct
  misc_feature 1..23: note = Description of Artificial Sequence: Syntheticoligonucleotide
  source 1..23: mol_type = other DNA
accgactctgtacagagtcggtg

SEQ ID NO: 3593 - DNA, 23 bp, synthetic construct
  misc_feature 1..23: note = Description of Artificial Sequence: Syntheticoligonucleotide
  source 1..23: mol_type = other DNA
tccgactctgtacagagtcggag

SEQ ID NO: 3594 - DNA, 23 bp, synthetic construct
  misc_feature 1..23: note = Description of Artificial Sequence: Syntheticoligonucleotide
  source 1..23: mol_type = other DNA
cgggactctgtacagagtcccgc

SEQ ID NO: 3595 - DNA, 23 bp, synthetic construct
  misc_feature 1..23: note = Description of Artificial Sequence: Syntheticoligonucleotide
  source 1..23: mol_type = other DNA
agggactctgtacagagtccctc

SEQ ID NO: 3596 - DNA, 23 bp, synthetic construct
  misc_feature 1..23: note = Description of Artificial Sequence: Syntheticoligonucleotide
  source 1..23: mol_type = other DNA
tgggactctgtacagagtcccac

SEQ ID NO: 3597 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactctggccagagtcnnnn

SEQ ID NO: 3598 - DNA, 23 bp, synthetic construct
  misc_feature 1..23: note = Description of Artificial Sequence: Syntheticoligonucleotide
  source 1..23: mol_type = other DNA
gcggactctggccagagtccgcc

SEQ ID NO: 3599 - DNA, 23 bp, synthetic construct
  misc_feature 1..23: note = Description of Artificial Sequence: Syntheticoligonucleotide
  source 1..23: mol_type = other DNA
gcggactctggccagagtccgct

SEQ ID NO: 3600 - DNA, 23 bp, synthetic construct
  misc_feature 1..23: note = Description of Artificial Sequence: Syntheticoligonucleotide
  source 1..23: mol_type = other DNA
acggactctggccagagtccgtc

SEQ ID NO: 3601 - DNA, 23 bp, synthetic construct
  misc_feature 1..23: note = Description of Artificial Sequence: Syntheticoligonucleotide
  source 1..23: mol_type = other DNA
gaggactctggccagagtcctcc

SEQ ID NO: 3602 - DNA, 23 bp, synthetic construct
  misc_feature 1..23: note = Description of Artificial Sequence: Syntheticoligonucleotide
  source 1..23: mol_type = other DNA
gcagactctggccagagtctgcc

SEQ ID NO: 3603 - DNA, 23 bp, synthetic construct
  misc_feature 1..23: note = Description of Artificial Sequence: Syntheticoligonucleotide
  source 1..23: mol_type = other DNA
gcggactctggccagagtccgca

SEQ ID NO: 3604 - DNA, 23 bp, synthetic construct
  misc_feature 1..23: note = Description of Artificial Sequence: Syntheticoligonucleotide
  source 1..23: mol_type = other DNA
tcggactctggccagagtccgac

SEQ ID NO: 3605 - DNA, 23 bp, synthetic construct
  misc_feature 1..23: note = Description of Artificial Sequence: Syntheticoligonucleotide
  source 1..23: mol_type = other DNA
gtggactctggccagagtccacc

SEQ ID NO: 3606 - DNA, 23 bp, synthetic construct
  misc_feature 1..23: note = Description of Artificial Sequence: Syntheticoligonucleotide
  source 1..23: mol_type = other DNA
gctgactctggccagagtcagcc

SEQ ID NO: 3607 - DNA, 23 bp, synthetic construct
  misc_feature 1..23: note = Description of Artificial Sequence: Syntheticoligonucleotide
  source 1..23: mol_type = other DNA
cccgactctggccagagtcgggc

SEQ ID NO: 3608 - DNA, 23 bp, synthetic construct
  misc_feature 1..23: note = Description of Artificial Sequence: Syntheticoligonucleotide
  source 1..23: mol_type = other DNA
cccgactctggccagagtcgggt

SEQ ID NO: 3609 - DNA, 23 bp, synthetic construct
  misc_feature 1..23: note = Description of Artificial Sequence: Syntheticoligonucleotide
  source 1..23: mol_type = other DNA
accgactctggccagagtcggtc

SEQ ID NO: 3610 - DNA, 23 bp, synthetic construct
  misc_feature 1..23: note = Description of Artificial Sequence: Syntheticoligonucleotide
  source 1..23: mol_type = other DNA
cacgactctggccagagtcgtgc

SEQ ID NO: 3611 - DNA, 23 bp, synthetic construct
  misc_feature 1..23: note = Description of Artificial Sequence: Syntheticoligonucleotide
  source 1..23: mol_type = other DNA
ccagactctggccagagtctggc

SEQ ID NO: 3612 - DNA, 23 bp, synthetic construct
  misc_feature 1..23: note = Description of Artificial Sequence: Syntheticoligonucleotide
  source 1..23: mol_type = other DNA
cccgactctggccagagtcggga

SEQ ID NO: 3613 - DNA, 23 bp, synthetic construct
  misc_feature 1..23: note = Description of Artificial Sequence: Syntheticoligonucleotide
  source 1..23: mol_type = other DNA
tccgactctggccagagtcggac

SEQ ID NO: 3614 - DNA, 23 bp, synthetic construct
  misc_feature 1..23: note = Description of Artificial Sequence: Syntheticoligonucleotide
  source 1..23: mol_type = other DNA
cctgactctggccagagtcaggc

SEQ ID NO: 3615 - DNA, 23 bp, synthetic construct
  misc_feature 1..23: note = Description of Artificial Sequence: Syntheticoligonucleotide
  source 1..23: mol_type = other DNA
ggcgactctggccagagtcgccc

SEQ ID NO: 3616 - DNA, 23 bp, synthetic construct
  misc_feature 1..23: note = Description of Artificial Sequence: Syntheticoligonucleotide
  source 1..23: mol_type = other DNA
ggcgactctggccagagtcgcct

SEQ ID NO: 3617 - DNA, 23 bp, synthetic construct
  misc_feature 1..23: note = Description of Artificial Sequence: Syntheticoligonucleotide
  source 1..23: mol_type = other DNA
agcgactctggccagagtcgctc

SEQ ID NO: 3618 - DNA, 23 bp, synthetic construct
  misc_feature 1..23: note = Description of Artificial Sequence: Syntheticoligonucleotide
  source 1..23: mol_type = other DNA
gacgactctggccagagtcgtcc

SEQ ID NO: 3619 - DNA, 23 bp, synthetic construct
  misc_feature 1..23: note = Description of Artificial Sequence: Syntheticoligonucleotide
  source 1..23: mol_type = other DNA
ggagactctggccagagtctccc

SEQ ID NO: 3620 - DNA, 23 bp, synthetic construct
  misc_feature 1..23: note = Description of Artificial Sequence: Syntheticoligonucleotide
  source 1..23: mol_type = other DNA
ggcgactctggccagagtcgcca

SEQ ID NO: 3621 - DNA, 23 bp, synthetic construct
  misc_feature 1..23: note = Description of Artificial Sequence: Syntheticoligonucleotide
  source 1..23: mol_type = other DNA
tgcgactctggccagagtcgcac

SEQ ID NO: 3622 - DNA, 23 bp, synthetic construct
  misc_feature 1..23: note = Description of Artificial Sequence: Syntheticoligonucleotide
  source 1..23: mol_type = other DNA
ggtgactctggccagagtcaccc

SEQ ID NO: 3623 - DNA, 23 bp, synthetic construct
  misc_feature 1..23: note = Description of Artificial Sequence: Syntheticoligonucleotide
  source 1..23: mol_type = other DNA
cgggactctggccagagtcccgt

SEQ ID NO: 3624 - DNA, 23 bp, synthetic construct
  misc_feature 1..23: note = Description of Artificial Sequence: Syntheticoligonucleotide
  source 1..23: mol_type = other DNA
agggactctggccagagtccctg

SEQ ID NO: 3625 - DNA, 23 bp, synthetic construct
  misc_feature 1..23: note = Description of Artificial Sequence: Syntheticoligonucleotide
  source 1..23: mol_type = other DNA
caggactctggccagagtcctgg

SEQ ID NO: 3626 - DNA, 23 bp, synthetic construct
  misc_feature 1..23: note = Description of Artificial Sequence: Syntheticoligonucleotide
  source 1..23: mol_type = other DNA
cgagactctggccagagtctcgg

SEQ ID NO: 3627 - DNA, 23 bp, synthetic construct
  misc_feature 1..23: note = Description of Artificial Sequence: Syntheticoligonucleotide
  source 1..23: mol_type = other DNA
cgggactctggccagagtcccga

SEQ ID NO: 3628 - DNA, 23 bp, synthetic construct
  misc_feature 1..23: note = Description of Artificial Sequence: Syntheticoligonucleotide
  source 1..23: mol_type = other DNA
tgggactctggccagagtcccag

SEQ ID NO: 3629 - DNA, 23 bp, synthetic construct
  misc_feature 1..23: note = Description of Artificial Sequence: Syntheticoligonucleotide
  source 1..23: mol_type = other DNA
ctggactctggccagagtccagg

SEQ ID NO: 3630 - DNA, 23 bp, synthetic construct
  misc_feature 1..23: note = Description of Artificial Sequence: Syntheticoligonucleotide
  source 1..23: mol_type = other DNA
cgtgactctggccagagtcacgg

SEQ ID NO: 3631 - DNA, 23 bp, synthetic construct
  misc_feature 1..23: note = Description of Artificial Sequence: Syntheticoligonucleotide
  source 1..23: mol_type = other DNA
ggcgactctggccagagtcgccg

SEQ ID NO: 3632 - DNA, 23 bp, synthetic construct
  misc_feature 1..23: note = Description of Artificial Sequence: Syntheticoligonucleotide
  source 1..23: mol_type = other DNA
agcgactctggccagagtcgctg

SEQ ID NO: 3633 - DNA, 23 bp, synthetic construct
  misc_feature 1..23: note = Description of Artificial Sequence: Syntheticoligonucleotide
  source 1..23: mol_type = other DNA
gacgactctggccagagtcgtcg

SEQ ID NO: 3634 - DNA, 23 bp, synthetic construct
  misc_feature 1..23: note = Description of Artificial Sequence: Syntheticoligonucleotide
  source 1..23: mol_type = other DNA
ggagactctggccagagtctccg

SEQ ID NO: 3635 - DNA, 23 bp, synthetic construct
  misc_feature 1..23: note = Description of Artificial Sequence: Syntheticoligonucleotide
  source 1..23: mol_type = other DNA
tgcgactctggccagagtcgcag

SEQ ID NO: 3636 - DNA, 23 bp, synthetic construct
  misc_feature 1..23: note = Description of Artificial Sequence: Syntheticoligonucleotide
  source 1..23: mol_type = other DNA
ggtgactctggccagagtcaccg

SEQ ID NO: 3637 - DNA, 23 bp, synthetic construct
  misc_feature 1..23: note = Description of Artificial Sequence: Syntheticoligonucleotide
  source 1..23: mol_type = other DNA
acggactctggccagagtccgtg

SEQ ID NO: 3638 - DNA, 23 bp, synthetic construct
  misc_feature 1..23: note = Description of Artificial Sequence: Syntheticoligonucleotide
  source 1..23: mol_type = other DNA
ccagactctggccagagtctggg

SEQ ID NO: 3639 - DNA, 23 bp, synthetic construct
  misc_feature 1..23: note = Description of Artificial Sequence: Syntheticoligonucleotide
  source 1..23: mol_type = other DNA
tcggactctggccagagtccgag

SEQ ID NO: 3640 - DNA, 23 bp, synthetic construct
  misc_feature 1..23: note = Description of Artificial Sequence: Syntheticoligonucleotide
  source 1..23: mol_type = other DNA
cctgactctggccagagtcaggg

SEQ ID NO: 3641 - DNA, 23 bp, synthetic construct
  misc_feature 1..23: note = Description of Artificial Sequence: Syntheticoligonucleotide
  source 1..23: mol_type = other DNA
cacgactctggccagagtcgtgg

SEQ ID NO: 3642 - DNA, 23 bp, synthetic construct
  misc_feature 1..23: note = Description of Artificial Sequence: Syntheticoligonucleotide
  source 1..23: mol_type = other DNA
gccgactctggccagagtcggct

SEQ ID NO: 3643 - DNA, 23 bp, synthetic construct
  misc_feature 1..23: note = Description of Artificial Sequence: Syntheticoligonucleotide
  source 1..23: mol_type = other DNA
gccgactctggccagagtcggca

SEQ ID NO: 3644 - DNA, 23 bp, synthetic construct
  misc_feature 1..23: note = Description of Artificial Sequence: Syntheticoligonucleotide
  source 1..23: mol_type = other DNA
cgagactctggccagagtctcgc

SEQ ID NO: 3645 - DNA, 23 bp, synthetic construct
  misc_feature 1..23: note = Description of Artificial Sequence: Syntheticoligonucleotide
  source 1..23: mol_type = other DNA
cgtgactctggccagagtcacgc

SEQ ID NO: 3646 - DNA, 23 bp, synthetic construct
  misc_feature 1..23: note = Description of Artificial Sequence: Syntheticoligonucleotide
  source 1..23: mol_type = other DNA
caggactctggccagagtcctgc

SEQ ID NO: 3647 - DNA, 23 bp, synthetic construct
  misc_feature 1..23: note = Description of Artificial Sequence: Syntheticoligonucleotide
  source 1..23: mol_type = other DNA
ctggactctggccagagtccagc

SEQ ID NO: 3648 - DNA, 23 bp, synthetic construct
  misc_feature 1..23: note = Description of Artificial Sequence: Syntheticoligonucleotide
  source 1..23: mol_type = other DNA
gaggactctggccagagtcctcg

SEQ ID NO: 3649 - DNA, 23 bp, synthetic construct
  misc_feature 1..23: note = Description of Artificial Sequence: Syntheticoligonucleotide
  source 1..23: mol_type = other DNA
gtggactctggccagagtccacg

SEQ ID NO: 3650 - DNA, 23 bp, synthetic construct
  misc_feature 1..23: note = Description of Artificial Sequence: Syntheticoligonucleotide
  source 1..23: mol_type = other DNA
accgactctggccagagtcggtg

SEQ ID NO: 3651 - DNA, 23 bp, synthetic construct
  misc_feature 1..23: note = Description of Artificial Sequence: Syntheticoligonucleotide
  source 1..23: mol_type = other DNA
tccgactctggccagagtcggag

SEQ ID NO: 3652 - DNA, 23 bp, synthetic construct
  misc_feature 1..23: note = Description of Artificial Sequence: Syntheticoligonucleotide
  source 1..23: mol_type = other DNA
cgggactctggccagagtcccgc

SEQ ID NO: 3653 - DNA, 23 bp, synthetic construct
  misc_feature 1..23: note = Description of Artificial Sequence: Syntheticoligonucleotide
  source 1..23: mol_type = other DNA
agggactctggccagagtccctc

SEQ ID NO: 3654 - DNA, 23 bp, synthetic construct
  misc_feature 1..23: note = Description of Artificial Sequence: Syntheticoligonucleotide
  source 1..23: mol_type = other DNA
tgggactctggccagagtcccac

SEQ ID NO: 3655 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactctgcgcagagtcnnnn

SEQ ID NO: 3656 - DNA, 23 bp, synthetic construct
  misc_feature 1..23: note = Description of Artificial Sequence: Syntheticoligonucleotide
  source 1..23: mol_type = other DNA
gcggactctgcgcagagtccgcc

SEQ ID NO: 3657 - DNA, 23 bp, synthetic construct
  misc_feature 1..23: note = Description of Artificial Sequence: Syntheticoligonucleotide
  source 1..23: mol_type = other DNA
gcggactctgcgcagagtccgct

SEQ ID NO: 3658 - DNA, 23 bp, synthetic construct
  misc_feature 1..23: note = Description of Artificial Sequence: Syntheticoligonucleotide
  source 1..23: mol_type = other DNA
acggactctgcgcagagtccgtc

SEQ ID NO: 3659 - DNA, 23 bp, synthetic construct
  misc_feature 1..23: note = Description of Artificial Sequence: Syntheticoligonucleotide
  source 1..23: mol_type = other DNA
gaggactctgcgcagagtcctcc

SEQ ID NO: 3660 - DNA, 23 bp, synthetic construct
  misc_feature 1..23: note = Description of Artificial Sequence: Syntheticoligonucleotide
  source 1..23: mol_type = other DNA
gcagactctgcgcagagtctgcc

SEQ ID NO: 3661 - DNA, 23 bp, synthetic construct
  misc_feature 1..23: note = Description of Artificial Sequence: Syntheticoligonucleotide
  source 1..23: mol_type = other DNA
gcggactctgcgcagagtccgca

SEQ ID NO: 3662 - DNA, 23 bp, synthetic construct
  misc_feature 1..23: note = Description of Artificial Sequence: Syntheticoligonucleotide
  source 1..23: mol_type = other DNA
tcggactctgcgcagagtccgac

SEQ ID NO: 3663 - DNA, 23 bp, synthetic construct
  misc_feature 1..23: note = Description of Artificial Sequence: Syntheticoligonucleotide
  source 1..23: mol_type = other DNA
gtggactctgcgcagagtccacc

SEQ ID NO: 3664 - DNA, 23 bp, synthetic construct
  misc_feature 1..23: note = Description of Artificial Sequence: Syntheticoligonucleotide
  source 1..23: mol_type = other DNA
gctgactctgcgcagagtcagcc

SEQ ID NO: 3665 - DNA, 23 bp, synthetic construct
  misc_feature 1..23: note = Description of Artificial Sequence: Syntheticoligonucleotide
  source 1..23: mol_type = other DNA
cccgactctgcgcagagtcgggc

SEQ ID NO: 3666 - DNA, 23 bp, synthetic construct
  misc_feature 1..23: note = Description of Artificial Sequence: Syntheticoligonucleotide
  source 1..23: mol_type = other DNA
cccgactctgcgcagagtcgggt

SEQ ID NO: 3667 - DNA, 23 bp, synthetic construct
  misc_feature 1..23: note = Description of Artificial Sequence: Syntheticoligonucleotide
  source 1..23: mol_type = other DNA
accgactctgcgcagagtcggtc

SEQ ID NO: 3668 - DNA, 23 bp, synthetic construct
  misc_feature 1..23: note = Description of Artificial Sequence: Syntheticoligonucleotide
  source 1..23: mol_type = other DNA
cacgactctgcgcagagtcgtgc

SEQ ID NO: 3669 - DNA, 23 bp, synthetic construct
  misc_feature 1..23: note = Description of Artificial Sequence: Syntheticoligonucleotide
  source 1..23: mol_type = other DNA
ccagactctgcgcagagtctggc

SEQ ID NO: 3670 - DNA, 23 bp, synthetic construct
  misc_feature 1..23: note = Description of Artificial Sequence: Syntheticoligonucleotide
  source 1..23: mol_type = other DNA
cccgactctgcgcagagtcggga

SEQ ID NO: 3671 - DNA, 23 bp, synthetic construct
  misc_feature 1..23: note = Description of Artificial Sequence: Syntheticoligonucleotide
  source 1..23: mol_type = other DNA
tccgactctgcgcagagtcggac

SEQ ID NO: 3672 - DNA, 23 bp, synthetic construct
  misc_feature 1..23: note = Description of Artificial Sequence: Syntheticoligonucleotide
  source 1..23: mol_type = other DNA
cctgactctgcgcagagtcaggc

SEQ ID NO: 3673 - DNA, 23 bp, synthetic construct
  misc_feature 1..23: note = Description of Artificial Sequence: Syntheticoligonucleotide
  source 1..23: mol_type = other DNA
ggcgactctgcgcagagtcgccc

SEQ ID NO: 3674 - DNA, 23 bp, synthetic construct
  misc_feature 1..23: note = Description of Artificial Sequence: Syntheticoligonucleotide
  source 1..23: mol_type = other DNA
ggcgactctgcgcagagtcgcct

SEQ ID NO: 3675 - DNA, 23 bp, synthetic construct
  misc_feature 1..23: note = Description of Artificial Sequence: Syntheticoligonucleotide
  source 1..23: mol_type = other DNA
agcgactctgcgcagagtcgctc

SEQ ID NO: 3676 - DNA, 23 bp, synthetic construct
  misc_feature 1..23: note = Description of Artificial Sequence: Syntheticoligonucleotide
  source 1..23: mol_type = other DNA
gacgactctgcgcagagtcgtcc

SEQ ID NO: 3677 - DNA, 23 bp, synthetic construct
  misc_feature 1..23: note = Description of Artificial Sequence: Syntheticoligonucleotide
  source 1..23: mol_type = other DNA
ggagactctgcgcagagtctccc

SEQ ID NO: 3678 - DNA, 23 bp, synthetic construct
  misc_feature 1..23: note = Description of Artificial Sequence: Syntheticoligonucleotide
  source 1..23: mol_type = other DNA
ggcgactctgcgcagagtcgcca

SEQ ID NO: 3679 - DNA, 23 bp, synthetic construct
  misc_feature 1..23: note = Description of Artificial Sequence: Syntheticoligonucleotide
  source 1..23: mol_type = other DNA
tgcgactctgcgcagagtcgcac

SEQ ID NO: 3680 - DNA, 23 bp, synthetic construct
  misc_feature 1..23: note = Description of Artificial Sequence: Syntheticoligonucleotide
  source 1..23: mol_type = other DNA
ggtgactctgcgcagagtcaccc

SEQ ID NO: 3681 - DNA, 23 bp, synthetic construct
  misc_feature 1..23: note = Description of Artificial Sequence: Syntheticoligonucleotide
  source 1..23: mol_type = other DNA
cgggactctgcgcagagtcccgt

SEQ ID NO: 3682 - DNA, 23 bp, synthetic construct
  misc_feature 1..23: note = Description of Artificial Sequence: Syntheticoligonucleotide
  source 1..23: mol_type = other DNA
agggactctgcgcagagtccctg

SEQ ID NO: 3683 - DNA, 23 bp, synthetic construct
  misc_feature 1..23: note = Description of Artificial Sequence: Syntheticoligonucleotide
  source 1..23: mol_type = other DNA
caggactctgcgcagagtcctgg

SEQ ID NO: 3684 - DNA, 23 bp, synthetic construct
  misc_feature 1..23: note = Description of Artificial Sequence: Syntheticoligonucleotide
  source 1..23: mol_type = other DNA
cgagactctgcgcagagtctcgg

SEQ ID NO: 3685 - DNA, 23 bp, synthetic construct
  misc_feature 1..23: note = Description of Artificial Sequence: Syntheticoligonucleotide
  source 1..23: mol_type = other DNA
cgggactctgcgcagagtcccga

SEQ ID NO: 3686 - DNA, 23 bp, synthetic construct
  misc_feature 1..23: note = Description of Artificial Sequence: Syntheticoligonucleotide
  source 1..23: mol_type = other DNA
tgggactctgcgcagagtcccag

SEQ ID NO: 3687 - DNA, 23 bp, synthetic construct
  misc_feature 1..23: note = Description of Artificial Sequence: Syntheticoligonucleotide
  source 1..23: mol_type = other DNA
ctggactctgcgcagagtccagg

SEQ ID NO: 3688 - DNA, 23 bp, synthetic construct
  misc_feature 1..23: note = Description of Artificial Sequence: Syntheticoligonucleotide
  source 1..23: mol_type = other DNA
cgtgactctgcgcagagtcacgg

SEQ ID NO: 3689 - DNA, 23 bp, synthetic construct
  misc_feature 1..23: note = Description of Artificial Sequence: Syntheticoligonucleotide
  source 1..23: mol_type = other DNA
ggcgactctgcgcagagtcgccg

SEQ ID NO: 3690 - DNA, 23 bp, synthetic construct
  misc_feature 1..23: note = Description of Artificial Sequence: Syntheticoligonucleotide
  source 1..23: mol_type = other DNA
agcgactctgcgcagagtcgctg

SEQ ID NO: 3691 - DNA, 23 bp, synthetic construct
  misc_feature 1..23: note = Description of Artificial Sequence: Syntheticoligonucleotide
  source 1..23: mol_type = other DNA
gacgactctgcgcagagtcgtcg

SEQ ID NO: 3692 - DNA, 23 bp, synthetic construct
  misc_feature 1..23: note = Description of Artificial Sequence: Syntheticoligonucleotide
  source 1..23: mol_type = other DNA
ggagactctgcgcagagtctccg

SEQ ID NO: 3693 - DNA, 23 bp, synthetic construct
  misc_feature 1..23: note = Description of Artificial Sequence: Syntheticoligonucleotide
  source 1..23: mol_type = other DNA
tgcgactctgcgcagagtcgcag

SEQ ID NO: 3694 - DNA, 23 bp, synthetic construct
  misc_feature 1..23: note = Description of Artificial Sequence: Syntheticoligonucleotide
  source 1..23: mol_type = other DNA
ggtgactctgcgcagagtcaccg

SEQ ID NO: 3695 - DNA, 23 bp, synthetic construct
  misc_feature 1..23: note = Description of Artificial Sequence: Syntheticoligonucleotide
  source 1..23: mol_type = other DNA
acggactctgcgcagagtccgtg

SEQ ID NO: 3696 - DNA, 23 bp, synthetic construct
  misc_feature 1..23: note = Description of Artificial Sequence: Syntheticoligonucleotide
  source 1..23: mol_type = other DNA
ccagactctgcgcagagtctggg

SEQ ID NO: 3697 - DNA, 23 bp, synthetic construct
  misc_feature 1..23: note = Description of Artificial Sequence: Syntheticoligonucleotide
  source 1..23: mol_type = other DNA
tcggactctgcgcagagtccgag

SEQ ID NO: 3698 - DNA, 23 bp, synthetic construct
  misc_feature 1..23: note = Description of Artificial Sequence: Syntheticoligonucleotide
  source 1..23: mol_type = other DNA
cctgactctgcgcagagtcaggg

SEQ ID NO: 3699 - DNA, 23 bp, synthetic construct
  misc_feature 1..23: note = Description of Artificial Sequence: Syntheticoligonucleotide
  source 1..23: mol_type = other DNA
cacgactctgcgcagagtcgtgg

SEQ ID NO: 3700 - DNA, 23 bp, synthetic construct
  misc_feature 1..23: note = Description of Artificial Sequence: Syntheticoligonucleotide
  source 1..23: mol_type = other DNA
gccgactctgcgcagagtcggct

SEQ ID NO: 3701 - DNA, 23 bp, synthetic construct
  misc_feature 1..23: note = Description of Artificial Sequence: Syntheticoligonucleotide
  source 1..23: mol_type = other DNA
gccgactctgcgcagagtcggca

SEQ ID NO: 3702 - DNA, 23 bp, synthetic construct
  misc_feature 1..23: note = Description of Artificial Sequence: Syntheticoligonucleotide
  source 1..23: mol_type = other DNA
cgagactctgcgcagagtctcgc

SEQ ID NO: 3703 - DNA, 23 bp, synthetic construct
  misc_feature 1..23: note = Description of Artificial Sequence: Syntheticoligonucleotide
  source 1..23: mol_type = other DNA
cgtgactctgcgcagagtcacgc

SEQ ID NO: 3704 - DNA, 23 bp, synthetic construct
  misc_feature 1..23: note = Description of Artificial Sequence: Syntheticoligonucleotide
  source 1..23: mol_type = other DNA
caggactctgcgcagagtcctgc

SEQ ID NO: 3705 - DNA, 23 bp, synthetic construct
  misc_feature 1..23: note = Description of Artificial Sequence: Syntheticoligonucleotide
  source 1..23: mol_type = other DNA
ctggactctgcgcagagtccagc

SEQ ID NO: 3706 - DNA, 23 bp, synthetic construct
  misc_feature 1..23: note = Description of Artificial Sequence: Syntheticoligonucleotide
  source 1..23: mol_type = other DNA
gaggactctgcgcagagtcctcg

SEQ ID NO: 3707 - DNA, 23 bp, synthetic construct
  misc_feature 1..23: note = Description of Artificial Sequence: Syntheticoligonucleotide
  source 1..23: mol_type = other DNA
gtggactctgcgcagagtccacg

SEQ ID NO: 3708 - DNA, 23 bp, synthetic construct
  misc_feature 1..23: note = Description of Artificial Sequence: Syntheticoligonucleotide
  source 1..23: mol_type = other DNA
accgactctgcgcagagtcggtg

SEQ ID NO: 3709 - DNA, 23 bp, synthetic construct
  misc_feature 1..23: note = Description of Artificial Sequence: Syntheticoligonucleotide
  source 1..23: mol_type = other DNA
tccgactctgcgcagagtcggag

SEQ ID NO: 3710 - DNA, 23 bp, synthetic construct
  misc_feature 1..23: note = Description of Artificial Sequence: Syntheticoligonucleotide
  source 1..23: mol_type = other DNA
cgggactctgcgcagagtcccgc

SEQ ID NO: 3711 - DNA, 23 bp, synthetic construct
  misc_feature 1..23: note = Description of Artificial Sequence: Syntheticoligonucleotide
  source 1..23: mol_type = other DNA
agggactctgcgcagagtccctc

SEQ ID NO: 3712 - DNA, 23 bp, synthetic construct
  misc_feature 1..23: note = Description of Artificial Sequence: Syntheticoligonucleotide
  source 1..23: mol_type = other DNA
tgggactctgcgcagagtcccac

SEQ ID NO: 3713 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcgcatgcgagtcnnnn

SEQ ID NO: 3714 - DNA, 23 bp, synthetic construct
  misc_feature 1..23: note = Description of Artificial Sequence: Syntheticoligonucleotide
  source 1..23: mol_type = other DNA
gcggactcgcatgcgagtccgcc

SEQ ID NO: 3715 - DNA, 23 bp, synthetic construct
  misc_feature 1..23: note = Description of Artificial Sequence: Syntheticoligonucleotide
  source 1..23: mol_type = other DNA
gcggactcgcatgcgagtccgct

SEQ ID NO: 3716 - DNA, 23 bp, synthetic construct
  misc_feature 1..23: note = Description of Artificial Sequence: Syntheticoligonucleotide
  source 1..23: mol_type = other DNA
acggactcgcatgcgagtccgtc

SEQ ID NO: 3717 - DNA, 23 bp, synthetic construct
  misc_feature 1..23: note = Description of Artificial Sequence: Syntheticoligonucleotide
  source 1..23: mol_type = other DNA
gaggactcgcatgcgagtcctcc

SEQ ID NO: 3718 - DNA, 23 bp, synthetic construct
  misc_feature 1..23: note = Description of Artificial Sequence: Syntheticoligonucleotide
  source 1..23: mol_type = other DNA
gcagactcgcatgcgagtctgcc

SEQ ID NO: 3719 - DNA, 23 bp, synthetic construct
  misc_feature 1..23: note = Description of Artificial Sequence: Syntheticoligonucleotide
  source 1..23: mol_type = other DNA
gcggactcgcatgcgagtccgca

SEQ ID NO: 3720 - DNA, 23 bp, synthetic construct
  misc_feature 1..23: note = Description of Artificial Sequence: Syntheticoligonucleotide
  source 1..23: mol_type = other DNA
tcggactcgcatgcgagtccgac

SEQ ID NO: 3721 - DNA, 23 bp, synthetic construct
  misc_feature 1..23: note = Description of Artificial Sequence: Syntheticoligonucleotide
  source 1..23: mol_type = other DNA
gtggactcgcatgcgagtccacc

SEQ ID NO: 3722 - DNA, 23 bp, synthetic construct
  misc_feature 1..23: note = Description of Artificial Sequence: Syntheticoligonucleotide
  source 1..23: mol_type = other DNA
gctgactcgcatgcgagtcagcc

SEQ ID NO: 3723 - DNA, 23 bp, synthetic construct
  misc_feature 1..23: note = Description of Artificial Sequence: Syntheticoligonucleotide
  source 1..23: mol_type = other DNA
cccgactcgcatgcgagtcgggc

SEQ ID NO: 3724 - DNA, 23 bp, synthetic construct
  misc_feature 1..23: note = Description of Artificial Sequence: Syntheticoligonucleotide
  source 1..23: mol_type = other DNA
cccgactcgcatgcgagtcgggt

SEQ ID NO: 3725 - DNA, 23 bp, synthetic construct
  misc_feature 1..23: note = Description of Artificial Sequence: Syntheticoligonucleotide
  source 1..23: mol_type = other DNA
accgactcgcatgcgagtcggtc

SEQ ID NO: 3726 - DNA, 23 bp, synthetic construct
  misc_feature 1..23: note = Description of Artificial Sequence: Syntheticoligonucleotide
  source 1..23: mol_type = other DNA
cacgactcgcatgcgagtcgtgc

SEQ ID NO: 3727 - DNA, 23 bp, synthetic construct
  misc_feature 1..23: note = Description of Artificial Sequence: Syntheticoligonucleotide
  source 1..23: mol_type = other DNA
ccagactcgcatgcgagtctggc

SEQ ID NO: 3728 - DNA, 23 bp, synthetic construct
  misc_feature 1..23: note = Description of Artificial Sequence: Syntheticoligonucleotide
  source 1..23: mol_type = other DNA
cccgactcgcatgcgagtcggga

SEQ ID NO: 3729 - DNA, 23 bp, synthetic construct
  misc_feature 1..23: note = Description of Artificial Sequence: Syntheticoligonucleotide
  source 1..23: mol_type = other DNA
tccgactcgcatgcgagtcggac

SEQ ID NO: 3730 - DNA, 23 bp, synthetic construct
  misc_feature 1..23: note = Description of Artificial Sequence: Syntheticoligonucleotide
  source 1..23: mol_type = other DNA
cctgactcgcatgcgagtcaggc

SEQ ID NO: 3731 - DNA, 23 bp, synthetic construct
  misc_feature 1..23: note = Description of Artificial Sequence: Syntheticoligonucleotide
  source 1..23: mol_type = other DNA
ggcgactcgcatgcgagtcgccc

SEQ ID NO: 3732 - DNA, 23 bp, synthetic construct
  misc_feature 1..23: note = Description of Artificial Sequence: Syntheticoligonucleotide
  source 1..23: mol_type = other DNA
ggcgactcgcatgcgagtcgcct

SEQ ID NO: 3733 - DNA, 23 bp, synthetic construct
  misc_feature 1..23: note = Description of Artificial Sequence: Syntheticoligonucleotide
  source 1..23: mol_type = other DNA
agcgactcgcatgcgagtcgctc

SEQ ID NO: 3734 - DNA, 23 bp, synthetic construct
  misc_feature 1..23: note = Description of Artificial Sequence: Syntheticoligonucleotide
  source 1..23: mol_type = other DNA
gacgactcgcatgcgagtcgtcc

SEQ ID NO: 3735 - DNA, 23 bp, synthetic construct
  misc_feature 1..23: note = Description of Artificial Sequence: Syntheticoligonucleotide
  source 1..23: mol_type = other DNA
ggagactcgcatgcgagtctccc

SEQ ID NO: 3736 - DNA, 23 bp, synthetic construct
  misc_feature 1..23: note = Description of Artificial Sequence: Syntheticoligonucleotide
  source 1..23: mol_type = other DNA
ggcgactcgcatgcgagtcgcca

SEQ ID NO: 3737 - DNA, 23 bp, synthetic construct
  misc_feature 1..23: note = Description of Artificial Sequence: Syntheticoligonucleotide
  source 1..23: mol_type = other DNA
tgcgactcgcatgcgagtcgcac

SEQ ID NO: 3738 - DNA, 23 bp, synthetic construct
  misc_feature 1..23: note = Description of Artificial Sequence: Syntheticoligonucleotide
  source 1..23: mol_type = other DNA
ggtgactcgcatgcgagtcaccc

SEQ ID NO: 3739 - DNA, 23 bp, synthetic construct
  misc_feature 1..23: note = Description of Artificial Sequence: Syntheticoligonucleotide
  source 1..23: mol_type = other DNA
cgggactcgcatgcgagtcccgt

SEQ ID NO: 3740 - DNA, 23 bp, synthetic construct
  misc_feature 1..23: note = Description of Artificial Sequence: Syntheticoligonucleotide
  source 1..23: mol_type = other DNA
agggactcgcatgcgagtccctg

SEQ ID NO: 3741 - DNA, 23 bp, synthetic construct
  misc_feature 1..23: note = Description of Artificial Sequence: Syntheticoligonucleotide
  source 1..23: mol_type = other DNA
caggactcgcatgcgagtcctgg

SEQ ID NO: 3742 - DNA, 23 bp, synthetic construct
  misc_feature 1..23: note = Description of Artificial Sequence: Syntheticoligonucleotide
  source 1..23: mol_type = other DNA
cgagactcgcatgcgagtctcgg

SEQ ID NO: 3743 - DNA, 23 bp, synthetic construct
  misc_feature 1..23: note = Description of Artificial Sequence: Syntheticoligonucleotide
  source 1..23: mol_type = other DNA
cgggactcgcatgcgagtcccga

SEQ ID NO: 3744 - DNA, 23 bp, synthetic construct
  misc_feature 1..23: note = Description of Artificial Sequence: Syntheticoligonucleotide
  source 1..23: mol_type = other DNA
tgggactcgcatgcgagtcccag

SEQ ID NO: 3745 - DNA, 23 bp, synthetic construct
  misc_feature 1..23: note = Description of Artificial Sequence: Syntheticoligonucleotide
  source 1..23: mol_type = other DNA
ctggactcgcatgcgagtccagg

SEQ ID NO: 3746 - DNA, 23 bp, synthetic construct
  misc_feature 1..23: note = Description of Artificial Sequence: Syntheticoligonucleotide
  source 1..23: mol_type = other DNA
cgtgactcgcatgcgagtcacgg

SEQ ID NO: 3747 - DNA, 23 bp, synthetic construct
  misc_feature 1..23: note = Description of Artificial Sequence: Syntheticoligonucleotide
  source 1..23: mol_type = other DNA
ggcgactcgcatgcgagtcgccg

SEQ ID NO: 3748 - DNA, 23 bp, synthetic construct
  misc_feature 1..23: note = Description of Artificial Sequence: Syntheticoligonucleotide
  source 1..23: mol_type = other DNA
agcgactcgcatgcgagtcgctg

SEQ ID NO: 3749 - DNA, 23 bp, synthetic construct
  misc_feature 1..23: note = Description of Artificial Sequence: Syntheticoligonucleotide
  source 1..23: mol_type = other DNA
gacgactcgcatgcgagtcgtcg

SEQ ID NO: 3750 - DNA, 23 bp, synthetic construct
  misc_feature 1..23: note = Description of Artificial Sequence: Syntheticoligonucleotide
  source 1..23: mol_type = other DNA
ggagactcgcatgcgagtctccg

SEQ ID NO: 3751 - DNA, 23 bp, synthetic construct
  misc_feature 1..23: note = Description of Artificial Sequence: Syntheticoligonucleotide
  source 1..23: mol_type = other DNA
tgcgactcgcatgcgagtcgcag

SEQ ID NO: 3752 - DNA, 23 bp, synthetic construct
  misc_feature 1..23: note = Description of Artificial Sequence: Syntheticoligonucleotide
  source 1..23: mol_type = other DNA
ggtgactcgcatgcgagtcaccg

SEQ ID NO: 3753 - DNA, 23 bp, synthetic construct
  misc_feature 1..23: note = Description of Artificial Sequence: Syntheticoligonucleotide
  source 1..23: mol_type = other DNA
acggactcgcatgcgagtccgtg

SEQ ID NO: 3754 - DNA, 23 bp, synthetic construct
  misc_feature 1..23: note = Description of Artificial Sequence: Syntheticoligonucleotide
  source 1..23: mol_type = other DNA
ccagactcgcatgcgagtctggg

SEQ ID NO: 3755 - DNA, 23 bp, synthetic construct
  misc_feature 1..23: note = Description of Artificial Sequence: Syntheticoligonucleotide
  source 1..23: mol_type = other DNA
tcggactcgcatgcgagtccgag

SEQ ID NO: 3756 - DNA, 23 bp, synthetic construct
  misc_feature 1..23: note = Description of Artificial Sequence: Syntheticoligonucleotide
  source 1..23: mol_type = other DNA
cctgactcgcatgcgagtcaggg

SEQ ID NO: 3757 - DNA, 23 bp, synthetic construct
  misc_feature 1..23: note = Description of Artificial Sequence: Syntheticoligonucleotide
  source 1..23: mol_type = other DNA
cacgactcgcatgcgagtcgtgg

SEQ ID NO: 3758 - DNA, 23 bp, synthetic construct
  misc_feature 1..23: note = Description of Artificial Sequence: Syntheticoligonucleotide
  source 1..23: mol_type = other DNA
gccgactcgcatgcgagtcggct

SEQ ID NO: 3759 - DNA, 23 bp, synthetic construct
  misc_feature 1..23: note = Description of Artificial Sequence: Syntheticoligonucleotide
  source 1..23: mol_type = other DNA
gccgactcgcatgcgagtcggca

SEQ ID NO: 3760 - DNA, 23 bp, synthetic construct
  misc_feature 1..23: note = Description of Artificial Sequence: Syntheticoligonucleotide
  source 1..23: mol_type = other DNA
cgagactcgcatgcgagtctcgc

SEQ ID NO: 3761 - DNA, 23 bp, synthetic construct
  misc_feature 1..23: note = Description of Artificial Sequence: Syntheticoligonucleotide
  source 1..23: mol_type = other DNA
cgtgactcgcatgcgagtcacgc

SEQ ID NO: 3762 - DNA, 23 bp, synthetic construct
  misc_feature 1..23: note = Description of Artificial Sequence: Syntheticoligonucleotide
  source 1..23: mol_type = other DNA
caggactcgcatgcgagtcctgc

SEQ ID NO: 3763 - DNA, 23 bp, synthetic construct
  misc_feature 1..23: note = Description of Artificial Sequence: Syntheticoligonucleotide
  source 1..23: mol_type = other DNA
ctggactcgcatgcgagtccagc

SEQ ID NO: 3764 - DNA, 23 bp, synthetic construct
  misc_feature 1..23: note = Description of Artificial Sequence: Syntheticoligonucleotide
  source 1..23: mol_type = other DNA
gaggactcgcatgcgagtcctcg

SEQ ID NO: 3765 - DNA, 23 bp, synthetic construct
  misc_feature 1..23: note = Description of Artificial Sequence: Syntheticoligonucleotide
  source 1..23: mol_type = other DNA
gtggactcgcatgcgagtccacg

SEQ ID NO: 3766 - DNA, 23 bp, synthetic construct
  misc_feature 1..23: note = Description of Artificial Sequence: Syntheticoligonucleotide
  source 1..23: mol_type = other DNA
accgactcgcatgcgagtcggtg

SEQ ID NO: 3767 - DNA, 23 bp, synthetic construct
  misc_feature 1..23: note = Description of Artificial Sequence: Syntheticoligonucleotide
  source 1..23: mol_type = other DNA
tccgactcgcatgcgagtcggag

SEQ ID NO: 3768 - DNA, 23 bp, synthetic construct
  misc_feature 1..23: note = Description of Artificial Sequence: Syntheticoligonucleotide
  source 1..23: mol_type = other DNA
cgggactcgcatgcgagtcccgc

SEQ ID NO: 3769 - DNA, 23 bp, synthetic construct
  misc_feature 1..23: note = Description of Artificial Sequence: Syntheticoligonucleotide
  source 1..23: mol_type = other DNA
agggactcgcatgcgagtccctc

SEQ ID NO: 3770 - DNA, 23 bp, synthetic construct
  misc_feature 1..23: note = Description of Artificial Sequence: Syntheticoligonucleotide
  source 1..23: mol_type = other DNA
tgggactcgcatgcgagtcccac

SEQ ID NO: 3771 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcgctagcgagtcnnnn

SEQ ID NO: 3772 - DNA, 23 bp, synthetic construct
  misc_feature 1..23: note = Description of Artificial Sequence: Syntheticoligonucleotide
  source 1..23: mol_type = other DNA
gcggactcgctagcgagtccgcc

SEQ ID NO: 3773 - DNA, 23 bp, synthetic construct
  misc_feature 1..23: note = Description of Artificial Sequence: Syntheticoligonucleotide
  source 1..23: mol_type = other DNA
gcggactcgctagcgagtccgct

SEQ ID NO: 3774 - DNA, 23 bp, synthetic construct
  misc_feature 1..23: note = Description of Artificial Sequence: Syntheticoligonucleotide
  source 1..23: mol_type = other DNA
acggactcgctagcgagtccgtc

SEQ ID NO: 3775 - DNA, 23 bp, synthetic construct
  misc_feature 1..23: note = Description of Artificial Sequence: Syntheticoligonucleotide
  source 1..23: mol_type = other DNA
gaggactcgctagcgagtcctcc

SEQ ID NO: 3776 - DNA, 23 bp, synthetic construct
  misc_feature 1..23: note = Description of Artificial Sequence: Syntheticoligonucleotide
  source 1..23: mol_type = other DNA
gcagactcgctagcgagtctgcc

SEQ ID NO: 3777 - DNA, 23 bp, synthetic construct
  misc_feature 1..23: note = Description of Artificial Sequence: Syntheticoligonucleotide
  source 1..23: mol_type = other DNA
gcggactcgctagcgagtccgca

SEQ ID NO: 3778 - DNA, 23 bp, synthetic construct
  misc_feature 1..23: note = Description of Artificial Sequence: Syntheticoligonucleotide
  source 1..23: mol_type = other DNA
tcggactcgctagcgagtccgac

SEQ ID NO: 3779 - DNA, 23 bp, synthetic construct
  misc_feature 1..23: note = Description of Artificial Sequence: Syntheticoligonucleotide
  source 1..23: mol_type = other DNA
gtggactcgctagcgagtccacc

SEQ ID NO: 3780 - DNA, 23 bp, synthetic construct
  misc_feature 1..23: note = Description of Artificial Sequence: Syntheticoligonucleotide
  source 1..23: mol_type = other DNA
gctgactcgctagcgagtcagcc

SEQ ID NO: 3781 - DNA, 23 bp, synthetic construct
  misc_feature 1..23: note = Description of Artificial Sequence: Syntheticoligonucleotide
  source 1..23: mol_type = other DNA
cccgactcgctagcgagtcgggc

SEQ ID NO: 3782 - DNA, 23 bp, synthetic construct
  misc_feature 1..23: note = Description of Artificial Sequence: Syntheticoligonucleotide
  source 1..23: mol_type = other DNA
cccgactcgctagcgagtcgggt

SEQ ID NO: 3783 - DNA, 23 bp, synthetic construct
  misc_feature 1..23: note = Description of Artificial Sequence: Syntheticoligonucleotide
  source 1..23: mol_type = other DNA
accgactcgctagcgagtcggtc

SEQ ID NO: 3784 - DNA, 23 bp, synthetic construct
  misc_feature 1..23: note = Description of Artificial Sequence: Syntheticoligonucleotide
  source 1..23: mol_type = other DNA
cacgactcgctagcgagtcgtgc

SEQ ID NO: 3785 - DNA, 23 bp, synthetic construct
  misc_feature 1..23: note = Description of Artificial Sequence: Syntheticoligonucleotide
  source 1..23: mol_type = other DNA
ccagactcgctagcgagtctggc

SEQ ID NO: 3786 - DNA, 23 bp, synthetic construct
  misc_feature 1..23: note = Description of Artificial Sequence: Syntheticoligonucleotide
  source 1..23: mol_type = other DNA
cccgactcgctagcgagtcggga

SEQ ID NO: 3787 - DNA, 23 bp, synthetic construct
  misc_feature 1..23: note = Description of Artificial Sequence: Syntheticoligonucleotide
  source 1..23: mol_type = other DNA
tccgactcgctagcgagtcggac

SEQ ID NO: 3788 - DNA, 23 bp, synthetic construct
  misc_feature 1..23: note = Description of Artificial Sequence: Syntheticoligonucleotide
  source 1..23: mol_type = other DNA
cctgactcgctagcgagtcaggc

SEQ ID NO: 3789 - DNA, 23 bp, synthetic construct
  misc_feature 1..23: note = Description of Artificial Sequence: Syntheticoligonucleotide
  source 1..23: mol_type = other DNA
ggcgactcgctagcgagtcgccc

SEQ ID NO: 3790 - DNA, 23 bp, synthetic construct
  misc_feature 1..23: note = Description of Artificial Sequence: Syntheticoligonucleotide
  source 1..23: mol_type = other DNA
ggcgactcgctagcgagtcgcct

SEQ ID NO: 3791 - DNA, 23 bp, synthetic construct
  misc_feature 1..23: note = Description of Artificial Sequence: Syntheticoligonucleotide
  source 1..23: mol_type = other DNA
agcgactcgctagcgagtcgctc

SEQ ID NO: 3792 - DNA, 23 bp, synthetic construct
  misc_feature 1..23: note = Description of Artificial Sequence: Syntheticoligonucleotide
  source 1..23: mol_type = other DNA
gacgactcgctagcgagtcgtcc

SEQ ID NO: 3793 - DNA, 23 bp, synthetic construct
  misc_feature 1..23: note = Description of Artificial Sequence: Syntheticoligonucleotide
  source 1..23: mol_type = other DNA
ggagactcgctagcgagtctccc

SEQ ID NO: 3794 - DNA, 23 bp, synthetic construct
  misc_feature 1..23: note = Description of Artificial Sequence: Syntheticoligonucleotide
  source 1..23: mol_type = other DNA
ggcgactcgctagcgagtcgcca

SEQ ID NO: 3795 - DNA, 23 bp, synthetic construct
  misc_feature 1..23: note = Description of Artificial Sequence: Syntheticoligonucleotide
  source 1..23: mol_type = other DNA
tgcgactcgctagcgagtcgcac

SEQ ID NO: 3796 - DNA, 23 bp, synthetic construct
  misc_feature 1..23: note = Description of Artificial Sequence: Syntheticoligonucleotide
  source 1..23: mol_type = other DNA
ggtgactcgctagcgagtcaccc

SEQ ID NO: 3797 - DNA, 23 bp, synthetic construct
  misc_feature 1..23: note = Description of Artificial Sequence: Syntheticoligonucleotide
  source 1..23: mol_type = other DNA
cgggactcgctagcgagtcccgt

SEQ ID NO: 3798 - DNA, 23 bp, synthetic construct
  misc_feature 1..23: note = Description of Artificial Sequence: Syntheticoligonucleotide
  source 1..23: mol_type = other DNA
agggactcgctagcgagtccctg

SEQ ID NO: 3799 - DNA, 23 bp, synthetic construct
  misc_feature 1..23: note = Description of Artificial Sequence: Syntheticoligonucleotide
  source 1..23: mol_type = other DNA
caggactcgctagcgagtcctgg

SEQ ID NO: 3800 - DNA, 23 bp, synthetic construct
  misc_feature 1..23: note = Description of Artificial Sequence: Syntheticoligonucleotide
  source 1..23: mol_type = other DNA
cgagactcgctagcgagtctcgg

SEQ ID NO: 3801 - DNA, 23 bp, synthetic construct
  misc_feature 1..23: note = Description of Artificial Sequence: Syntheticoligonucleotide
  source 1..23: mol_type = other DNA
cgggactcgctagcgagtcccga

SEQ ID NO: 3802 - DNA, 23 bp, synthetic construct
  misc_feature 1..23: note = Description of Artificial Sequence: Syntheticoligonucleotide
  source 1..23: mol_type = other DNA
tgggactcgctagcgagtcccag

SEQ ID NO: 3803 - DNA, 23 bp, synthetic construct
  misc_feature 1..23: note = Description of Artificial Sequence: Syntheticoligonucleotide
  source 1..23: mol_type = other DNA
ctggactcgctagcgagtccagg

SEQ ID NO: 3804 - DNA, 23 bp, synthetic construct
  misc_feature 1..23: note = Description of Artificial Sequence: Syntheticoligonucleotide
  source 1..23: mol_type = other DNA
cgtgactcgctagcgagtcacgg

SEQ ID NO: 3805 - DNA, 23 bp, synthetic construct
  misc_feature 1..23: note = Description of Artificial Sequence: Syntheticoligonucleotide
  source 1..23: mol_type = other DNA
ggcgactcgctagcgagtcgccg

SEQ ID NO: 3806 - DNA, 23 bp, synthetic construct
  misc_feature 1..23: note = Description of Artificial Sequence: Syntheticoligonucleotide
  source 1..23: mol_type = other DNA
agcgactcgctagcgagtcgctg

SEQ ID NO: 3807 - DNA, 23 bp, synthetic construct
  misc_feature 1..23: note = Description of Artificial Sequence: Syntheticoligonucleotide
  source 1..23: mol_type = other DNA
gacgactcgctagcgagtcgtcg

SEQ ID NO: 3808 - DNA, 23 bp, synthetic construct
  misc_feature 1..23: note = Description of Artificial Sequence: Syntheticoligonucleotide
  source 1..23: mol_type = other DNA
ggagactcgctagcgagtctccg

SEQ ID NO: 3809 - DNA, 23 bp, synthetic construct
  misc_feature 1..23: note = Description of Artificial Sequence: Syntheticoligonucleotide
  source 1..23: mol_type = other DNA
tgcgactcgctagcgagtcgcag

SEQ ID NO: 3810 - DNA, 23 bp, synthetic construct
  misc_feature 1..23: note = Description of Artificial Sequence: Syntheticoligonucleotide
  source 1..23: mol_type = other DNA
ggtgactcgctagcgagtcaccg

SEQ ID NO: 3811 - DNA, 23 bp, synthetic construct
  misc_feature 1..23: note = Description of Artificial Sequence: Syntheticoligonucleotide
  source 1..23: mol_type = other DNA
acggactcgctagcgagtccgtg

SEQ ID NO: 3812 - DNA, 23 bp, synthetic construct
  misc_feature 1..23: note = Description of Artificial Sequence: Syntheticoligonucleotide
  source 1..23: mol_type = other DNA
ccagactcgctagcgagtctggg

SEQ ID NO: 3813 - DNA, 23 bp, synthetic construct
  misc_feature 1..23: note = Description of Artificial Sequence: Syntheticoligonucleotide
  source 1..23: mol_type = other DNA
tcggactcgctagcgagtccgag

SEQ ID NO: 3814 - DNA, 23 bp, synthetic construct
  misc_feature 1..23: note = Description of Artificial Sequence: Syntheticoligonucleotide
  source 1..23: mol_type = other DNA
cctgactcgctagcgagtcaggg

SEQ ID NO: 3815 - DNA, 23 bp, synthetic construct
  misc_feature 1..23: note = Description of Artificial Sequence: Syntheticoligonucleotide
  source 1..23: mol_type = other DNA
cacgactcgctagcgagtcgtgg

SEQ ID NO: 3816 - DNA, 23 bp, synthetic construct
  misc_feature 1..23: note = Description of Artificial Sequence: Syntheticoligonucleotide
  source 1..23: mol_type = other DNA
gccgactcgctagcgagtcggct

SEQ ID NO: 3817 - DNA, 23 bp, synthetic construct
  misc_feature 1..23: note = Description of Artificial Sequence: Syntheticoligonucleotide
  source 1..23: mol_type = other DNA
gccgactcgctagcgagtcggca

SEQ ID NO: 3818 - DNA, 23 bp, synthetic construct
  misc_feature 1..23: note = Description of Artificial Sequence: Syntheticoligonucleotide
  source 1..23: mol_type = other DNA
cgagactcgctagcgagtctcgc

SEQ ID NO: 3819 - DNA, 23 bp, synthetic construct
  misc_feature 1..23: note = Description of Artificial Sequence: Syntheticoligonucleotide
  source 1..23: mol_type = other DNA
cgtgactcgctagcgagtcacgc

SEQ ID NO: 3820 - DNA, 23 bp, synthetic construct
  misc_feature 1..23: note = Description of Artificial Sequence: Syntheticoligonucleotide
  source 1..23: mol_type = other DNA
caggactcgctagcgagtcctgc

SEQ ID NO: 3821 - DNA, 23 bp, synthetic construct
  misc_feature 1..23: note = Description of Artificial Sequence: Syntheticoligonucleotide
  source 1..23: mol_type = other DNA
ctggactcgctagcgagtccagc

SEQ ID NO: 3822 - DNA, 23 bp, synthetic construct
  misc_feature 1..23: note = Description of Artificial Sequence: Syntheticoligonucleotide
  source 1..23: mol_type = other DNA
gaggactcgctagcgagtcctcg

SEQ ID NO: 3823 - DNA, 23 bp, synthetic construct
  misc_feature 1..23: note = Description of Artificial Sequence: Syntheticoligonucleotide
  source 1..23: mol_type = other DNA
gtggactcgctagcgagtccacg

SEQ ID NO: 3824 - DNA, 23 bp, synthetic construct
  misc_feature 1..23: note = Description of Artificial Sequence: Syntheticoligonucleotide
  source 1..23: mol_type = other DNA
accgactcgctagcgagtcggtg

SEQ ID NO: 3825 - DNA, 23 bp, synthetic construct
  misc_feature 1..23: note = Description of Artificial Sequence: Syntheticoligonucleotide
  source 1..23: mol_type = other DNA
tccgactcgctagcgagtcggag

SEQ ID NO: 3826 - DNA, 23 bp, synthetic construct
  misc_feature 1..23: note = Description of Artificial Sequence: Syntheticoligonucleotide
  source 1..23: mol_type = other DNA
cgggactcgctagcgagtcccgc

SEQ ID NO: 3827 - DNA, 23 bp, synthetic construct
  misc_feature 1..23: note = Description of Artificial Sequence: Syntheticoligonucleotide
  source 1..23: mol_type = other DNA
agggactcgctagcgagtccctc

SEQ ID NO: 3828 - DNA, 23 bp, synthetic construct
  misc_feature 1..23: note = Description of Artificial Sequence: Syntheticoligonucleotide
  source 1..23: mol_type = other DNA
tgggactcgctagcgagtcccac

SEQ ID NO: 3829 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcgcgcgcgagtcnnnn

SEQ ID NO: 3830 - DNA, 23 bp, synthetic construct
  misc_feature 1..23: note = Description of Artificial Sequence: Syntheticoligonucleotide
  source 1..23: mol_type = other DNA
gcggactcgcgcgcgagtccgcc

SEQ ID NO: 3831 - DNA, 23 bp, synthetic construct
  misc_feature 1..23: note = Description of Artificial Sequence: Syntheticoligonucleotide
  source 1..23: mol_type = other DNA
gcggactcgcgcgcgagtccgct

SEQ ID NO: 3832 - DNA, 23 bp, synthetic construct
  misc_feature 1..23: note = Description of Artificial Sequence: Syntheticoligonucleotide
  source 1..23: mol_type = other DNA
acggactcgcgcgcgagtccgtc

SEQ ID NO: 3833 - DNA, 23 bp, synthetic construct
  misc_feature 1..23: note = Description of Artificial Sequence: Syntheticoligonucleotide
  source 1..23: mol_type = other DNA
gaggactcgcgcgcgagtcctcc

SEQ ID NO: 3834 - DNA, 23 bp, synthetic construct
  misc_feature 1..23: note = Description of Artificial Sequence: Syntheticoligonucleotide
  source 1..23: mol_type = other DNA
gcagactcgcgcgcgagtctgcc

SEQ ID NO: 3835 - DNA, 23 bp, synthetic construct
  misc_feature 1..23: note = Description of Artificial Sequence: Syntheticoligonucleotide
  source 1..23: mol_type = other DNA
gcggactcgcgcgcgagtccgca

SEQ ID NO: 3836 - DNA, 23 bp, synthetic construct
  misc_feature 1..23: note = Description of Artificial Sequence: Syntheticoligonucleotide
  source 1..23: mol_type = other DNA
tcggactcgcgcgcgagtccgac

SEQ ID NO: 3837 - DNA, 23 bp, synthetic construct
  misc_feature 1..23: note = Description of Artificial Sequence: Syntheticoligonucleotide
  source 1..23: mol_type = other DNA
gtggactcgcgcgcgagtccacc

SEQ ID NO: 3838 - DNA, 23 bp, synthetic construct
  misc_feature 1..23: note = Description of Artificial Sequence: Syntheticoligonucleotide
  source 1..23: mol_type = other DNA
gctgactcgcgcgcgagtcagcc

SEQ ID NO: 3839 - DNA, 23 bp, synthetic construct
  misc_feature 1..23: note = Description of Artificial Sequence: Syntheticoligonucleotide
  source 1..23: mol_type = other DNA
cccgactcgcgcgcgagtcgggc

SEQ ID NO: 3840 - DNA, 23 bp, synthetic construct
  misc_feature 1..23: note = Description of Artificial Sequence: Syntheticoligonucleotide
  source 1..23: mol_type = other DNA
cccgactcgcgcgcgagtcgggt

SEQ ID NO: 3841 - DNA, 23 bp, synthetic construct
  misc_feature 1..23: note = Description of Artificial Sequence: Syntheticoligonucleotide
  source 1..23: mol_type = other DNA
accgactcgcgcgcgagtcggtc

SEQ ID NO: 3842 - DNA, 23 bp, synthetic construct
  misc_feature 1..23: note = Description of Artificial Sequence: Syntheticoligonucleotide
  source 1..23: mol_type = other DNA
cacgactcgcgcgcgagtcgtgc

SEQ ID NO: 3843 - DNA, 23 bp, synthetic construct
  misc_feature 1..23: note = Description of Artificial Sequence: Syntheticoligonucleotide
  source 1..23: mol_type = other DNA
ccagactcgcgcgcgagtctggc

SEQ ID NO: 3844 - DNA, 23 bp, synthetic construct
  misc_feature 1..23: note = Description of Artificial Sequence: Syntheticoligonucleotide
  source 1..23: mol_type = other DNA
cccgactcgcgcgcgagtcggga

SEQ ID NO: 3845 - DNA, 23 bp, synthetic construct
  misc_feature 1..23: note = Description of Artificial Sequence: Syntheticoligonucleotide
  source 1..23: mol_type = other DNA
tccgactcgcgcgcgagtcggac

SEQ ID NO: 3846 - DNA, 23 bp, synthetic construct
  misc_feature 1..23: note = Description of Artificial Sequence: Syntheticoligonucleotide
  source 1..23: mol_type = other DNA
cctgactcgcgcgcgagtcaggc

SEQ ID NO: 3847 - DNA, 23 bp, synthetic construct
  misc_feature 1..23: note = Description of Artificial Sequence: Syntheticoligonucleotide
  source 1..23: mol_type = other DNA
ggcgactcgcgcgcgagtcgccc

SEQ ID NO: 3848 - DNA, 23 bp, synthetic construct
  misc_feature 1..23: note = Description of Artificial Sequence: Syntheticoligonucleotide
  source 1..23: mol_type = other DNA
ggcgactcgcgcgcgagtcgcct

SEQ ID NO: 3849 - DNA, 23 bp, synthetic construct
  misc_feature 1..23: note = Description of Artificial Sequence: Syntheticoligonucleotide
  source 1..23: mol_type = other DNA
agcgactcgcgcgcgagtcgctc

SEQ ID NO: 3850 - DNA, 23 bp, synthetic construct
  misc_feature 1..23: note = Description of Artificial Sequence: Syntheticoligonucleotide
  source 1..23: mol_type = other DNA
gacgactcgcgcgcgagtcgtcc

SEQ ID NO: 3851 - DNA, 23 bp, synthetic construct
  misc_feature 1..23: note = Description of Artificial Sequence: Syntheticoligonucleotide
  source 1..23: mol_type = other DNA
ggagactcgcgcgcgagtctccc

SEQ ID NO: 3852 - DNA, 23 bp, synthetic construct
  misc_feature 1..23: note = Description of Artificial Sequence: Syntheticoligonucleotide
  source 1..23: mol_type = other DNA
ggcgactcgcgcgcgagtcgcca

SEQ ID NO: 3853 - DNA, 23 bp, synthetic construct
  misc_feature 1..23: note = Description of Artificial Sequence: Syntheticoligonucleotide
  source 1..23: mol_type = other DNA
tgcgactcgcgcgcgagtcgcac

SEQ ID NO: 3854 - DNA, 23 bp, synthetic construct
  misc_feature 1..23: note = Description of Artificial Sequence: Syntheticoligonucleotide
  source 1..23: mol_type = other DNA
ggtgactcgcgcgcgagtcaccc

SEQ ID NO: 3855 - DNA, 23 bp, synthetic construct
  misc_feature 1..23: note = Description of Artificial Sequence: Syntheticoligonucleotide
  source 1..23: mol_type = other DNA
cgggactcgcgcgcgagtcccgt

SEQ ID NO: 3856 - DNA, 23 bp, synthetic construct
  misc_feature 1..23: note = Description of Artificial Sequence: Syntheticoligonucleotide
  source 1..23: mol_type = other DNA
agggactcgcgcgcgagtccctg

SEQ ID NO: 3857 - DNA, 23 bp, synthetic construct
  misc_feature 1..23: note = Description of Artificial Sequence: Syntheticoligonucleotide
  source 1..23: mol_type = other DNA
caggactcgcgcgcgagtcctgg

SEQ ID NO: 3858 - DNA, 23 bp, synthetic construct
  misc_feature 1..23: note = Description of Artificial Sequence: Syntheticoligonucleotide
  source 1..23: mol_type = other DNA
cgagactcgcgcgcgagtctcgg

SEQ ID NO: 3859 - DNA, 23 bp, synthetic construct
  misc_feature 1..23: note = Description of Artificial Sequence: Syntheticoligonucleotide
  source 1..23: mol_type = other DNA
cgggactcgcgcgcgagtcccga

SEQ ID NO: 3860 - DNA, 23 bp, synthetic construct
  misc_feature 1..23: note = Description of Artificial Sequence: Syntheticoligonucleotide
  source 1..23: mol_type = other DNA
tgggactcgcgcgcgagtcccag

SEQ ID NO: 3861 - DNA, 23 bp, synthetic construct
  misc_feature 1..23: note = Description of Artificial Sequence: Syntheticoligonucleotide
  source 1..23: mol_type = other DNA
ctggactcgcgcgcgagtccagg

SEQ ID NO: 3862 - DNA, 23 bp, synthetic construct
  misc_feature 1..23: note = Description of Artificial Sequence: Syntheticoligonucleotide
  source 1..23: mol_type = other DNA
cgtgactcgcgcgcgagtcacgg

SEQ ID NO: 3863 - DNA, 23 bp, synthetic construct
  misc_feature 1..23: note = Description of Artificial Sequence: Syntheticoligonucleotide
  source 1..23: mol_type = other DNA
ggcgactcgcgcgcgagtcgccg

SEQ ID NO: 3864 - DNA, 23 bp, synthetic construct
  misc_feature 1..23: note = Description of Artificial Sequence: Syntheticoligonucleotide
  source 1..23: mol_type = other DNA
agcgactcgcgcgcgagtcgctg

SEQ ID NO: 3865 - DNA, 23 bp, synthetic construct
  misc_feature 1..23: note = Description of Artificial Sequence: Syntheticoligonucleotide
  source 1..23: mol_type = other DNA
gacgactcgcgcgcgagtcgtcg

SEQ ID NO: 3866 - DNA, 23 bp, synthetic construct
  misc_feature 1..23: note = Description of Artificial Sequence: Syntheticoligonucleotide
  source 1..23: mol_type = other DNA
ggagactcgcgcgcgagtctccg

SEQ ID NO: 3867 - DNA, 23 bp, synthetic construct
  misc_feature 1..23: note = Description of Artificial Sequence: Syntheticoligonucleotide
  source 1..23: mol_type = other DNA
tgcgactcgcgcgcgagtcgcag

SEQ ID NO: 3868 - DNA, 23 bp, synthetic construct
  misc_feature 1..23: note = Description of Artificial Sequence: Syntheticoligonucleotide
  source 1..23: mol_type = other DNA
ggtgactcgcgcgcgagtcaccg

SEQ ID NO: 3869 - DNA, 23 bp, synthetic construct
  misc_feature 1..23: note = Description of Artificial Sequence: Syntheticoligonucleotide
  source 1..23: mol_type = other DNA
acggactcgcgcgcgagtccgtg

SEQ ID NO: 3870 - DNA, 23 bp, synthetic construct
  misc_feature 1..23: note = Description of Artificial Sequence: Syntheticoligonucleotide
  source 1..23: mol_type = other DNA
ccagactcgcgcgcgagtctggg

SEQ ID NO: 3871 - DNA, 23 bp, synthetic construct
  misc_feature 1..23: note = Description of Artificial Sequence: Syntheticoligonucleotide
  source 1..23: mol_type = other DNA
tcggactcgcgcgcgagtccgag

SEQ ID NO: 3872 - DNA, 23 bp, synthetic construct
  misc_feature 1..23: note = Description of Artificial Sequence: Syntheticoligonucleotide
  source 1..23: mol_type = other DNA
cctgactcgcgcgcgagtcaggg

SEQ ID NO: 3873 - DNA, 23 bp, synthetic construct
  misc_feature 1..23: note = Description of Artificial Sequence: Syntheticoligonucleotide
  source 1..23: mol_type = other DNA
cacgactcgcgcgcgagtcgtgg

SEQ ID NO: 3874 - DNA, 23 bp, synthetic construct
  misc_feature 1..23: note = Description of Artificial Sequence: Syntheticoligonucleotide
  source 1..23: mol_type = other DNA
gccgactcgcgcgcgagtcggct

SEQ ID NO: 3875 - DNA, 23 bp, synthetic construct
  misc_feature 1..23: note = Description of Artificial Sequence: Syntheticoligonucleotide
  source 1..23: mol_type = other DNA
gccgactcgcgcgcgagtcggca

SEQ ID NO: 3876 - DNA, 23 bp, synthetic construct
  misc_feature 1..23: note = Description of Artificial Sequence: Syntheticoligonucleotide
  source 1..23: mol_type = other DNA
cgagactcgcgcgcgagtctcgc

SEQ ID NO: 3877 - DNA, 23 bp, synthetic construct
  misc_feature 1..23: note = Description of Artificial Sequence: Syntheticoligonucleotide
  source 1..23: mol_type = other DNA
cgtgactcgcgcgcgagtcacgc

SEQ ID NO: 3878 - DNA, 23 bp, synthetic construct
  misc_feature 1..23: note = Description of Artificial Sequence: Syntheticoligonucleotide
  source 1..23: mol_type = other DNA
caggactcgcgcgcgagtcctgc

SEQ ID NO: 3879 - DNA, 23 bp, synthetic construct
  misc_feature 1..23: note = Description of Artificial Sequence: Syntheticoligonucleotide
  source 1..23: mol_type = other DNA
ctggactcgcgcgcgagtccagc

SEQ ID NO: 3880 - DNA, 23 bp, synthetic construct
  misc_feature 1..23: note = Description of Artificial Sequence: Syntheticoligonucleotide
  source 1..23: mol_type = other DNA
gaggactcgcgcgcgagtcctcg

SEQ ID NO: 3881 - DNA, 23 bp, synthetic construct
  misc_feature 1..23: note = Description of Artificial Sequence: Syntheticoligonucleotide
  source 1..23: mol_type = other DNA
gtggactcgcgcgcgagtccacg

SEQ ID NO: 3882 - DNA, 23 bp, synthetic construct
  misc_feature 1..23: note = Description of Artificial Sequence: Syntheticoligonucleotide
  source 1..23: mol_type = other DNA
accgactcgcgcgcgagtcggtg

SEQ ID NO: 3883 - DNA, 23 bp, synthetic construct
  misc_feature 1..23: note = Description of Artificial Sequence: Syntheticoligonucleotide
  source 1..23: mol_type = other DNA
tccgactcgcgcgcgagtcggag

SEQ ID NO: 3884 - DNA, 23 bp, synthetic construct
  misc_feature 1..23: note = Description of Artificial Sequence: Syntheticoligonucleotide
  source 1..23: mol_type = other DNA
cgggactcgcgcgcgagtcccgc

SEQ ID NO: 3885 - DNA, 23 bp, synthetic construct
  misc_feature 1..23: note = Description of Artificial Sequence: Syntheticoligonucleotide
  source 1..23: mol_type = other DNA
agggactcgcgcgcgagtccctc

SEQ ID NO: 3886 - DNA, 23 bp, synthetic construct
  misc_feature 1..23: note = Description of Artificial Sequence: Syntheticoligonucleotide
  source 1..23: mol_type = other DNA
tgggactcgcgcgcgagtcccac

SEQ ID NO: 3887 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcgccggcgagtcnnnn

SEQ ID NO: 3888 - DNA, 23 bp, synthetic construct
  misc_feature 1..23: note = Description of Artificial Sequence: Syntheticoligonucleotide
  source 1..23: mol_type = other DNA
gcggactcgccggcgagtccgcc

SEQ ID NO: 3889 - DNA, 23 bp, synthetic construct
  misc_feature 1..23: note = Description of Artificial Sequence: Syntheticoligonucleotide
  source 1..23: mol_type = other DNA
gcggactcgccggcgagtccgct

SEQ ID NO: 3890 - DNA, 23 bp, synthetic construct
  misc_feature 1..23: note = Description of Artificial Sequence: Syntheticoligonucleotide
  source 1..23: mol_type = other DNA
acggactcgccggcgagtccgtc

SEQ ID NO: 3891 - DNA, 23 bp, synthetic construct
  misc_feature 1..23: note = Description of Artificial Sequence: Syntheticoligonucleotide
  source 1..23: mol_type = other DNA
gaggactcgccggcgagtcctcc

SEQ ID NO: 3892 - DNA, 23 bp, synthetic construct
  misc_feature 1..23: note = Description of Artificial Sequence: Syntheticoligonucleotide
  source 1..23: mol_type = other DNA
gcagactcgccggcgagtctgcc

SEQ ID NO: 3893 - DNA, 23 bp, synthetic construct
  misc_feature 1..23: note = Description of Artificial Sequence: Syntheticoligonucleotide
  source 1..23: mol_type = other DNA
gcggactcgccggcgagtccgca

SEQ ID NO: 3894 - DNA, 23 bp, synthetic construct
  misc_feature 1..23: note = Description of Artificial Sequence: Syntheticoligonucleotide
  source 1..23: mol_type = other DNA
tcggactcgccggcgagtccgac

SEQ ID NO: 3895 - DNA, 23 bp, synthetic construct
  misc_feature 1..23: note = Description of Artificial Sequence: Syntheticoligonucleotide
  source 1..23: mol_type = other DNA
gtggactcgccggcgagtccacc

SEQ ID NO: 3896 - DNA, 23 bp, synthetic construct
  misc_feature 1..23: note = Description of Artificial Sequence: Syntheticoligonucleotide
  source 1..23: mol_type = other DNA
gctgactcgccggcgagtcagcc

SEQ ID NO: 3897 - DNA, 23 bp, synthetic construct
  misc_feature 1..23: note = Description of Artificial Sequence: Syntheticoligonucleotide
  source 1..23: mol_type = other DNA
cccgactcgccggcgagtcgggc

SEQ ID NO: 3898 - DNA, 23 bp, synthetic construct
  misc_feature 1..23: note = Description of Artificial Sequence: Syntheticoligonucleotide
  source 1..23: mol_type = other DNA
cccgactcgccggcgagtcgggt

SEQ ID NO: 3899 - DNA, 23 bp, synthetic construct
  misc_feature 1..23: note = Description of Artificial Sequence: Syntheticoligonucleotide
  source 1..23: mol_type = other DNA
accgactcgccggcgagtcggtc

SEQ ID NO: 3900 - DNA, 23 bp, synthetic construct
  misc_feature 1..23: note = Description of Artificial Sequence: Syntheticoligonucleotide
  source 1..23: mol_type = other DNA
cacgactcgccggcgagtcgtgc

SEQ ID NO: 3901 - DNA, 23 bp, synthetic construct
  misc_feature 1..23: note = Description of Artificial Sequence: Syntheticoligonucleotide
  source 1..23: mol_type = other DNA
ccagactcgccggcgagtctggc

SEQ ID NO: 3902 - DNA, 23 bp, synthetic construct
  misc_feature 1..23: note = Description of Artificial Sequence: Syntheticoligonucleotide
  source 1..23: mol_type = other DNA
cccgactcgccggcgagtcggga

SEQ ID NO: 3903 - DNA, 23 bp, synthetic construct
  misc_feature 1..23: note = Description of Artificial Sequence: Syntheticoligonucleotide
  source 1..23: mol_type = other DNA
tccgactcgccggcgagtcggac

SEQ ID NO: 3904 - DNA, 23 bp, synthetic construct
  misc_feature 1..23: note = Description of Artificial Sequence: Syntheticoligonucleotide
  source 1..23: mol_type = other DNA
cctgactcgccggcgagtcaggc

SEQ ID NO: 3905 - DNA, 23 bp, synthetic construct
  misc_feature 1..23: note = Description of Artificial Sequence: Syntheticoligonucleotide
  source 1..23: mol_type = other DNA
ggcgactcgccggcgagtcgccc

SEQ ID NO: 3906 - DNA, 23 bp, synthetic construct
  misc_feature 1..23: note = Description of Artificial Sequence: Syntheticoligonucleotide
  source 1..23: mol_type = other DNA
ggcgactcgccggcgagtcgcct

SEQ ID NO: 3907 - DNA, 23 bp, synthetic construct
  misc_feature 1..23: note = Description of Artificial Sequence: Syntheticoligonucleotide
  source 1..23: mol_type = other DNA
agcgactcgccggcgagtcgctc

SEQ ID NO: 3908 - DNA, 23 bp, synthetic construct
  misc_feature 1..23: note = Description of Artificial Sequence: Syntheticoligonucleotide
  source 1..23: mol_type = other DNA
gacgactcgccggcgagtcgtcc

SEQ ID NO: 3909 - DNA, 23 bp, synthetic construct
  misc_feature 1..23: note = Description of Artificial Sequence: Syntheticoligonucleotide
  source 1..23: mol_type = other DNA
ggagactcgccggcgagtctccc

SEQ ID NO: 3910 - DNA, 23 bp, synthetic construct
  misc_feature 1..23: note = Description of Artificial Sequence: Syntheticoligonucleotide
  source 1..23: mol_type = other DNA
ggcgactcgccggcgagtcgcca

SEQ ID NO: 3911 - DNA, 23 bp, synthetic construct
  misc_feature 1..23: note = Description of Artificial Sequence: Syntheticoligonucleotide
  source 1..23: mol_type = other DNA
tgcgactcgccggcgagtcgcac

SEQ ID NO: 3912 - DNA, 23 bp, synthetic construct
  misc_feature 1..23: note = Description of Artificial Sequence: Syntheticoligonucleotide
  source 1..23: mol_type = other DNA
ggtgactcgccggcgagtcaccc

SEQ ID NO: 3913 - DNA, 23 bp, synthetic construct
  misc_feature 1..23: note = Description of Artificial Sequence: Syntheticoligonucleotide
  source 1..23: mol_type = other DNA
cgggactcgccggcgagtcccgt

SEQ ID NO: 3914 - DNA, 23 bp, synthetic construct
  misc_feature 1..23: note = Description of Artificial Sequence: Syntheticoligonucleotide
  source 1..23: mol_type = other DNA
agggactcgccggcgagtccctg

SEQ ID NO: 3915 - DNA, 23 bp, synthetic construct
  misc_feature 1..23: note = Description of Artificial Sequence: Syntheticoligonucleotide
  source 1..23: mol_type = other DNA
caggactcgccggcgagtcctgg

SEQ ID NO: 3916 - DNA, 23 bp, synthetic construct
  misc_feature 1..23: note = Description of Artificial Sequence: Syntheticoligonucleotide
  source 1..23: mol_type = other DNA
cgagactcgccggcgagtctcgg

SEQ ID NO: 3917 - DNA, 23 bp, synthetic construct
  misc_feature 1..23: note = Description of Artificial Sequence: Syntheticoligonucleotide
  source 1..23: mol_type = other DNA
cgggactcgccggcgagtcccga

SEQ ID NO: 3918 - DNA, 23 bp, synthetic construct
  misc_feature 1..23: note = Description of Artificial Sequence: Syntheticoligonucleotide
  source 1..23: mol_type = other DNA
tgggactcgccggcgagtcccag

SEQ ID NO: 3919 - DNA, 23 bp, synthetic construct
  misc_feature 1..23: note = Description of Artificial Sequence: Syntheticoligonucleotide
  source 1..23: mol_type = other DNA
ctggactcgccggcgagtccagg

SEQ ID NO: 3920 - DNA, 23 bp, synthetic construct
  misc_feature 1..23: note = Description of Artificial Sequence: Syntheticoligonucleotide
  source 1..23: mol_type = other DNA
cgtgactcgccggcgagtcacgg

SEQ ID NO: 3921 - DNA, 23 bp, synthetic construct
  misc_feature 1..23: note = Description of Artificial Sequence: Syntheticoligonucleotide
  source 1..23: mol_type = other DNA
ggcgactcgccggcgagtcgccg

SEQ ID NO: 3922 - DNA, 23 bp, synthetic construct
  misc_feature 1..23: note = Description of Artificial Sequence: Syntheticoligonucleotide
  source 1..23: mol_type = other DNA
agcgactcgccggcgagtcgctg

SEQ ID NO: 3923 - DNA, 23 bp, synthetic construct
  misc_feature 1..23: note = Description of Artificial Sequence: Syntheticoligonucleotide
  source 1..23: mol_type = other DNA
gacgactcgccggcgagtcgtcg

SEQ ID NO: 3924 - DNA, 23 bp, synthetic construct
  misc_feature 1..23: note = Description of Artificial Sequence: Syntheticoligonucleotide
  source 1..23: mol_type = other DNA
ggagactcgccggcgagtctccg

SEQ ID NO: 3925 - DNA, 23 bp, synthetic construct
  misc_feature 1..23: note = Description of Artificial Sequence: Syntheticoligonucleotide
  source 1..23: mol_type = other DNA
tgcgactcgccggcgagtcgcag

SEQ ID NO: 3926 - DNA, 23 bp, synthetic construct
  misc_feature 1..23: note = Description of Artificial Sequence: Syntheticoligonucleotide
  source 1..23: mol_type = other DNA
ggtgactcgccggcgagtcaccg

SEQ ID NO: 3927 - DNA, 23 bp, synthetic construct
  misc_feature 1..23: note = Description of Artificial Sequence: Syntheticoligonucleotide
  source 1..23: mol_type = other DNA
acggactcgccggcgagtccgtg

SEQ ID NO: 3928 - DNA, 23 bp, synthetic construct
  misc_feature 1..23: note = Description of Artificial Sequence: Syntheticoligonucleotide
  source 1..23: mol_type = other DNA
ccagactcgccggcgagtctggg

SEQ ID NO: 3929 - DNA, 23 bp, synthetic construct
  misc_feature 1..23: note = Description of Artificial Sequence: Syntheticoligonucleotide
  source 1..23: mol_type = other DNA
tcggactcgccggcgagtccgag

SEQ ID NO: 3930 - DNA, 23 bp, synthetic construct
  misc_feature 1..23: note = Description of Artificial Sequence: Syntheticoligonucleotide
  source 1..23: mol_type = other DNA
cctgactcgccggcgagtcaggg

SEQ ID NO: 3931 - DNA, 23 bp, synthetic construct
  misc_feature 1..23: note = Description of Artificial Sequence: Syntheticoligonucleotide
  source 1..23: mol_type = other DNA
cacgactcgccggcgagtcgtgg

SEQ ID NO: 3932 - DNA, 23 bp, synthetic construct
  misc_feature 1..23: note = Description of Artificial Sequence: Syntheticoligonucleotide
  source 1..23: mol_type = other DNA
gccgactcgccggcgagtcggct

SEQ ID NO: 3933 - DNA, 23 bp, synthetic construct
  misc_feature 1..23: note = Description of Artificial Sequence: Syntheticoligonucleotide
  source 1..23: mol_type = other DNA
gccgactcgccggcgagtcggca

SEQ ID NO: 3934 - DNA, 23 bp, synthetic construct
  misc_feature 1..23: note = Description of Artificial Sequence: Syntheticoligonucleotide
  source 1..23: mol_type = other DNA
cgagactcgccggcgagtctcgc

SEQ ID NO: 3935 - DNA, 23 bp, synthetic construct
  misc_feature 1..23: note = Description of Artificial Sequence: Syntheticoligonucleotide
  source 1..23: mol_type = other DNA
cgtgactcgccggcgagtcacgc

SEQ ID NO: 3936 - DNA, 23 bp, synthetic construct
  misc_feature 1..23: note = Description of Artificial Sequence: Syntheticoligonucleotide
  source 1..23: mol_type = other DNA
caggactcgccggcgagtcctgc

SEQ ID NO: 3937 - DNA, 23 bp, synthetic construct
  misc_feature 1..23: note = Description of Artificial Sequence: Syntheticoligonucleotide
  source 1..23: mol_type = other DNA
ctggactcgccggcgagtccagc

SEQ ID NO: 3938 - DNA, 23 bp, synthetic construct
  misc_feature 1..23: note = Description of Artificial Sequence: Syntheticoligonucleotide
  source 1..23: mol_type = other DNA
gaggactcgccggcgagtcctcg

SEQ ID NO: 3939 - DNA, 23 bp, synthetic construct
  misc_feature 1..23: note = Description of Artificial Sequence: Syntheticoligonucleotide
  source 1..23: mol_type = other DNA
gtggactcgccggcgagtccacg

SEQ ID NO: 3940 - DNA, 23 bp, synthetic construct
  misc_feature 1..23: note = Description of Artificial Sequence: Syntheticoligonucleotide
  source 1..23: mol_type = other DNA
accgactcgccggcgagtcggtg

SEQ ID NO: 3941 - DNA, 23 bp, synthetic construct
  misc_feature 1..23: note = Description of Artificial Sequence: Syntheticoligonucleotide
  source 1..23: mol_type = other DNA
tccgactcgccggcgagtcggag

SEQ ID NO: 3942 - DNA, 23 bp, synthetic construct
  misc_feature 1..23: note = Description of Artificial Sequence: Syntheticoligonucleotide
  source 1..23: mol_type = other DNA
cgggactcgccggcgagtcccgc

SEQ ID NO: 3943 - DNA, 23 bp, synthetic construct
  misc_feature 1..23: note = Description of Artificial Sequence: Syntheticoligonucleotide
  source 1..23: mol_type = other DNA
agggactcgccggcgagtccctc

SEQ ID NO: 3944 - DNA, 23 bp, synthetic construct
  misc_feature 1..23: note = Description of Artificial Sequence: Syntheticoligonucleotide
  source 1..23: mol_type = other DNA
tgggactcgccggcgagtcccac

SEQ ID NO: 3945 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcacatgtgagtcnnnn

SEQ ID NO: 3946 - DNA, 23 bp, synthetic construct
  misc_feature 1..23: note = Description of Artificial Sequence: Syntheticoligonucleotide
  source 1..23: mol_type = other DNA
gcggactcacatgtgagtccgcc

SEQ ID NO: 3947 - DNA, 23 bp, synthetic construct
  misc_feature 1..23: note = Description of Artificial Sequence: Syntheticoligonucleotide
  source 1..23: mol_type = other DNA
gcggactcacatgtgagtccgct

SEQ ID NO: 3948 - DNA, 23 bp, synthetic construct
  misc_feature 1..23: note = Description of Artificial Sequence: Syntheticoligonucleotide
  source 1..23: mol_type = other DNA
acggactcacatgtgagtccgtc

SEQ ID NO: 3949 - DNA, 23 bp, synthetic construct
  misc_feature 1..23: note = Description of Artificial Sequence: Syntheticoligonucleotide
  source 1..23: mol_type = other DNA
gaggactcacatgtgagtcctcc

SEQ ID NO: 3950 - DNA, 23 bp, synthetic construct
  misc_feature 1..23: note = Description of Artificial Sequence: Syntheticoligonucleotide
  source 1..23: mol_type = other DNA
gcagactcacatgtgagtctgcc

SEQ ID NO: 3951 - DNA, 23 bp, synthetic construct
  misc_feature 1..23: note = Description of Artificial Sequence: Syntheticoligonucleotide
  source 1..23: mol_type = other DNA
gcggactcacatgtgagtccgca

SEQ ID NO: 3952 - DNA, 23 bp, synthetic construct
  misc_feature 1..23: note = Description of Artificial Sequence: Syntheticoligonucleotide
  source 1..23: mol_type = other DNA
tcggactcacatgtgagtccgac

SEQ ID NO: 3953 - DNA, 23 bp, synthetic construct
  misc_feature 1..23: note = Description of Artificial Sequence: Syntheticoligonucleotide
  source 1..23: mol_type = other DNA
gtggactcacatgtgagtccacc

SEQ ID NO: 3954 - DNA, 23 bp, synthetic construct
  misc_feature 1..23: note = Description of Artificial Sequence: Syntheticoligonucleotide
  source 1..23: mol_type = other DNA
gctgactcacatgtgagtcagcc

SEQ ID NO: 3955 - DNA, 23 bp, synthetic construct
  misc_feature 1..23: note = Description of Artificial Sequence: Syntheticoligonucleotide
  source 1..23: mol_type = other DNA
cccgactcacatgtgagtcgggc

SEQ ID NO: 3956 - DNA, 23 bp, synthetic construct
  misc_feature 1..23: note = Description of Artificial Sequence: Syntheticoligonucleotide
  source 1..23: mol_type = other DNA
cccgactcacatgtgagtcgggt

SEQ ID NO: 3957 - DNA, 23 bp, synthetic construct
  misc_feature 1..23: note = Description of Artificial Sequence: Syntheticoligonucleotide
  source 1..23: mol_type = other DNA
accgactcacatgtgagtcggtc

SEQ ID NO: 3958 - DNA, 23 bp, synthetic construct
  misc_feature 1..23: note = Description of Artificial Sequence: Syntheticoligonucleotide
  source 1..23: mol_type = other DNA
cacgactcacatgtgagtcgtgc

SEQ ID NO: 3959 - DNA, 23 bp, synthetic construct
  misc_feature 1..23: note = Description of Artificial Sequence: Syntheticoligonucleotide
  source 1..23: mol_type = other DNA
ccagactcacatgtgagtctggc

SEQ ID NO: 3960 - DNA, 23 bp, synthetic construct
  misc_feature 1..23: note = Description of Artificial Sequence: Syntheticoligonucleotide
  source 1..23: mol_type = other DNA
cccgactcacatgtgagtcggga

SEQ ID NO: 3961 - DNA, 23 bp, synthetic construct
  misc_feature 1..23: note = Description of Artificial Sequence: Syntheticoligonucleotide
  source 1..23: mol_type = other DNA
tccgactcacatgtgagtcggac

SEQ ID NO: 3962 - DNA, 23 bp, synthetic construct
  misc_feature 1..23: note = Description of Artificial Sequence: Syntheticoligonucleotide
  source 1..23: mol_type = other DNA
cctgactcacatgtgagtcaggc

SEQ ID NO: 3963 - DNA, 23 bp, synthetic construct
  misc_feature 1..23: note = Description of Artificial Sequence: Syntheticoligonucleotide
  source 1..23: mol_type = other DNA
ggcgactcacatgtgagtcgccc

SEQ ID NO: 3964 - DNA, 23 bp, synthetic construct
  misc_feature 1..23: note = Description of Artificial Sequence: Syntheticoligonucleotide
  source 1..23: mol_type = other DNA
ggcgactcacatgtgagtcgcct

SEQ ID NO: 3965 - DNA, 23 bp, synthetic construct
  misc_feature 1..23: note = Description of Artificial Sequence: Syntheticoligonucleotide
  source 1..23: mol_type = other DNA
agcgactcacatgtgagtcgctc

SEQ ID NO: 3966 - DNA, 23 bp, synthetic construct
  misc_feature 1..23: note = Description of Artificial Sequence: Syntheticoligonucleotide
  source 1..23: mol_type = other DNA
gacgactcacatgtgagtcgtcc

SEQ ID NO: 3967 - DNA, 23 bp, synthetic construct
  misc_feature 1..23: note = Description of Artificial Sequence: Syntheticoligonucleotide
  source 1..23: mol_type = other DNA
ggagactcacatgtgagtctccc

SEQ ID NO: 3968 - DNA, 23 bp, synthetic construct
  misc_feature 1..23: note = Description of Artificial Sequence: Syntheticoligonucleotide
  source 1..23: mol_type = other DNA
ggcgactcacatgtgagtcgcca

SEQ ID NO: 3969 - DNA, 23 bp, synthetic construct
  misc_feature 1..23: note = Description of Artificial Sequence: Syntheticoligonucleotide
  source 1..23: mol_type = other DNA
tgcgactcacatgtgagtcgcac

SEQ ID NO: 3970 - DNA, 23 bp, synthetic construct
  misc_feature 1..23: note = Description of Artificial Sequence: Syntheticoligonucleotide
  source 1..23: mol_type = other DNA
ggtgactcacatgtgagtcaccc

SEQ ID NO: 3971 - DNA, 23 bp, synthetic construct
  misc_feature 1..23: note = Description of Artificial Sequence: Syntheticoligonucleotide
  source 1..23: mol_type = other DNA
cgggactcacatgtgagtcccgt

SEQ ID NO: 3972 - DNA, 23 bp, synthetic construct
  misc_feature 1..23: note = Description of Artificial Sequence: Syntheticoligonucleotide
  source 1..23: mol_type = other DNA
agggactcacatgtgagtccctg

SEQ ID NO: 3973 - DNA, 23 bp, synthetic construct
  misc_feature 1..23: note = Description of Artificial Sequence: Syntheticoligonucleotide
  source 1..23: mol_type = other DNA
caggactcacatgtgagtcctgg

SEQ ID NO: 3974 - DNA, 23 bp, synthetic construct
  misc_feature 1..23: note = Description of Artificial Sequence: Syntheticoligonucleotide
  source 1..23: mol_type = other DNA
cgagactcacatgtgagtctcgg

SEQ ID NO: 3975 - DNA, 23 bp, synthetic construct
  misc_feature 1..23: note = Description of Artificial Sequence: Syntheticoligonucleotide
  source 1..23: mol_type = other DNA
cgggactcacatgtgagtcccga

SEQ ID NO: 3976 - DNA, 23 bp, synthetic construct
  misc_feature 1..23: note = Description of Artificial Sequence: Syntheticoligonucleotide
  source 1..23: mol_type = other DNA
tgggactcacatgtgagtcccag

SEQ ID NO: 3977 - DNA, 23 bp, synthetic construct
  misc_feature 1..23: note = Description of Artificial Sequence: Syntheticoligonucleotide
  source 1..23: mol_type = other DNA
ctggactcacatgtgagtccagg

SEQ ID NO: 3978 - DNA, 23 bp, synthetic construct
  misc_feature 1..23: note = Description of Artificial Sequence: Syntheticoligonucleotide
  source 1..23: mol_type = other DNA
cgtgactcacatgtgagtcacgg

SEQ ID NO: 3979 - DNA, 23 bp, synthetic construct
  misc_feature 1..23: note = Description of Artificial Sequence: Syntheticoligonucleotide
  source 1..23: mol_type = other DNA
ggcgactcacatgtgagtcgccg

SEQ ID NO: 3980 - DNA, 23 bp, synthetic construct
  misc_feature 1..23: note = Description of Artificial Sequence: Syntheticoligonucleotide
  source 1..23: mol_type = other DNA
agcgactcacatgtgagtcgctg

SEQ ID NO: 3981 - DNA, 23 bp, synthetic construct
  misc_feature 1..23: note = Description of Artificial Sequence: Syntheticoligonucleotide
  source 1..23: mol_type = other DNA
gacgactcacatgtgagtcgtcg

SEQ ID NO: 3982 - DNA, 23 bp, synthetic construct
  misc_feature 1..23: note = Description of Artificial Sequence: Syntheticoligonucleotide
  source 1..23: mol_type = other DNA
ggagactcacatgtgagtctccg

SEQ ID NO: 3983 - DNA, 23 bp, synthetic construct
  misc_feature 1..23: note = Description of Artificial Sequence: Syntheticoligonucleotide
  source 1..23: mol_type = other DNA
tgcgactcacatgtgagtcgcag

SEQ ID NO: 3984 - DNA, 23 bp, synthetic construct
  misc_feature 1..23: note = Description of Artificial Sequence: Syntheticoligonucleotide
  source 1..23: mol_type = other DNA
ggtgactcacatgtgagtcaccg

SEQ ID NO: 3985 - DNA, 23 bp, synthetic construct
  misc_feature 1..23: note = Description of Artificial Sequence: Syntheticoligonucleotide
  source 1..23: mol_type = other DNA
acggactcacatgtgagtccgtg

SEQ ID NO: 3986 - DNA, 23 bp, synthetic construct
  misc_feature 1..23: note = Description of Artificial Sequence: Syntheticoligonucleotide
  source 1..23: mol_type = other DNA
ccagactcacatgtgagtctggg

SEQ ID NO: 3987 - DNA, 23 bp, synthetic construct
  misc_feature 1..23: note = Description of Artificial Sequence: Syntheticoligonucleotide
  source 1..23: mol_type = other DNA
tcggactcacatgtgagtccgag

SEQ ID NO: 3988 - DNA, 23 bp, synthetic construct
  misc_feature 1..23: note = Description of Artificial Sequence: Syntheticoligonucleotide
  source 1..23: mol_type = other DNA
cctgactcacatgtgagtcaggg

SEQ ID NO: 3989 - DNA, 23 bp, synthetic construct
  misc_feature 1..23: note = Description of Artificial Sequence: Syntheticoligonucleotide
  source 1..23: mol_type = other DNA
cacgactcacatgtgagtcgtgg

SEQ ID NO: 3990 - DNA, 23 bp, synthetic construct
  misc_feature 1..23: note = Description of Artificial Sequence: Syntheticoligonucleotide
  source 1..23: mol_type = other DNA
gccgactcacatgtgagtcggct

SEQ ID NO: 3991 - DNA, 23 bp, synthetic construct
  misc_feature 1..23: note = Description of Artificial Sequence: Syntheticoligonucleotide
  source 1..23: mol_type = other DNA
gccgactcacatgtgagtcggca

SEQ ID NO: 3992 - DNA, 23 bp, synthetic construct
  misc_feature 1..23: note = Description of Artificial Sequence: Syntheticoligonucleotide
  source 1..23: mol_type = other DNA
cgagactcacatgtgagtctcgc

SEQ ID NO: 3993 - DNA, 23 bp, synthetic construct
  misc_feature 1..23: note = Description of Artificial Sequence: Syntheticoligonucleotide
  source 1..23: mol_type = other DNA
cgtgactcacatgtgagtcacgc

SEQ ID NO: 3994 - DNA, 23 bp, synthetic construct
  misc_feature 1..23: note = Description of Artificial Sequence: Syntheticoligonucleotide
  source 1..23: mol_type = other DNA
caggactcacatgtgagtcctgc

SEQ ID NO: 3995 - DNA, 23 bp, synthetic construct
  misc_feature 1..23: note = Description of Artificial Sequence: Syntheticoligonucleotide
  source 1..23: mol_type = other DNA
ctggactcacatgtgagtccagc

SEQ ID NO: 3996 - DNA, 23 bp, synthetic construct
  misc_feature 1..23: note = Description of Artificial Sequence: Syntheticoligonucleotide
  source 1..23: mol_type = other DNA
gaggactcacatgtgagtcctcg

SEQ ID NO: 3997 - DNA, 23 bp, synthetic construct
  misc_feature 1..23: note = Description of Artificial Sequence: Syntheticoligonucleotide
  source 1..23: mol_type = other DNA
gtggactcacatgtgagtccacg

SEQ ID NO: 3998 - DNA, 23 bp, synthetic construct
  misc_feature 1..23: note = Description of Artificial Sequence: Syntheticoligonucleotide
  source 1..23: mol_type = other DNA
accgactcacatgtgagtcggtg

SEQ ID NO: 3999 - DNA, 23 bp, synthetic construct
  misc_feature 1..23: note = Description of Artificial Sequence: Syntheticoligonucleotide
  source 1..23: mol_type = other DNA
tccgactcacatgtgagtcggag

SEQ ID NO: 4000 - DNA, 23 bp, synthetic construct
  misc_feature 1..23: note = Description of Artificial Sequence: Syntheticoligonucleotide
  source 1..23: mol_type = other DNA
cgggactcacatgtgagtcccgc

SEQ ID NO: 4001 - DNA, 23 bp, synthetic construct
  misc_feature 1..23: note = Description of Artificial Sequence: Syntheticoligonucleotide
  source 1..23: mol_type = other DNA
agggactcacatgtgagtccctc

SEQ ID NO: 4002 - DNA, 23 bp, synthetic construct
  misc_feature 1..23: note = Description of Artificial Sequence: Syntheticoligonucleotide
  source 1..23: mol_type = other DNA
tgggactcacatgtgagtcccac

SEQ ID NO: 4003 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcactagtgagtcnnnn

SEQ ID NO: 4004 - DNA, 23 bp, synthetic construct
  misc_feature 1..23: note = Description of Artificial Sequence: Syntheticoligonucleotide
  source 1..23: mol_type = other DNA
gcggactcactagtgagtccgcc

SEQ ID NO: 4005 - DNA, 23 bp, synthetic construct
  misc_feature 1..23: note = Description of Artificial Sequence: Syntheticoligonucleotide
  source 1..23: mol_type = other DNA
gcggactcactagtgagtccgct

SEQ ID NO: 4006 - DNA, 23 bp, synthetic construct
  misc_feature 1..23: note = Description of Artificial Sequence: Syntheticoligonucleotide
  source 1..23: mol_type = other DNA
acggactcactagtgagtccgtc

SEQ ID NO: 4007 - DNA, 23 bp, synthetic construct
  misc_feature 1..23: note = Description of Artificial Sequence: Syntheticoligonucleotide
  source 1..23: mol_type = other DNA
gaggactcactagtgagtcctcc

SEQ ID NO: 4008 - DNA, 23 bp, synthetic construct
  misc_feature 1..23: note = Description of Artificial Sequence: Syntheticoligonucleotide
  source 1..23: mol_type = other DNA
gcagactcactagtgagtctgcc

SEQ ID NO: 4009 - DNA, 23 bp, synthetic construct
  misc_feature 1..23: note = Description of Artificial Sequence: Syntheticoligonucleotide
  source 1..23: mol_type = other DNA
gcggactcactagtgagtccgca

SEQ ID NO: 4010 - DNA, 23 bp, synthetic construct
  misc_feature 1..23: note = Description of Artificial Sequence: Syntheticoligonucleotide
  source 1..23: mol_type = other DNA
tcggactcactagtgagtccgac

SEQ ID NO: 4011 - DNA, 23 bp, synthetic construct
  misc_feature 1..23: note = Description of Artificial Sequence: Syntheticoligonucleotide
  source 1..23: mol_type = other DNA
gtggactcactagtgagtccacc

SEQ ID NO: 4012 - DNA, 23 bp, synthetic construct
  misc_feature 1..23: note = Description of Artificial Sequence: Syntheticoligonucleotide
  source 1..23: mol_type = other DNA
gctgactcactagtgagtcagcc

SEQ ID NO: 4013 - DNA, 23 bp, synthetic construct
  misc_feature 1..23: note = Description of Artificial Sequence: Syntheticoligonucleotide
  source 1..23: mol_type = other DNA
cccgactcactagtgagtcgggc

SEQ ID NO: 4014 - DNA, 23 bp, synthetic construct
  misc_feature 1..23: note = Description of Artificial Sequence: Syntheticoligonucleotide
  source 1..23: mol_type = other DNA
cccgactcactagtgagtcgggt

SEQ ID NO: 4015 - DNA, 23 bp, synthetic construct
  misc_feature 1..23: note = Description of Artificial Sequence: Syntheticoligonucleotide
  source 1..23: mol_type = other DNA
accgactcactagtgagtcggtc

SEQ ID NO: 4016 - DNA, 23 bp, synthetic construct
  misc_feature 1..23: note = Description of Artificial Sequence: Syntheticoligonucleotide
  source 1..23: mol_type = other DNA
cacgactcactagtgagtcgtgc

SEQ ID NO: 4017 - DNA, 23 bp, synthetic construct
  misc_feature 1..23: note = Description of Artificial Sequence: Syntheticoligonucleotide
  source 1..23: mol_type = other DNA
ccagactcactagtgagtctggc

SEQ ID NO: 4018 - DNA, 23 bp, synthetic construct
  misc_feature 1..23: note = Description of Artificial Sequence: Syntheticoligonucleotide
  source 1..23: mol_type = other DNA
cccgactcactagtgagtcggga

SEQ ID NO: 4019 - DNA, 23 bp, synthetic construct
  misc_feature 1..23: note = Description of Artificial Sequence: Syntheticoligonucleotide
  source 1..23: mol_type = other DNA
tccgactcactagtgagtcggac

SEQ ID NO: 4020 - DNA, 23 bp, synthetic construct
  misc_feature 1..23: note = Description of Artificial Sequence: Syntheticoligonucleotide
  source 1..23: mol_type = other DNA
cctgactcactagtgagtcaggc

SEQ ID NO: 4021 - DNA, 23 bp, synthetic construct
  misc_feature 1..23: note = Description of Artificial Sequence: Syntheticoligonucleotide
  source 1..23: mol_type = other DNA
ggcgactcactagtgagtcgccc

SEQ ID NO: 4022 - DNA, 23 bp, synthetic construct
  misc_feature 1..23: note = Description of Artificial Sequence: Syntheticoligonucleotide
  source 1..23: mol_type = other DNA
ggcgactcactagtgagtcgcct

SEQ ID NO: 4023 - DNA, 23 bp, synthetic construct
  misc_feature 1..23: note = Description of Artificial Sequence: Syntheticoligonucleotide
  source 1..23: mol_type = other DNA
agcgactcactagtgagtcgctc

SEQ ID NO: 4024 - DNA, 23 bp, synthetic construct
  misc_feature 1..23: note = Description of Artificial Sequence: Syntheticoligonucleotide
  source 1..23: mol_type = other DNA
gacgactcactagtgagtcgtcc

SEQ ID NO: 4025 - DNA, 23 bp, synthetic construct
  misc_feature 1..23: note = Description of Artificial Sequence: Syntheticoligonucleotide
  source 1..23: mol_type = other DNA
ggagactcactagtgagtctccc

SEQ ID NO: 4026 - DNA, 23 bp, synthetic construct
  misc_feature 1..23: note = Description of Artificial Sequence: Syntheticoligonucleotide
  source 1..23: mol_type = other DNA
ggcgactcactagtgagtcgcca

SEQ ID NO: 4027 - DNA, 23 bp, synthetic construct
  misc_feature 1..23: note = Description of Artificial Sequence: Syntheticoligonucleotide
  source 1..23: mol_type = other DNA
tgcgactcactagtgagtcgcac

SEQ ID NO: 4028 - DNA, 23 bp, synthetic construct
  misc_feature 1..23: note = Description of Artificial Sequence: Syntheticoligonucleotide
  source 1..23: mol_type = other DNA
ggtgactcactagtgagtcaccc

SEQ ID NO: 4029 - DNA, 23 bp, synthetic construct
  misc_feature 1..23: note = Description of Artificial Sequence: Syntheticoligonucleotide
  source 1..23: mol_type = other DNA
cgggactcactagtgagtcccgt

SEQ ID NO: 4030 - DNA, 23 bp, synthetic construct
  misc_feature 1..23: note = Description of Artificial Sequence: Syntheticoligonucleotide
  source 1..23: mol_type = other DNA
agggactcactagtgagtccctg

SEQ ID NO: 4031 - DNA, 23 bp, synthetic construct
  misc_feature 1..23: note = Description of Artificial Sequence: Syntheticoligonucleotide
  source 1..23: mol_type = other DNA
caggactcactagtgagtcctgg

SEQ ID NO: 4032 - DNA, 23 bp, synthetic construct
  misc_feature 1..23: note = Description of Artificial Sequence: Syntheticoligonucleotide
  source 1..23: mol_type = other DNA
cgagactcactagtgagtctcgg

SEQ ID NO: 4033 - DNA, 23 bp, synthetic construct
  misc_feature 1..23: note = Description of Artificial Sequence: Syntheticoligonucleotide
  source 1..23: mol_type = other DNA
cgggactcactagtgagtcccga

SEQ ID NO: 4034 - DNA, 23 bp, synthetic construct
  misc_feature 1..23: note = Description of Artificial Sequence: Syntheticoligonucleotide
  source 1..23: mol_type = other DNA
tgggactcactagtgagtcccag

SEQ ID NO: 4035 - DNA, 23 bp, synthetic construct
  misc_feature 1..23: note = Description of Artificial Sequence: Syntheticoligonucleotide
  source 1..23: mol_type = other DNA
ctggactcactagtgagtccagg

SEQ ID NO: 4036 - DNA, 23 bp, synthetic construct
  misc_feature 1..23: note = Description of Artificial Sequence: Syntheticoligonucleotide
  source 1..23: mol_type = other DNA
cgtgactcactagtgagtcacgg

SEQ ID NO: 4037 - DNA, 23 bp, synthetic construct
  misc_feature 1..23: note = Description of Artificial Sequence: Syntheticoligonucleotide
  source 1..23: mol_type = other DNA
ggcgactcactagtgagtcgccg

SEQ ID NO: 4038 - DNA, 23 bp, synthetic construct
  misc_feature 1..23: note = Description of Artificial Sequence: Syntheticoligonucleotide
  source 1..23: mol_type = other DNA
agcgactcactagtgagtcgctg

SEQ ID NO: 4039 - DNA, 23 bp, synthetic construct
  misc_feature 1..23: note = Description of Artificial Sequence: Syntheticoligonucleotide
  source 1..23: mol_type = other DNA
gacgactcactagtgagtcgtcg

SEQ ID NO: 4040 - DNA, 23 bp, synthetic construct
  misc_feature 1..23: note = Description of Artificial Sequence: Syntheticoligonucleotide
  source 1..23: mol_type = other DNA
ggagactcactagtgagtctccg

SEQ ID NO: 4041 - DNA, 23 bp, synthetic construct
  misc_feature 1..23: note = Description of Artificial Sequence: Syntheticoligonucleotide
  source 1..23: mol_type = other DNA
tgcgactcactagtgagtcgcag

SEQ ID NO: 4042 - DNA, 23 bp, synthetic construct
  misc_feature 1..23: note = Description of Artificial Sequence: Syntheticoligonucleotide
  source 1..23: mol_type = other DNA
ggtgactcactagtgagtcaccg

SEQ ID NO: 4043 - DNA, 23 bp, synthetic construct
  misc_feature 1..23: note = Description of Artificial Sequence: Syntheticoligonucleotide
  source 1..23: mol_type = other DNA
acggactcactagtgagtccgtg

SEQ ID NO: 4044 - DNA, 23 bp, synthetic construct
  misc_feature 1..23: note = Description of Artificial Sequence: Syntheticoligonucleotide
  source 1..23: mol_type = other DNA
ccagactcactagtgagtctggg

SEQ ID NO: 4045 - DNA, 23 bp, synthetic construct
  misc_feature 1..23: note = Description of Artificial Sequence: Syntheticoligonucleotide
  source 1..23: mol_type = other DNA
tcggactcactagtgagtccgag

SEQ ID NO: 4046 - DNA, 23 bp, synthetic construct
  misc_feature 1..23: note = Description of Artificial Sequence: Syntheticoligonucleotide
  source 1..23: mol_type = other DNA
cctgactcactagtgagtcaggg

SEQ ID NO: 4047 - DNA, 23 bp, synthetic construct
  misc_feature 1..23: note = Description of Artificial Sequence: Syntheticoligonucleotide
  source 1..23: mol_type = other DNA
cacgactcactagtgagtcgtgg

SEQ ID NO: 4048 - DNA, 23 bp, synthetic construct
  misc_feature 1..23: note = Description of Artificial Sequence: Syntheticoligonucleotide
  source 1..23: mol_type = other DNA
gccgactcactagtgagtcggct

SEQ ID NO: 4049 - DNA, 23 bp, synthetic construct
  misc_feature 1..23: note = Description of Artificial Sequence: Syntheticoligonucleotide
  source 1..23: mol_type = other DNA
gccgactcactagtgagtcggca

SEQ ID NO: 4050 - DNA, 23 bp, synthetic construct
  misc_feature 1..23: note = Description of Artificial Sequence: Syntheticoligonucleotide
  source 1..23: mol_type = other DNA
cgagactcactagtgagtctcgc

SEQ ID NO: 4051 - DNA, 23 bp, synthetic construct
  misc_feature 1..23: note = Description of Artificial Sequence: Syntheticoligonucleotide
  source 1..23: mol_type = other DNA
cgtgactcactagtgagtcacgc

SEQ ID NO: 4052 - DNA, 23 bp, synthetic construct
  misc_feature 1..23: note = Description of Artificial Sequence: Syntheticoligonucleotide
  source 1..23: mol_type = other DNA
caggactcactagtgagtcctgc

SEQ ID NO: 4053 - DNA, 23 bp, synthetic construct
  misc_feature 1..23: note = Description of Artificial Sequence: Syntheticoligonucleotide
  source 1..23: mol_type = other DNA
ctggactcactagtgagtccagc

SEQ ID NO: 4054 - DNA, 23 bp, synthetic construct
  misc_feature 1..23: note = Description of Artificial Sequence: Syntheticoligonucleotide
  source 1..23: mol_type = other DNA
gaggactcactagtgagtcctcg

SEQ ID NO: 4055 - DNA, 23 bp, synthetic construct
  misc_feature 1..23: note = Description of Artificial Sequence: Syntheticoligonucleotide
  source 1..23: mol_type = other DNA
gtggactcactagtgagtccacg

SEQ ID NO: 4056 - DNA, 23 bp, synthetic construct
  misc_feature 1..23: note = Description of Artificial Sequence: Syntheticoligonucleotide
  source 1..23: mol_type = other DNA
accgactcactagtgagtcggtg

SEQ ID NO: 4057 - DNA, 23 bp, synthetic construct
  misc_feature 1..23: note = Description of Artificial Sequence: Syntheticoligonucleotide
  source 1..23: mol_type = other DNA
tccgactcactagtgagtcggag

SEQ ID NO: 4058 - DNA, 23 bp, synthetic construct
  misc_feature 1..23: note = Description of Artificial Sequence: Syntheticoligonucleotide
  source 1..23: mol_type = other DNA
cgggactcactagtgagtcccgc

SEQ ID NO: 4059 - DNA, 23 bp, synthetic construct
  misc_feature 1..23: note = Description of Artificial Sequence: Syntheticoligonucleotide
  source 1..23: mol_type = other DNA
agggactcactagtgagtccctc

SEQ ID NO: 4060 - DNA, 23 bp, synthetic construct
  misc_feature 1..23: note = Description of Artificial Sequence: Syntheticoligonucleotide
  source 1..23: mol_type = other DNA
tgggactcactagtgagtcccac

SEQ ID NO: 4061 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcacgcgtgagtcnnnn

SEQ ID NO: 4062 - DNA, 23 bp, synthetic construct
  misc_feature 1..23: note = Description of Artificial Sequence: Syntheticoligonucleotide
  source 1..23: mol_type = other DNA
gcggactcacgcgtgagtccgcc

SEQ ID NO: 4063 - DNA, 23 bp, synthetic construct
  misc_feature 1..23: note = Description of Artificial Sequence: Syntheticoligonucleotide
  source 1..23: mol_type = other DNA
gcggactcacgcgtgagtccgct

SEQ ID NO: 4064 - DNA, 23 bp, synthetic construct
  misc_feature 1..23: note = Description of Artificial Sequence: Syntheticoligonucleotide
  source 1..23: mol_type = other DNA
acggactcacgcgtgagtccgtc

SEQ ID NO: 4065 - DNA, 23 bp, synthetic construct
  misc_feature 1..23: note = Description of Artificial Sequence: Syntheticoligonucleotide
  source 1..23: mol_type = other DNA
gaggactcacgcgtgagtcctcc

SEQ ID NO: 4066 - DNA, 23 bp, synthetic construct
  misc_feature 1..23: note = Description of Artificial Sequence: Syntheticoligonucleotide
  source 1..23: mol_type = other DNA
gcagactcacgcgtgagtctgcc

SEQ ID NO: 4067 - DNA, 23 bp, synthetic construct
  misc_feature 1..23: note = Description of Artificial Sequence: Syntheticoligonucleotide
  source 1..23: mol_type = other DNA
gcggactcacgcgtgagtccgca

SEQ ID NO: 4068 - DNA, 23 bp, synthetic construct
  misc_feature 1..23: note = Description of Artificial Sequence: Syntheticoligonucleotide
  source 1..23: mol_type = other DNA
tcggactcacgcgtgagtccgac

SEQ ID NO: 4069 - DNA, 23 bp, synthetic construct
  misc_feature 1..23: note = Description of Artificial Sequence: Syntheticoligonucleotide
  source 1..23: mol_type = other DNA
gtggactcacgcgtgagtccacc

SEQ ID NO: 4070 - DNA, 23 bp, synthetic construct
  misc_feature 1..23: note = Description of Artificial Sequence: Syntheticoligonucleotide
  source 1..23: mol_type = other DNA
gctgactcacgcgtgagtcagcc

SEQ ID NO: 4071 - DNA, 23 bp, synthetic construct
  misc_feature 1..23: note = Description of Artificial Sequence: Syntheticoligonucleotide
  source 1..23: mol_type = other DNA
cccgactcacgcgtgagtcgggc

SEQ ID NO: 4072 - DNA, 23 bp, synthetic construct
  misc_feature 1..23: note = Description of Artificial Sequence: Syntheticoligonucleotide
  source 1..23: mol_type = other DNA
cccgactcacgcgtgagtcgggt

SEQ ID NO: 4073 - DNA, 23 bp, synthetic construct
  misc_feature 1..23: note = Description of Artificial Sequence: Syntheticoligonucleotide
  source 1..23: mol_type = other DNA
accgactcacgcgtgagtcggtc

SEQ ID NO: 4074 - DNA, 23 bp, synthetic construct
  misc_feature 1..23: note = Description of Artificial Sequence: Syntheticoligonucleotide
  source 1..23: mol_type = other DNA
cacgactcacgcgtgagtcgtgc

SEQ ID NO: 4075 - DNA, 23 bp, synthetic construct
  misc_feature 1..23: note = Description of Artificial Sequence: Syntheticoligonucleotide
  source 1..23: mol_type = other DNA
ccagactcacgcgtgagtctggc

SEQ ID NO: 4076 - DNA, 23 bp, synthetic construct
  misc_feature 1..23: note = Description of Artificial Sequence: Syntheticoligonucleotide
  source 1..23: mol_type = other DNA
cccgactcacgcgtgagtcggga

SEQ ID NO: 4077 - DNA, 23 bp, synthetic construct
  misc_feature 1..23: note = Description of Artificial Sequence: Syntheticoligonucleotide
  source 1..23: mol_type = other DNA
tccgactcacgcgtgagtcggac

SEQ ID NO: 4078 - DNA, 23 bp, synthetic construct
  misc_feature 1..23: note = Description of Artificial Sequence: Syntheticoligonucleotide
  source 1..23: mol_type = other DNA
cctgactcacgcgtgagtcaggc

SEQ ID NO: 4079 - DNA, 23 bp, synthetic construct
  misc_feature 1..23: note = Description of Artificial Sequence: Syntheticoligonucleotide
  source 1..23: mol_type = other DNA
ggcgactcacgcgtgagtcgccc

SEQ ID NO: 4080 - DNA, 23 bp, synthetic construct
  misc_feature 1..23: note = Description of Artificial Sequence: Syntheticoligonucleotide
  source 1..23: mol_type = other DNA
ggcgactcacgcgtgagtcgcct

SEQ ID NO: 4081 - DNA, 23 bp, synthetic construct
  misc_feature 1..23: note = Description of Artificial Sequence: Syntheticoligonucleotide
  source 1..23: mol_type = other DNA
agcgactcacgcgtgagtcgctc

SEQ ID NO: 4082 - DNA, 23 bp, synthetic construct
  misc_feature 1..23: note = Description of Artificial Sequence: Syntheticoligonucleotide
  source 1..23: mol_type = other DNA
gacgactcacgcgtgagtcgtcc

SEQ ID NO: 4083 - DNA, 23 bp, synthetic construct
  misc_feature 1..23: note = Description of Artificial Sequence: Syntheticoligonucleotide
  source 1..23: mol_type = other DNA
ggagactcacgcgtgagtctccc

SEQ ID NO: 4084 - DNA, 23 bp, synthetic construct
  misc_feature 1..23: note = Description of Artificial Sequence: Syntheticoligonucleotide
  source 1..23: mol_type = other DNA
ggcgactcacgcgtgagtcgcca

SEQ ID NO: 4085 - DNA, 23 bp, synthetic construct
  misc_feature 1..23: note = Description of Artificial Sequence: Syntheticoligonucleotide
  source 1..23: mol_type = other DNA
tgcgactcacgcgtgagtcgcac

SEQ ID NO: 4086 - DNA, 23 bp, synthetic construct
  misc_feature 1..23: note = Description of Artificial Sequence: Syntheticoligonucleotide
  source 1..23: mol_type = other DNA
ggtgactcacgcgtgagtcaccc

SEQ ID NO: 4087 - DNA, 23 bp, synthetic construct
  misc_feature 1..23: note = Description of Artificial Sequence: Syntheticoligonucleotide
  source 1..23: mol_type = other DNA
cgggactcacgcgtgagtcccgt

SEQ ID NO: 4088 - DNA, 23 bp, synthetic construct
  misc_feature 1..23: note = Description of Artificial Sequence: Syntheticoligonucleotide
  source 1..23: mol_type = other DNA
agggactcacgcgtgagtccctg

SEQ ID NO: 4089 - DNA, 23 bp, synthetic construct
  misc_feature 1..23: note = Description of Artificial Sequence: Syntheticoligonucleotide
  source 1..23: mol_type = other DNA
caggactcacgcgtgagtcctgg

SEQ ID NO: 4090 - DNA, 23 bp, synthetic construct
  misc_feature 1..23: note = Description of Artificial Sequence: Syntheticoligonucleotide
  source 1..23: mol_type = other DNA
cgagactcacgcgtgagtctcgg

SEQ ID NO: 4091 - DNA, 23 bp, synthetic construct
  misc_feature 1..23: note = Description of Artificial Sequence: Syntheticoligonucleotide
  source 1..23: mol_type = other DNA
cgggactcacgcgtgagtcccga

SEQ ID NO: 4092 - DNA, 23 bp, synthetic construct
  misc_feature 1..23: note = Description of Artificial Sequence: Syntheticoligonucleotide
  source 1..23: mol_type = other DNA
tgggactcacgcgtgagtcccag

SEQ ID NO: 4093 - DNA, 23 bp, synthetic construct
  misc_feature 1..23: note = Description of Artificial Sequence: Syntheticoligonucleotide
  source 1..23: mol_type = other DNA
ctggactcacgcgtgagtccagg

SEQ ID NO: 4094 - DNA, 23 bp, synthetic construct
  misc_feature 1..23: note = Description of Artificial Sequence: Syntheticoligonucleotide
  source 1..23: mol_type = other DNA
cgtgactcacgcgtgagtcacgg

SEQ ID NO: 4095 - DNA, 23 bp, synthetic construct
  misc_feature 1..23: note = Description of Artificial Sequence: Syntheticoligonucleotide
  source 1..23: mol_type = other DNA
ggcgactcacgcgtgagtcgccg

SEQ ID NO: 4096 - DNA, 23 bp, synthetic construct
  misc_feature 1..23: note = Description of Artificial Sequence: Syntheticoligonucleotide
  source 1..23: mol_type = other DNA
agcgactcacgcgtgagtcgctg

SEQ ID NO: 4097 - DNA, 23 bp, synthetic construct
  misc_feature 1..23: note = Description of Artificial Sequence: Syntheticoligonucleotide
  source 1..23: mol_type = other DNA
gacgactcacgcgtgagtcgtcg

SEQ ID NO: 4098 - DNA, 23 bp, synthetic construct
  misc_feature 1..23: note = Description of Artificial Sequence: Syntheticoligonucleotide
  source 1..23: mol_type = other DNA
ggagactcacgcgtgagtctccg

SEQ ID NO: 4099 - DNA, 23 bp, synthetic construct
  misc_feature 1..23: note = Description of Artificial Sequence: Syntheticoligonucleotide
  source 1..23: mol_type = other DNA
tgcgactcacgcgtgagtcgcag

SEQ ID NO: 4100 - DNA, 23 bp, synthetic construct
  misc_feature 1..23: note = Description of Artificial Sequence: Syntheticoligonucleotide
  source 1..23: mol_type = other DNA
ggtgactcacgcgtgagtcaccg

SEQ ID NO: 4101 - DNA, 23 bp, synthetic construct
  misc_feature 1..23: note = Description of Artificial Sequence: Syntheticoligonucleotide
  source 1..23: mol_type = other DNA
acggactcacgcgtgagtccgtg

SEQ ID NO: 4102 - DNA, 23 bp, synthetic construct
  misc_feature 1..23: note = Description of Artificial Sequence: Syntheticoligonucleotide
  source 1..23: mol_type = other DNA
ccagactcacgcgtgagtctggg

SEQ ID NO: 4103 - DNA, 23 bp, synthetic construct
  misc_feature 1..23: note = Description of Artificial Sequence: Syntheticoligonucleotide
  source 1..23: mol_type = other DNA
tcggactcacgcgtgagtccgag

SEQ ID NO: 4104 - DNA, 23 bp, synthetic construct
  misc_feature 1..23: note = Description of Artificial Sequence: Syntheticoligonucleotide
  source 1..23: mol_type = other DNA
cctgactcacgcgtgagtcaggg

SEQ ID NO: 4105 - DNA, 23 bp, synthetic construct
  misc_feature 1..23: note = Description of Artificial Sequence: Syntheticoligonucleotide
  source 1..23: mol_type = other DNA
cacgactcacgcgtgagtcgtgg

SEQ ID NO: 4106 - DNA, 23 bp, synthetic construct
  misc_feature 1..23: note = Description of Artificial Sequence: Syntheticoligonucleotide
  source 1..23: mol_type = other DNA
gccgactcacgcgtgagtcggct

SEQ ID NO: 4107 - DNA, 23 bp, synthetic construct
  misc_feature 1..23: note = Description of Artificial Sequence: Syntheticoligonucleotide
  source 1..23: mol_type = other DNA
gccgactcacgcgtgagtcggca

SEQ ID NO: 4108 - DNA, 23 bp, synthetic construct
  misc_feature 1..23: note = Description of Artificial Sequence: Syntheticoligonucleotide
  source 1..23: mol_type = other DNA
cgagactcacgcgtgagtctcgc

SEQ ID NO: 4109 - DNA, 23 bp, synthetic construct
  misc_feature 1..23: note = Description of Artificial Sequence: Syntheticoligonucleotide
  source 1..23: mol_type = other DNA
cgtgactcacgcgtgagtcacgc

SEQ ID NO: 4110 - DNA, 23 bp, synthetic construct
  misc_feature 1..23: note = Description of Artificial Sequence: Syntheticoligonucleotide
  source 1..23: mol_type = other DNA
caggactcacgcgtgagtcctgc

SEQ ID NO: 4111 - DNA, 23 bp, synthetic construct
  misc_feature 1..23: note = Description of Artificial Sequence: Syntheticoligonucleotide
  source 1..23: mol_type = other DNA
ctggactcacgcgtgagtccagc

SEQ ID NO: 4112 - DNA, 23 bp, synthetic construct
  misc_feature 1..23: note = Description of Artificial Sequence: Syntheticoligonucleotide
  source 1..23: mol_type = other DNA
gaggactcacgcgtgagtcctcg

SEQ ID NO: 4113 - DNA, 23 bp, synthetic construct
  misc_feature 1..23: note = Description of Artificial Sequence: Syntheticoligonucleotide
  source 1..23: mol_type = other DNA
gtggactcacgcgtgagtccacg

SEQ ID NO: 4114 - DNA, 23 bp, synthetic construct
  misc_feature 1..23: note = Description of Artificial Sequence: Syntheticoligonucleotide
  source 1..23: mol_type = other DNA
accgactcacgcgtgagtcggtg

SEQ ID NO: 4115 - DNA, 23 bp, synthetic construct
  misc_feature 1..23: note = Description of Artificial Sequence: Syntheticoligonucleotide
  source 1..23: mol_type = other DNA
tccgactcacgcgtgagtcggag

SEQ ID NO: 4116 - DNA, 23 bp, synthetic construct
  misc_feature 1..23: note = Description of Artificial Sequence: Syntheticoligonucleotide
  source 1..23: mol_type = other DNA
cgggactcacgcgtgagtcccgc

SEQ ID NO: 4117 - DNA, 23 bp, synthetic construct
  misc_feature 1..23: note = Description of Artificial Sequence: Syntheticoligonucleotide
  source 1..23: mol_type = other DNA
agggactcacgcgtgagtccctc

SEQ ID NO: 4118 - DNA, 23 bp, synthetic construct
  misc_feature 1..23: note = Description of Artificial Sequence: Syntheticoligonucleotide
  source 1..23: mol_type = other DNA
tgggactcacgcgtgagtcccac

SEQ ID NO: 4119 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcaccggtgagtcnnnn

SEQ ID NO: 4120 - DNA, 23 bp, synthetic construct
  misc_feature 1..23: note = Description of Artificial Sequence: Syntheticoligonucleotide
  source 1..23: mol_type = other DNA
gcggactcaccggtgagtccgcc

SEQ ID NO: 4121 - DNA, 23 bp, synthetic construct
  misc_feature 1..23: note = Description of Artificial Sequence: Syntheticoligonucleotide
  source 1..23: mol_type = other DNA
gcggactcaccggtgagtccgct

SEQ ID NO: 4122 - DNA, 23 bp, synthetic construct
  misc_feature 1..23: note = Description of Artificial Sequence: Syntheticoligonucleotide
  source 1..23: mol_type = other DNA
acggactcaccggtgagtccgtc

SEQ ID NO: 4123 - DNA, 23 bp, synthetic construct
  misc_feature 1..23: note = Description of Artificial Sequence: Syntheticoligonucleotide
  source 1..23: mol_type = other DNA
gaggactcaccggtgagtcctcc

SEQ ID NO: 4124 - DNA, 23 bp, synthetic construct
  misc_feature 1..23: note = Description of Artificial Sequence: Syntheticoligonucleotide
  source 1..23: mol_type = other DNA
gcagactcaccggtgagtctgcc

SEQ ID NO: 4125 - DNA, 23 bp, synthetic construct
  misc_feature 1..23: note = Description of Artificial Sequence: Syntheticoligonucleotide
  source 1..23: mol_type = other DNA
gcggactcaccggtgagtccgca

SEQ ID NO: 4126 - DNA, 23 bp, synthetic construct
  misc_feature 1..23: note = Description of Artificial Sequence: Syntheticoligonucleotide
  source 1..23: mol_type = other DNA
tcggactcaccggtgagtccgac

SEQ ID NO: 4127 - DNA, 23 bp, synthetic construct
  misc_feature 1..23: note = Description of Artificial Sequence: Syntheticoligonucleotide
  source 1..23: mol_type = other DNA
gtggactcaccggtgagtccacc

SEQ ID NO: 4128 - DNA, 23 bp, synthetic construct
  misc_feature 1..23: note = Description of Artificial Sequence: Syntheticoligonucleotide
  source 1..23: mol_type = other DNA
gctgactcaccggtgagtcagcc

SEQ ID NO: 4129 - DNA, 23 bp, synthetic construct
  misc_feature 1..23: note = Description of Artificial Sequence: Syntheticoligonucleotide
  source 1..23: mol_type = other DNA
cccgactcaccggtgagtcgggc

SEQ ID NO: 4130 - DNA, 23 bp, synthetic construct
  misc_feature 1..23: note = Description of Artificial Sequence: Syntheticoligonucleotide
  source 1..23: mol_type = other DNA
cccgactcaccggtgagtcgggt

SEQ ID NO: 4131 - DNA, 23 bp, synthetic construct
  misc_feature 1..23: note = Description of Artificial Sequence: Syntheticoligonucleotide
  source 1..23: mol_type = other DNA
accgactcaccggtgagtcggtc

SEQ ID NO: 4132 - DNA, 23 bp, synthetic construct
  misc_feature 1..23: note = Description of Artificial Sequence: Syntheticoligonucleotide
  source 1..23: mol_type = other DNA
cacgactcaccggtgagtcgtgc

SEQ ID NO: 4133 - DNA, 23 bp, synthetic construct
  misc_feature 1..23: note = Description of Artificial Sequence: Syntheticoligonucleotide
  source 1..23: mol_type = other DNA
ccagactcaccggtgagtctggc

SEQ ID NO: 4134 - DNA, 23 bp, synthetic construct
  misc_feature 1..23: note = Description of Artificial Sequence: Syntheticoligonucleotide
  source 1..23: mol_type = other DNA
cccgactcaccggtgagtcggga

SEQ ID NO: 4135 - DNA, 23 bp, synthetic construct
  misc_feature 1..23: note = Description of Artificial Sequence: Syntheticoligonucleotide
  source 1..23: mol_type = other DNA
tccgactcaccggtgagtcggac

SEQ ID NO: 4136 - DNA, 23 bp, synthetic construct
  misc_feature 1..23: note = Description of Artificial Sequence: Syntheticoligonucleotide
  source 1..23: mol_type = other DNA
cctgactcaccggtgagtcaggc

SEQ ID NO: 4137 - DNA, 23 bp, synthetic construct
  misc_feature 1..23: note = Description of Artificial Sequence: Syntheticoligonucleotide
  source 1..23: mol_type = other DNA
ggcgactcaccggtgagtcgccc

SEQ ID NO: 4138 - DNA, 23 bp, synthetic construct
  misc_feature 1..23: note = Description of Artificial Sequence: Syntheticoligonucleotide
  source 1..23: mol_type = other DNA
ggcgactcaccggtgagtcgcct

SEQ ID NO: 4139 - DNA, 23 bp, synthetic construct
  misc_feature 1..23: note = Description of Artificial Sequence: Syntheticoligonucleotide
  source 1..23: mol_type = other DNA
agcgactcaccggtgagtcgctc

SEQ ID NO: 4140 - DNA, 23 bp, synthetic construct
  misc_feature 1..23: note = Description of Artificial Sequence: Syntheticoligonucleotide
  source 1..23: mol_type = other DNA
gacgactcaccggtgagtcgtcc

SEQ ID NO: 4141 - DNA, 23 bp, synthetic construct
  misc_feature 1..23: note = Description of Artificial Sequence: Syntheticoligonucleotide
  source 1..23: mol_type = other DNA
ggagactcaccggtgagtctccc

SEQ ID NO: 4142 - DNA, 23 bp, synthetic construct
  misc_feature 1..23: note = Description of Artificial Sequence: Syntheticoligonucleotide
  source 1..23: mol_type = other DNA
ggcgactcaccggtgagtcgcca

SEQ ID NO: 4143 - DNA, 23 bp, synthetic construct
  misc_feature 1..23: note = Description of Artificial Sequence: Syntheticoligonucleotide
  source 1..23: mol_type = other DNA
tgcgactcaccggtgagtcgcac

SEQ ID NO: 4144 - DNA, 23 bp, synthetic construct
  misc_feature 1..23: note = Description of Artificial Sequence: Syntheticoligonucleotide
  source 1..23: mol_type = other DNA
ggtgactcaccggtgagtcaccc

SEQ ID NO: 4145 - DNA, 23 bp, synthetic construct
  misc_feature 1..23: note = Description of Artificial Sequence: Syntheticoligonucleotide
  source 1..23: mol_type = other DNA
cgggactcaccggtgagtcccgt

SEQ ID NO: 4146 - DNA, 23 bp, synthetic construct
  misc_feature 1..23: note = Description of Artificial Sequence: Syntheticoligonucleotide
  source 1..23: mol_type = other DNA
agggactcaccggtgagtccctg

SEQ ID NO: 4147 - DNA, 23 bp, synthetic construct
  misc_feature 1..23: note = Description of Artificial Sequence: Syntheticoligonucleotide
  source 1..23: mol_type = other DNA
caggactcaccggtgagtcctgg

SEQ ID NO: 4148 - DNA, 23 bp, synthetic construct
  misc_feature 1..23: note = Description of Artificial Sequence: Syntheticoligonucleotide
  source 1..23: mol_type = other DNA
cgagactcaccggtgagtctcgg

SEQ ID NO: 4149 - DNA, 23 bp, synthetic construct
  misc_feature 1..23: note = Description of Artificial Sequence: Syntheticoligonucleotide
  source 1..23: mol_type = other DNA
cgggactcaccggtgagtcccga

SEQ ID NO: 4150 - DNA, 23 bp, synthetic construct
  misc_feature 1..23: note = Description of Artificial Sequence: Syntheticoligonucleotide
  source 1..23: mol_type = other DNA
tgggactcaccggtgagtcccag

SEQ ID NO: 4151 - DNA, 23 bp, synthetic construct
  misc_feature 1..23: note = Description of Artificial Sequence: Syntheticoligonucleotide
  source 1..23: mol_type = other DNA
ctggactcaccggtgagtccagg

SEQ ID NO: 4152 - DNA, 23 bp, synthetic construct
  misc_feature 1..23: note = Description of Artificial Sequence: Syntheticoligonucleotide
  source 1..23: mol_type = other DNA
cgtgactcaccggtgagtcacgg

SEQ ID NO: 4153 - DNA, 23 bp, synthetic construct
  misc_feature 1..23: note = Description of Artificial Sequence: Syntheticoligonucleotide
  source 1..23: mol_type = other DNA
ggcgactcaccggtgagtcgccg

SEQ ID NO: 4154 - DNA, 23 bp, synthetic construct
  misc_feature 1..23: note = Description of Artificial Sequence: Syntheticoligonucleotide
  source 1..23: mol_type = other DNA
agcgactcaccggtgagtcgctg

SEQ ID NO: 4155 - DNA, 23 bp, synthetic construct
  misc_feature 1..23: note = Description of Artificial Sequence: Syntheticoligonucleotide
  source 1..23: mol_type = other DNA
gacgactcaccggtgagtcgtcg

SEQ ID NO: 4156 - DNA, 23 bp, synthetic construct
  misc_feature 1..23: note = Description of Artificial Sequence: Syntheticoligonucleotide
  source 1..23: mol_type = other DNA
ggagactcaccggtgagtctccg

SEQ ID NO: 4157 - DNA, 23 bp, synthetic construct
  misc_feature 1..23: note = Description of Artificial Sequence: Syntheticoligonucleotide
  source 1..23: mol_type = other DNA
tgcgactcaccggtgagtcgcag

SEQ ID NO: 4158 - DNA, 23 bp, synthetic construct
  misc_feature 1..23: note = Description of Artificial Sequence: Syntheticoligonucleotide
  source 1..23: mol_type = other DNA
ggtgactcaccggtgagtcaccg

SEQ ID NO: 4159 - DNA, 23 bp, synthetic construct
  misc_feature 1..23: note = Description of Artificial Sequence: Syntheticoligonucleotide
  source 1..23: mol_type = other DNA
acggactcaccggtgagtccgtg

SEQ ID NO: 4160 - DNA, 23 bp, synthetic construct
  misc_feature 1..23: note = Description of Artificial Sequence: Syntheticoligonucleotide
  source 1..23: mol_type = other DNA
ccagactcaccggtgagtctggg

SEQ ID NO: 4161 - DNA, 23 bp, synthetic construct
  misc_feature 1..23: note = Description of Artificial Sequence: Syntheticoligonucleotide
  source 1..23: mol_type = other DNA
tcggactcaccggtgagtccgag

SEQ ID NO: 4162 - DNA, 23 bp, synthetic construct
  misc_feature 1..23: note = Description of Artificial Sequence: Syntheticoligonucleotide
  source 1..23: mol_type = other DNA
cctgactcaccggtgagtcaggg

SEQ ID NO: 4163 - DNA, 23 bp, synthetic construct
  misc_feature 1..23: note = Description of Artificial Sequence: Syntheticoligonucleotide
  source 1..23: mol_type = other DNA
cacgactcaccggtgagtcgtgg

SEQ ID NO: 4164 - DNA, 23 bp, synthetic construct
  misc_feature 1..23: note = Description of Artificial Sequence: Syntheticoligonucleotide
  source 1..23: mol_type = other DNA
gccgactcaccggtgagtcggct

SEQ ID NO: 4165 - DNA, 23 bp, synthetic construct
  misc_feature 1..23: note = Description of Artificial Sequence: Syntheticoligonucleotide
  source 1..23: mol_type = other DNA
gccgactcaccggtgagtcggca

SEQ ID NO: 4166 - DNA, 23 bp, synthetic construct
  misc_feature 1..23: note = Description of Artificial Sequence: Syntheticoligonucleotide
  source 1..23: mol_type = other DNA
cgagactcaccggtgagtctcgc

SEQ ID NO: 4167 - DNA, 23 bp, synthetic construct
  misc_feature 1..23: note = Description of Artificial Sequence: Syntheticoligonucleotide
  source 1..23: mol_type = other DNA
cgtgactcaccggtgagtcacgc

SEQ ID NO: 4168 - DNA, 23 bp, synthetic construct
  misc_feature 1..23: note = Description of Artificial Sequence: Syntheticoligonucleotide
  source 1..23: mol_type = other DNA
caggactcaccggtgagtcctgc

SEQ ID NO: 4169 - DNA, 23 bp, synthetic construct
  misc_feature 1..23: note = Description of Artificial Sequence: Syntheticoligonucleotide
  source 1..23: mol_type = other DNA
ctggactcaccggtgagtccagc

SEQ ID NO: 4170 - DNA, 23 bp, synthetic construct
  misc_feature 1..23: note = Description of Artificial Sequence: Syntheticoligonucleotide
  source 1..23: mol_type = other DNA
gaggactcaccggtgagtcctcg

SEQ ID NO: 4171 - DNA, 23 bp, synthetic construct
  misc_feature 1..23: note = Description of Artificial Sequence: Syntheticoligonucleotide
  source 1..23: mol_type = other DNA
gtggactcaccggtgagtccacg

SEQ ID NO: 4172 - DNA, 23 bp, synthetic construct
  misc_feature 1..23: note = Description of Artificial Sequence: Syntheticoligonucleotide
  source 1..23: mol_type = other DNA
accgactcaccggtgagtcggtg

SEQ ID NO: 4173 - DNA, 23 bp, synthetic construct
  misc_feature 1..23: note = Description of Artificial Sequence: Syntheticoligonucleotide
  source 1..23: mol_type = other DNA
tccgactcaccggtgagtcggag

SEQ ID NO: 4174 - DNA, 23 bp, synthetic construct
  misc_feature 1..23: note = Description of Artificial Sequence: Syntheticoligonucleotide
  source 1..23: mol_type = other DNA
cgggactcaccggtgagtcccgc

SEQ ID NO: 4175 - DNA, 23 bp, synthetic construct
  misc_feature 1..23: note = Description of Artificial Sequence: Syntheticoligonucleotide
  source 1..23: mol_type = other DNA
agggactcaccggtgagtccctc

SEQ ID NO: 4176 - DNA, 23 bp, synthetic construct
  misc_feature 1..23: note = Description of Artificial Sequence: Syntheticoligonucleotide
  source 1..23: mol_type = other DNA
tgggactcaccggtgagtcccac

SEQ ID NO: 4177 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcggatccgagtcnnnn

SEQ ID NO: 4178 - DNA, 23 bp, synthetic construct
  misc_feature 1..23: note = Description of Artificial Sequence: Syntheticoligonucleotide
  source 1..23: mol_type = other DNA
gcggactcggatccgagtccgcc

SEQ ID NO: 4179 - DNA, 23 bp, synthetic construct
  misc_feature 1..23: note = Description of Artificial Sequence: Syntheticoligonucleotide
  source 1..23: mol_type = other DNA
gcggactcggatccgagtccgct

SEQ ID NO: 4180 - DNA, 23 bp, synthetic construct
  misc_feature 1..23: note = Description of Artificial Sequence: Syntheticoligonucleotide
  source 1..23: mol_type = other DNA
acggactcggatccgagtccgtc

SEQ ID NO: 4181 - DNA, 23 bp, synthetic construct
  misc_feature 1..23: note = Description of Artificial Sequence: Syntheticoligonucleotide
  source 1..23: mol_type = other DNA
gaggactcggatccgagtcctcc

SEQ ID NO: 4182 - DNA, 23 bp, synthetic construct
  misc_feature 1..23: note = Description of Artificial Sequence: Syntheticoligonucleotide
  source 1..23: mol_type = other DNA
gcagactcggatccgagtctgcc

SEQ ID NO: 4183 - DNA, 23 bp, synthetic construct
  misc_feature 1..23: note = Description of Artificial Sequence: Syntheticoligonucleotide
  source 1..23: mol_type = other DNA
gcggactcggatccgagtccgca

SEQ ID NO: 4184 - DNA, 23 bp, synthetic construct
  misc_feature 1..23: note = Description of Artificial Sequence: Syntheticoligonucleotide
  source 1..23: mol_type = other DNA
tcggactcggatccgagtccgac

SEQ ID NO: 4185 - DNA, 23 bp, synthetic construct
  misc_feature 1..23: note = Description of Artificial Sequence: Syntheticoligonucleotide
  source 1..23: mol_type = other DNA
gtggactcggatccgagtccacc

SEQ ID NO: 4186 - DNA, 23 bp, synthetic construct
  misc_feature 1..23: note = Description of Artificial Sequence: Syntheticoligonucleotide
  source 1..23: mol_type = other DNA
gctgactcggatccgagtcagcc

SEQ ID NO: 4187 - DNA, 23 bp, synthetic construct
  misc_feature 1..23: note = Description of Artificial Sequence: Syntheticoligonucleotide
  source 1..23: mol_type = other DNA
cccgactcggatccgagtcgggc

SEQ ID NO: 4188 - DNA, 23 bp, synthetic construct
  misc_feature 1..23: note = Description of Artificial Sequence: Syntheticoligonucleotide
  source 1..23: mol_type = other DNA
cccgactcggatccgagtcgggt

SEQ ID NO: 4189 - DNA, 23 bp, synthetic construct
  misc_feature 1..23: note = Description of Artificial Sequence: Syntheticoligonucleotide
  source 1..23: mol_type = other DNA
accgactcggatccgagtcggtc

SEQ ID NO: 4190 - DNA, 23 bp, synthetic construct
  misc_feature 1..23: note = Description of Artificial Sequence: Syntheticoligonucleotide
  source 1..23: mol_type = other DNA
cacgactcggatccgagtcgtgc

SEQ ID NO: 4191 - DNA, 23 bp, synthetic construct
  misc_feature 1..23: note = Description of Artificial Sequence: Syntheticoligonucleotide
  source 1..23: mol_type = other DNA
ccagactcggatccgagtctggc

SEQ ID NO: 4192 - DNA, 23 bp, synthetic construct
  misc_feature 1..23: note = Description of Artificial Sequence: Syntheticoligonucleotide
  source 1..23: mol_type = other DNA
cccgactcggatccgagtcggga

SEQ ID NO: 4193 - DNA, 23 bp, synthetic construct
  misc_feature 1..23: note = Description of Artificial Sequence: Syntheticoligonucleotide
  source 1..23: mol_type = other DNA
tccgactcggatccgagtcggac

SEQ ID NO: 4194 - DNA, 23 bp, synthetic construct
  misc_feature 1..23: note = Description of Artificial Sequence: Syntheticoligonucleotide
  source 1..23: mol_type = other DNA
cctgactcggatccgagtcaggc

SEQ ID NO: 4195 - DNA, 23 bp, synthetic construct
  misc_feature 1..23: note = Description of Artificial Sequence: Syntheticoligonucleotide
  source 1..23: mol_type = other DNA
ggcgactcggatccgagtcgccc

SEQ ID NO: 4196 - DNA, 23 bp, synthetic construct
  misc_feature 1..23: note = Description of Artificial Sequence: Syntheticoligonucleotide
  source 1..23: mol_type = other DNA
ggcgactcggatccgagtcgcct

SEQ ID NO: 4197 - DNA, 23 bp, synthetic construct
  misc_feature 1..23: note = Description of Artificial Sequence: Syntheticoligonucleotide
  source 1..23: mol_type = other DNA
agcgactcggatccgagtcgctc

SEQ ID NO: 4198 - DNA, 23 bp, synthetic construct
  misc_feature 1..23: note = Description of Artificial Sequence: Syntheticoligonucleotide
  source 1..23: mol_type = other DNA
gacgactcggatccgagtcgtcc

SEQ ID NO: 4199 - DNA, 23 bp, synthetic construct
  misc_feature 1..23: note = Description of Artificial Sequence: Syntheticoligonucleotide
  source 1..23: mol_type = other DNA
ggagactcggatccgagtctccc

SEQ ID NO: 4200 - DNA, 23 bp, synthetic construct
  misc_feature 1..23: note = Description of Artificial Sequence: Syntheticoligonucleotide
  source 1..23: mol_type = other DNA
ggcgactcggatccgagtcgcca

SEQ ID NO: 4201 - DNA, 23 bp, synthetic construct
  misc_feature 1..23: note = Description of Artificial Sequence: Syntheticoligonucleotide
  source 1..23: mol_type = other DNA
tgcgactcggatccgagtcgcac

SEQ ID NO: 4202 - DNA, 23 bp, synthetic construct
  misc_feature 1..23: note = Description of Artificial Sequence: Syntheticoligonucleotide
  source 1..23: mol_type = other DNA
ggtgactcggatccgagtcaccc

SEQ ID NO: 4203 - DNA, 23 bp, synthetic construct
  misc_feature 1..23: note = Description of Artificial Sequence: Syntheticoligonucleotide
  source 1..23: mol_type = other DNA
cgggactcggatccgagtcccgt

SEQ ID NO: 4204 - DNA, 23 bp, synthetic construct
  misc_feature 1..23: note = Description of Artificial Sequence: Syntheticoligonucleotide
  source 1..23: mol_type = other DNA
agggactcggatccgagtccctg

SEQ ID NO: 4205 - DNA, 23 bp, synthetic construct
  misc_feature 1..23: note = Description of Artificial Sequence: Syntheticoligonucleotide
  source 1..23: mol_type = other DNA
caggactcggatccgagtcctgg

SEQ ID NO: 4206 - DNA, 23 bp, synthetic construct
  misc_feature 1..23: note = Description of Artificial Sequence: Syntheticoligonucleotide
  source 1..23: mol_type = other DNA
cgagactcggatccgagtctcgg

SEQ ID NO: 4207 - DNA, 23 bp, synthetic construct
  misc_feature 1..23: note = Description of Artificial Sequence: Syntheticoligonucleotide
  source 1..23: mol_type = other DNA
cgggactcggatccgagtcccga

SEQ ID NO: 4208 - DNA, 23 bp, synthetic construct
  misc_feature 1..23: note = Description of Artificial Sequence: Syntheticoligonucleotide
  source 1..23: mol_type = other DNA
tgggactcggatccgagtcccag

SEQ ID NO: 4209 - DNA, 23 bp, synthetic construct
  misc_feature 1..23: note = Description of Artificial Sequence: Syntheticoligonucleotide
  source 1..23: mol_type = other DNA
ctggactcggatccgagtccagg

SEQ ID NO: 4210 - DNA, 23 bp, synthetic construct
  misc_feature 1..23: note = Description of Artificial Sequence: Syntheticoligonucleotide
  source 1..23: mol_type = other DNA
cgtgactcggatccgagtcacgg

SEQ ID NO: 4211 - DNA, 23 bp, synthetic construct
  misc_feature 1..23: note = Description of Artificial Sequence: Syntheticoligonucleotide
  source 1..23: mol_type = other DNA
ggcgactcggatccgagtcgccg

SEQ ID NO: 4212 - DNA, 23 bp, synthetic construct
  misc_feature 1..23: note = Description of Artificial Sequence: Syntheticoligonucleotide
  source 1..23: mol_type = other DNA
agcgactcggatccgagtcgctg

SEQ ID NO: 4213 - DNA, 23 bp, synthetic construct
  misc_feature 1..23: note = Description of Artificial Sequence: Syntheticoligonucleotide
  source 1..23: mol_type = other DNA
gacgactcggatccgagtcgtcg

SEQ ID NO: 4214 - DNA, 23 bp, synthetic construct
  misc_feature 1..23: note = Description of Artificial Sequence: Syntheticoligonucleotide
  source 1..23: mol_type = other DNA
ggagactcggatccgagtctccg

SEQ ID NO: 4215 - DNA, 23 bp, synthetic construct
  misc_feature 1..23: note = Description of Artificial Sequence: Syntheticoligonucleotide
  source 1..23: mol_type = other DNA
tgcgactcggatccgagtcgcag

SEQ ID NO: 4216 - DNA, 23 bp, synthetic construct
  misc_feature 1..23: note = Description of Artificial Sequence: Syntheticoligonucleotide
  source 1..23: mol_type = other DNA
ggtgactcggatccgagtcaccg

SEQ ID NO: 4217 - DNA, 23 bp, synthetic construct
  misc_feature 1..23: note = Description of Artificial Sequence: Syntheticoligonucleotide
  source 1..23: mol_type = other DNA
acggactcggatccgagtccgtg

SEQ ID NO: 4218 - DNA, 23 bp, synthetic construct
  misc_feature 1..23: note = Description of Artificial Sequence: Syntheticoligonucleotide
  source 1..23: mol_type = other DNA
ccagactcggatccgagtctggg

SEQ ID NO: 4219 - DNA, 23 bp, synthetic construct
  misc_feature 1..23: note = Description of Artificial Sequence: Syntheticoligonucleotide
  source 1..23: mol_type = other DNA
tcggactcggatccgagtccgag

SEQ ID NO: 4220 - DNA, 23 bp, synthetic construct
  misc_feature 1..23: note = Description of Artificial Sequence: Syntheticoligonucleotide
  source 1..23: mol_type = other DNA
cctgactcggatccgagtcaggg

SEQ ID NO: 4221 - DNA, 23 bp, synthetic construct
  misc_feature 1..23: note = Description of Artificial Sequence: Syntheticoligonucleotide
  source 1..23: mol_type = other DNA
cacgactcggatccgagtcgtgg

SEQ ID NO: 4222 - DNA, 23 bp, synthetic construct
  misc_feature 1..23: note = Description of Artificial Sequence: Syntheticoligonucleotide
  source 1..23: mol_type = other DNA
gccgactcggatccgagtcggct

SEQ ID NO: 4223 - DNA, 23 bp, synthetic construct
  misc_feature 1..23: note = Description of Artificial Sequence: Syntheticoligonucleotide
  source 1..23: mol_type = other DNA
gccgactcggatccgagtcggca

SEQ ID NO: 4224 - DNA, 23 bp, synthetic construct
  misc_feature 1..23: note = Description of Artificial Sequence: Syntheticoligonucleotide
  source 1..23: mol_type = other DNA
cgagactcggatccgagtctcgc

SEQ ID NO: 4225 - DNA, 23 bp, synthetic construct
  misc_feature 1..23: note = Description of Artificial Sequence: Syntheticoligonucleotide
  source 1..23: mol_type = other DNA
cgtgactcggatccgagtcacgc

SEQ ID NO: 4226 - DNA, 23 bp, synthetic construct
  misc_feature 1..23: note = Description of Artificial Sequence: Syntheticoligonucleotide
  source 1..23: mol_type = other DNA
caggactcggatccgagtcctgc

SEQ ID NO: 4227 - DNA, 23 bp, synthetic construct
  misc_feature 1..23: note = Description of Artificial Sequence: Syntheticoligonucleotide
  source 1..23: mol_type = other DNA
ctggactcggatccgagtccagc

SEQ ID NO: 4228 - DNA, 23 bp, synthetic construct
  misc_feature 1..23: note = Description of Artificial Sequence: Syntheticoligonucleotide
  source 1..23: mol_type = other DNA
gaggactcggatccgagtcctcg

SEQ ID NO: 4229 - DNA, 23 bp, synthetic construct
  misc_feature 1..23: note = Description of Artificial Sequence: Syntheticoligonucleotide
  source 1..23: mol_type = other DNA
gtggactcggatccgagtccacg

SEQ ID NO: 4230 - DNA, 23 bp, synthetic construct
  misc_feature 1..23: note = Description of Artificial Sequence: Syntheticoligonucleotide
  source 1..23: mol_type = other DNA
accgactcggatccgagtcggtg

SEQ ID NO: 4231 - DNA, 23 bp, synthetic construct
  misc_feature 1..23: note = Description of Artificial Sequence: Syntheticoligonucleotide
  source 1..23: mol_type = other DNA
tccgactcggatccgagtcggag

SEQ ID NO: 4232 - DNA, 23 bp, synthetic construct
  misc_feature 1..23: note = Description of Artificial Sequence: Syntheticoligonucleotide
  source 1..23: mol_type = other DNA
cgggactcggatccgagtcccgc

SEQ ID NO: 4233 - DNA, 23 bp, synthetic construct
  misc_feature 1..23: note = Description of Artificial Sequence: Syntheticoligonucleotide
  source 1..23: mol_type = other DNA
agggactcggatccgagtccctc

SEQ ID NO: 4234 - DNA, 23 bp, synthetic construct
  misc_feature 1..23: note = Description of Artificial Sequence: Syntheticoligonucleotide
  source 1..23: mol_type = other DNA
tgggactcggatccgagtcccac

SEQ ID NO: 4235 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcggtaccgagtcnnnn

SEQ ID NO: 4236 - DNA, 23 bp, synthetic construct
  misc_feature 1..23: note = Description of Artificial Sequence: Syntheticoligonucleotide
  source 1..23: mol_type = other DNA
gcggactcggtaccgagtccgcc

SEQ ID NO: 4237 - DNA, 23 bp, synthetic construct
  misc_feature 1..23: note = Description of Artificial Sequence: Syntheticoligonucleotide
  source 1..23: mol_type = other DNA
gcggactcggtaccgagtccgct

SEQ ID NO: 4238 - DNA, 23 bp, synthetic construct
  misc_feature 1..23: note = Description of Artificial Sequence: Syntheticoligonucleotide
  source 1..23: mol_type = other DNA
acggactcggtaccgagtccgtc

SEQ ID NO: 4239 - DNA, 23 bp, synthetic construct
  misc_feature 1..23: note = Description of Artificial Sequence: Syntheticoligonucleotide
  source 1..23: mol_type = other DNA
gaggactcggtaccgagtcctcc

SEQ ID NO: 4240 - DNA, 23 bp, synthetic construct
  misc_feature 1..23: note = Description of Artificial Sequence: Syntheticoligonucleotide
  source 1..23: mol_type = other DNA
gcagactcggtaccgagtctgcc

SEQ ID NO: 4241 - DNA, 23 bp, synthetic construct
  misc_feature 1..23: note = Description of Artificial Sequence: Syntheticoligonucleotide
  source 1..23: mol_type = other DNA
gcggactcggtaccgagtccgca

SEQ ID NO: 4242 - DNA, 23 bp, synthetic construct
  misc_feature 1..23: note = Description of Artificial Sequence: Syntheticoligonucleotide
  source 1..23: mol_type = other DNA
tcggactcggtaccgagtccgac

SEQ ID NO: 4243 - DNA, 23 bp, synthetic construct
  misc_feature 1..23: note = Description of Artificial Sequence: Syntheticoligonucleotide
  source 1..23: mol_type = other DNA
gtggactcggtaccgagtccacc

SEQ ID NO: 4244 - DNA, 23 bp, synthetic construct
  misc_feature 1..23: note = Description of Artificial Sequence: Syntheticoligonucleotide
  source 1..23: mol_type = other DNA
gctgactcggtaccgagtcagcc

SEQ ID NO: 4245 - DNA, 23 bp, synthetic construct
  misc_feature 1..23: note = Description of Artificial Sequence: Syntheticoligonucleotide
  source 1..23: mol_type = other DNA
cccgactcggtaccgagtcgggc

SEQ ID NO: 4246 - DNA, 23 bp, synthetic construct
  misc_feature 1..23: note = Description of Artificial Sequence: Syntheticoligonucleotide
  source 1..23: mol_type = other DNA
cccgactcggtaccgagtcgggt

SEQ ID NO: 4247 - DNA, 23 bp, synthetic construct
  misc_feature 1..23: note = Description of Artificial Sequence: Syntheticoligonucleotide
  source 1..23: mol_type = other DNA
accgactcggtaccgagtcggtc

SEQ ID NO: 4248 - DNA, 23 bp, synthetic construct
  misc_feature 1..23: note = Description of Artificial Sequence: Syntheticoligonucleotide
  source 1..23: mol_type = other DNA
cacgactcggtaccgagtcgtgc

SEQ ID NO: 4249 - DNA, 23 bp, synthetic construct
  misc_feature 1..23: note = Description of Artificial Sequence: Syntheticoligonucleotide
  source 1..23: mol_type = other DNA
ccagactcggtaccgagtctggc

SEQ ID NO: 4250 - DNA, 23 bp, synthetic construct
  misc_feature 1..23: note = Description of Artificial Sequence: Syntheticoligonucleotide
  source 1..23: mol_type = other DNA
cccgactcggtaccgagtcggga

SEQ ID NO: 4251 - DNA, 23 bp, synthetic construct
  misc_feature 1..23: note = Description of Artificial Sequence: Syntheticoligonucleotide
  source 1..23: mol_type = other DNA
tccgactcggtaccgagtcggac

SEQ ID NO: 4252 - DNA, 23 bp, synthetic construct
  misc_feature 1..23: note = Description of Artificial Sequence: Syntheticoligonucleotide
  source 1..23: mol_type = other DNA
cctgactcggtaccgagtcaggc

SEQ ID NO: 4253 - DNA, 23 bp, synthetic construct
  misc_feature 1..23: note = Description of Artificial Sequence: Syntheticoligonucleotide
  source 1..23: mol_type = other DNA
ggcgactcggtaccgagtcgccc

SEQ ID NO: 4254 - DNA, 23 bp, synthetic construct
  misc_feature 1..23: note = Description of Artificial Sequence: Syntheticoligonucleotide
  source 1..23: mol_type = other DNA
ggcgactcggtaccgagtcgcct

SEQ ID NO: 4255 - DNA, 23 bp, synthetic construct
  misc_feature 1..23: note = Description of Artificial Sequence: Syntheticoligonucleotide
  source 1..23: mol_type = other DNA
agcgactcggtaccgagtcgctc

SEQ ID NO: 4256 - DNA, 23 bp, synthetic construct
  misc_feature 1..23: note = Description of Artificial Sequence: Syntheticoligonucleotide
  source 1..23: mol_type = other DNA
gacgactcggtaccgagtcgtcc

SEQ ID NO: 4257 - DNA, 23 bp, synthetic construct
  misc_feature 1..23: note = Description of Artificial Sequence: Syntheticoligonucleotide
  source 1..23: mol_type = other DNA
ggagactcggtaccgagtctccc

SEQ ID NO: 4258 - DNA, 23 bp, synthetic construct
  misc_feature 1..23: note = Description of Artificial Sequence: Syntheticoligonucleotide
  source 1..23: mol_type = other DNA
ggcgactcggtaccgagtcgcca

SEQ ID NO: 4259 - DNA, 23 bp, synthetic construct
  misc_feature 1..23: note = Description of Artificial Sequence: Syntheticoligonucleotide
  source 1..23: mol_type = other DNA
tgcgactcggtaccgagtcgcac

SEQ ID NO: 4260 - DNA, 23 bp, synthetic construct
  misc_feature 1..23: note = Description of Artificial Sequence: Syntheticoligonucleotide
  source 1..23: mol_type = other DNA
ggtgactcggtaccgagtcaccc

SEQ ID NO: 4261 - DNA, 23 bp, synthetic construct
  misc_feature 1..23: note = Description of Artificial Sequence: Syntheticoligonucleotide
  source 1..23: mol_type = other DNA
cgggactcggtaccgagtcccgt

SEQ ID NO: 4262 - DNA, 23 bp, synthetic construct
  misc_feature 1..23: note = Description of Artificial Sequence: Syntheticoligonucleotide
  source 1..23: mol_type = other DNA
agggactcggtaccgagtccctg

SEQ ID NO: 4263 - DNA, 23 bp, synthetic construct
  misc_feature 1..23: note = Description of Artificial Sequence: Syntheticoligonucleotide
  source 1..23: mol_type = other DNA
caggactcggtaccgagtcctgg

SEQ ID NO: 4264 - DNA, 23 bp, synthetic construct
  misc_feature 1..23: note = Description of Artificial Sequence: Syntheticoligonucleotide
  source 1..23: mol_type = other DNA
cgagactcggtaccgagtctcgg

SEQ ID NO: 4265 - DNA, 23 bp, synthetic construct
  misc_feature 1..23: note = Description of Artificial Sequence: Syntheticoligonucleotide
  source 1..23: mol_type = other DNA
cgggactcggtaccgagtcccga

SEQ ID NO: 4266 - DNA, 23 bp, synthetic construct
  misc_feature 1..23: note = Description of Artificial Sequence: Syntheticoligonucleotide
  source 1..23: mol_type = other DNA
tgggactcggtaccgagtcccag

SEQ ID NO: 4267 - DNA, 23 bp, synthetic construct
  misc_feature 1..23: note = Description of Artificial Sequence: Syntheticoligonucleotide
  source 1..23: mol_type = other DNA
ctggactcggtaccgagtccagg

SEQ ID NO: 4268 - DNA, 23 bp, synthetic construct
  misc_feature 1..23: note = Description of Artificial Sequence: Syntheticoligonucleotide
  source 1..23: mol_type = other DNA
cgtgactcggtaccgagtcacgg

SEQ ID NO: 4269 - DNA, 23 bp, synthetic construct
  misc_feature 1..23: note = Description of Artificial Sequence: Syntheticoligonucleotide
  source 1..23: mol_type = other DNA
ggcgactcggtaccgagtcgccg

SEQ ID NO: 4270 - DNA, 23 bp, synthetic construct
  misc_feature 1..23: note = Description of Artificial Sequence: Syntheticoligonucleotide
  source 1..23: mol_type = other DNA
agcgactcggtaccgagtcgctg

SEQ ID NO: 4271 - DNA, 23 bp, synthetic construct
  misc_feature 1..23: note = Description of Artificial Sequence: Syntheticoligonucleotide
  source 1..23: mol_type = other DNA
gacgactcggtaccgagtcgtcg

SEQ ID NO: 4272 - DNA, 23 bp, synthetic construct
  misc_feature 1..23: note = Description of Artificial Sequence: Syntheticoligonucleotide
  source 1..23: mol_type = other DNA
ggagactcggtaccgagtctccg

SEQ ID NO: 4273 - DNA, 23 bp, synthetic construct
  misc_feature 1..23: note = Description of Artificial Sequence: Syntheticoligonucleotide
  source 1..23: mol_type = other DNA
tgcgactcggtaccgagtcgcag

SEQ ID NO: 4274 - DNA, 23 bp, synthetic construct
  misc_feature 1..23: note = Description of Artificial Sequence: Syntheticoligonucleotide
  source 1..23: mol_type = other DNA
ggtgactcggtaccgagtcaccg

SEQ ID NO: 4275 - DNA, 23 bp, synthetic construct
  misc_feature 1..23: note = Description of Artificial Sequence: Syntheticoligonucleotide
  source 1..23: mol_type = other DNA
acggactcggtaccgagtccgtg

SEQ ID NO: 4276 - DNA, 23 bp, synthetic construct
  misc_feature 1..23: note = Description of Artificial Sequence: Syntheticoligonucleotide
  source 1..23: mol_type = other DNA
ccagactcggtaccgagtctggg

SEQ ID NO: 4277 - DNA, 23 bp, synthetic construct
  misc_feature 1..23: note = Description of Artificial Sequence: Syntheticoligonucleotide
  source 1..23: mol_type = other DNA
tcggactcggtaccgagtccgag

SEQ ID NO: 4278 - DNA, 23 bp, synthetic construct
  misc_feature 1..23: note = Description of Artificial Sequence: Syntheticoligonucleotide
  source 1..23: mol_type = other DNA
cctgactcggtaccgagtcaggg

SEQ ID NO: 4279 - DNA, 23 bp, synthetic construct
  misc_feature 1..23: note = Description of Artificial Sequence: Syntheticoligonucleotide
  source 1..23: mol_type = other DNA
cacgactcggtaccgagtcgtgg

SEQ ID NO: 4280 - DNA, 23 bp, synthetic construct
  misc_feature 1..23: note = Description of Artificial Sequence: Syntheticoligonucleotide
  source 1..23: mol_type = other DNA
gccgactcggtaccgagtcggct

SEQ ID NO: 4281 - DNA, 23 bp, synthetic construct
  misc_feature 1..23: note = Description of Artificial Sequence: Syntheticoligonucleotide
  source 1..23: mol_type = other DNA
gccgactcggtaccgagtcggca

SEQ ID NO: 4282 - DNA, 23 bp, synthetic construct
  misc_feature 1..23: note = Description of Artificial Sequence: Syntheticoligonucleotide
  source 1..23: mol_type = other DNA
cgagactcggtaccgagtctcgc

SEQ ID NO: 4283 - DNA, 23 bp, synthetic construct
  misc_feature 1..23: note = Description of Artificial Sequence: Syntheticoligonucleotide
  source 1..23: mol_type = other DNA
cgtgactcggtaccgagtcacgc

SEQ ID NO: 4284 - DNA, 23 bp, synthetic construct
  misc_feature 1..23: note = Description of Artificial Sequence: Syntheticoligonucleotide
  source 1..23: mol_type = other DNA
caggactcggtaccgagtcctgc

SEQ ID NO: 4285 - DNA, 23 bp, synthetic construct
  misc_feature 1..23: note = Description of Artificial Sequence: Syntheticoligonucleotide
  source 1..23: mol_type = other DNA
ctggactcggtaccgagtccagc

SEQ ID NO: 4286 - DNA, 23 bp, synthetic construct
  misc_feature 1..23: note = Description of Artificial Sequence: Syntheticoligonucleotide
  source 1..23: mol_type = other DNA
gaggactcggtaccgagtcctcg

SEQ ID NO: 4287 - DNA, 23 bp, synthetic construct
  misc_feature 1..23: note = Description of Artificial Sequence: Syntheticoligonucleotide
  source 1..23: mol_type = other DNA
gtggactcggtaccgagtccacg

SEQ ID NO: 4288 - DNA, 23 bp, synthetic construct
  misc_feature 1..23: note = Description of Artificial Sequence: Syntheticoligonucleotide
  source 1..23: mol_type = other DNA
accgactcggtaccgagtcggtg

SEQ ID NO: 4289 - DNA, 23 bp, synthetic construct
  misc_feature 1..23: note = Description of Artificial Sequence: Syntheticoligonucleotide
  source 1..23: mol_type = other DNA
tccgactcggtaccgagtcggag

SEQ ID NO: 4290 - DNA, 23 bp, synthetic construct
  misc_feature 1..23: note = Description of Artificial Sequence: Syntheticoligonucleotide
  source 1..23: mol_type = other DNA
cgggactcggtaccgagtcccgc

SEQ ID NO: 4291 - DNA, 23 bp, synthetic construct
  misc_feature 1..23: note = Description of Artificial Sequence: Syntheticoligonucleotide
  source 1..23: mol_type = other DNA
agggactcggtaccgagtccctc

SEQ ID NO: 4292 - DNA, 23 bp, synthetic construct
  misc_feature 1..23: note = Description of Artificial Sequence: Syntheticoligonucleotide
  source 1..23: mol_type = other DNA
tgggactcggtaccgagtcccac

SEQ ID NO: 4293 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcgggcccgagtcnnnn

SEQ ID NO: 4294 - DNA, 23 bp, synthetic construct
  misc_feature 1..23: note = Description of Artificial Sequence: Syntheticoligonucleotide
  source 1..23: mol_type = other DNA
gcggactcgggcccgagtccgcc

SEQ ID NO: 4295 - DNA, 23 bp, synthetic construct
  misc_feature 1..23: note = Description of Artificial Sequence: Syntheticoligonucleotide
  source 1..23: mol_type = other DNA
gcggactcgggcccgagtccgct

SEQ ID NO: 4296 - DNA, 23 bp, synthetic construct
  misc_feature 1..23: note = Description of Artificial Sequence: Syntheticoligonucleotide
  source 1..23: mol_type = other DNA
acggactcgggcccgagtccgtc

SEQ ID NO: 4297 - DNA, 23 bp, synthetic construct
  misc_feature 1..23: note = Description of Artificial Sequence: Syntheticoligonucleotide
  source 1..23: mol_type = other DNA
gaggactcgggcccgagtcctcc

SEQ ID NO: 4298 - DNA, 23 bp, synthetic construct
  misc_feature 1..23: note = Description of Artificial Sequence: Syntheticoligonucleotide
  source 1..23: mol_type = other DNA
gcagactcgggcccgagtctgcc

SEQ ID NO: 4299 - DNA, 23 bp, synthetic construct
  misc_feature 1..23: note = Description of Artificial Sequence: Syntheticoligonucleotide
  source 1..23: mol_type = other DNA
gcggactcgggcccgagtccgca

SEQ ID NO: 4300 - DNA, 23 bp, synthetic construct
  misc_feature 1..23: note = Description of Artificial Sequence: Syntheticoligonucleotide
  source 1..23: mol_type = other DNA
tcggactcgggcccgagtccgac

SEQ ID NO: 4301 - DNA, 23 bp, synthetic construct
  misc_feature 1..23: note = Description of Artificial Sequence: Syntheticoligonucleotide
  source 1..23: mol_type = other DNA
gtggactcgggcccgagtccacc

SEQ ID NO: 4302 - DNA, 23 bp, synthetic construct
  misc_feature 1..23: note = Description of Artificial Sequence: Syntheticoligonucleotide
  source 1..23: mol_type = other DNA
gctgactcgggcccgagtcagcc

SEQ ID NO: 4303 - DNA, 23 bp, synthetic construct
  misc_feature 1..23: note = Description of Artificial Sequence: Syntheticoligonucleotide
  source 1..23: mol_type = other DNA
cccgactcgggcccgagtcgggc

SEQ ID NO: 4304 - DNA, 23 bp, synthetic construct
  misc_feature 1..23: note = Description of Artificial Sequence: Syntheticoligonucleotide
  source 1..23: mol_type = other DNA
cccgactcgggcccgagtcgggt

SEQ ID NO: 4305 - DNA, 23 bp, synthetic construct
  misc_feature 1..23: note = Description of Artificial Sequence: Syntheticoligonucleotide
  source 1..23: mol_type = other DNA
accgactcgggcccgagtcggtc

SEQ ID NO: 4306 - DNA, 23 bp, synthetic construct
  misc_feature 1..23: note = Description of Artificial Sequence: Syntheticoligonucleotide
  source 1..23: mol_type = other DNA
cacgactcgggcccgagtcgtgc

SEQ ID NO: 4307 - DNA, 23 bp, synthetic construct
  misc_feature 1..23: note = Description of Artificial Sequence: Syntheticoligonucleotide
  source 1..23: mol_type = other DNA
ccagactcgggcccgagtctggc

SEQ ID NO: 4308 - DNA, 23 bp, synthetic construct
  misc_feature 1..23: note = Description of Artificial Sequence: Syntheticoligonucleotide
  source 1..23: mol_type = other DNA
cccgactcgggcccgagtcggga

SEQ ID NO: 4309 - DNA, 23 bp, synthetic construct
  misc_feature 1..23: note = Description of Artificial Sequence: Syntheticoligonucleotide
  source 1..23: mol_type = other DNA
tccgactcgggcccgagtcggac

SEQ ID NO: 4310 - DNA, 23 bp, synthetic construct
  misc_feature 1..23: note = Description of Artificial Sequence: Syntheticoligonucleotide
  source 1..23: mol_type = other DNA
cctgactcgggcccgagtcaggc

SEQ ID NO: 4311 - DNA, 23 bp, synthetic construct
  misc_feature 1..23: note = Description of Artificial Sequence: Syntheticoligonucleotide
  source 1..23: mol_type = other DNA
ggcgactcgggcccgagtcgccc

SEQ ID NO: 4312 - DNA, 23 bp, synthetic construct
  misc_feature 1..23: note = Description of Artificial Sequence: Syntheticoligonucleotide
  source 1..23: mol_type = other DNA
ggcgactcgggcccgagtcgcct

SEQ ID NO: 4313 - DNA, 23 bp, synthetic construct
  misc_feature 1..23: note = Description of Artificial Sequence: Syntheticoligonucleotide
  source 1..23: mol_type = other DNA
agcgactcgggcccgagtcgctc

SEQ ID NO: 4314 - DNA, 23 bp, synthetic construct
  misc_feature 1..23: note = Description of Artificial Sequence: Syntheticoligonucleotide
  source 1..23: mol_type = other DNA
gacgactcgggcccgagtcgtcc

SEQ ID NO: 4315 - DNA, 23 bp, synthetic construct
  misc_feature 1..23: note = Description of Artificial Sequence: Syntheticoligonucleotide
  source 1..23: mol_type = other DNA
ggagactcgggcccgagtctccc

SEQ ID NO: 4316 - DNA, 23 bp, synthetic construct
  misc_feature 1..23: note = Description of Artificial Sequence: Syntheticoligonucleotide
  source 1..23: mol_type = other DNA
ggcgactcgggcccgagtcgcca

SEQ ID NO: 4317 - DNA, 23 bp, synthetic construct
  misc_feature 1..23: note = Description of Artificial Sequence: Syntheticoligonucleotide
  source 1..23: mol_type = other DNA
tgcgactcgggcccgagtcgcac

SEQ ID NO: 4318 - DNA, 23 bp, synthetic construct
  misc_feature 1..23: note = Description of Artificial Sequence: Syntheticoligonucleotide
  source 1..23: mol_type = other DNA
ggtgactcgggcccgagtcaccc

SEQ ID NO: 4319 - DNA, 23 bp, synthetic construct
  misc_feature 1..23: note = Description of Artificial Sequence: Syntheticoligonucleotide
  source 1..23: mol_type = other DNA
cgggactcgggcccgagtcccgt

SEQ ID NO: 4320 - DNA, 23 bp, synthetic construct
  misc_feature 1..23: note = Description of Artificial Sequence: Syntheticoligonucleotide
  source 1..23: mol_type = other DNA
agggactcgggcccgagtccctg

SEQ ID NO: 4321 - DNA, 23 bp, synthetic construct
  misc_feature 1..23: note = Description of Artificial Sequence: Syntheticoligonucleotide
  source 1..23: mol_type = other DNA
caggactcgggcccgagtcctgg

SEQ ID NO: 4322 - DNA, 23 bp, synthetic construct
  misc_feature 1..23: note = Description of Artificial Sequence: Syntheticoligonucleotide
  source 1..23: mol_type = other DNA
cgagactcgggcccgagtctcgg

SEQ ID NO: 4323 - DNA, 23 bp, synthetic construct
  misc_feature 1..23: note = Description of Artificial Sequence: Syntheticoligonucleotide
  source 1..23: mol_type = other DNA
cgggactcgggcccgagtcccga

SEQ ID NO: 4324 - DNA, 23 bp, synthetic construct
  misc_feature 1..23: note = Description of Artificial Sequence: Syntheticoligonucleotide
  source 1..23: mol_type = other DNA
tgggactcgggcccgagtcccag

SEQ ID NO: 4325 - DNA, 23 bp, synthetic construct
  misc_feature 1..23: note = Description of Artificial Sequence: Syntheticoligonucleotide
  source 1..23: mol_type = other DNA
ctggactcgggcccgagtccagg

SEQ ID NO: 4326 - DNA, 23 bp, synthetic construct
  misc_feature 1..23: note = Description of Artificial Sequence: Syntheticoligonucleotide
  source 1..23: mol_type = other DNA
cgtgactcgggcccgagtcacgg

SEQ ID NO: 4327 - DNA, 23 bp, synthetic construct
  misc_feature 1..23: note = Description of Artificial Sequence: Syntheticoligonucleotide
  source 1..23: mol_type = other DNA
ggcgactcgggcccgagtcgccg

SEQ ID NO: 4328 - DNA, 23 bp, synthetic construct
  misc_feature 1..23: note = Description of Artificial Sequence: Syntheticoligonucleotide
  source 1..23: mol_type = other DNA
agcgactcgggcccgagtcgctg

SEQ ID NO: 4329 - DNA, 23 bp, synthetic construct
  misc_feature 1..23: note = Description of Artificial Sequence: Syntheticoligonucleotide
  source 1..23: mol_type = other DNA
gacgactcgggcccgagtcgtcg

SEQ ID NO: 4330 - DNA, 23 bp, synthetic construct
  misc_feature 1..23: note = Description of Artificial Sequence: Syntheticoligonucleotide
  source 1..23: mol_type = other DNA
ggagactcgggcccgagtctccg

SEQ ID NO: 4331 - DNA, 23 bp, synthetic construct
  misc_feature 1..23: note = Description of Artificial Sequence: Syntheticoligonucleotide
  source 1..23: mol_type = other DNA
tgcgactcgggcccgagtcgcag

SEQ ID NO: 4332 - DNA, 23 bp, synthetic construct
  misc_feature 1..23: note = Description of Artificial Sequence: Syntheticoligonucleotide
  source 1..23: mol_type = other DNA
ggtgactcgggcccgagtcaccg

SEQ ID NO: 4333 - DNA, 23 bp, synthetic construct
  misc_feature 1..23: note = Description of Artificial Sequence: Syntheticoligonucleotide
  source 1..23: mol_type = other DNA
acggactcgggcccgagtccgtg

SEQ ID NO: 4334 - DNA, 23 bp, synthetic construct
  misc_feature 1..23: note = Description of Artificial Sequence: Syntheticoligonucleotide
  source 1..23: mol_type = other DNA
ccagactcgggcccgagtctggg

SEQ ID NO: 4335 - DNA, 23 bp, synthetic construct
  misc_feature 1..23: note = Description of Artificial Sequence: Syntheticoligonucleotide
  source 1..23: mol_type = other DNA
tcggactcgggcccgagtccgag

SEQ ID NO: 4336 - DNA, 23 bp, synthetic construct
  misc_feature 1..23: note = Description of Artificial Sequence: Syntheticoligonucleotide
  source 1..23: mol_type = other DNA
cctgactcgggcccgagtcaggg

SEQ ID NO: 4337 - DNA, 23 bp, synthetic construct
  misc_feature 1..23: note = Description of Artificial Sequence: Syntheticoligonucleotide
  source 1..23: mol_type = other DNA
cacgactcgggcccgagtcgtgg

SEQ ID NO: 4338 - DNA, 23 bp, synthetic construct
  misc_feature 1..23: note = Description of Artificial Sequence: Syntheticoligonucleotide
  source 1..23: mol_type = other DNA
gccgactcgggcccgagtcggct

SEQ ID NO: 4339 - DNA, 23 bp, synthetic construct
  misc_feature 1..23: note = Description of Artificial Sequence: Syntheticoligonucleotide
  source 1..23: mol_type = other DNA
gccgactcgggcccgagtcggca

SEQ ID NO: 4340 - DNA, 23 bp, synthetic construct
  misc_feature 1..23: note = Description of Artificial Sequence: Syntheticoligonucleotide
  source 1..23: mol_type = other DNA
cgagactcgggcccgagtctcgc

SEQ ID NO: 4341 - DNA, 23 bp, synthetic construct
  misc_feature 1..23: note = Description of Artificial Sequence: Syntheticoligonucleotide
  source 1..23: mol_type = other DNA
cgtgactcgggcccgagtcacgc

SEQ ID NO: 4342 - DNA, 23 bp, synthetic construct
  misc_feature 1..23: note = Description of Artificial Sequence: Syntheticoligonucleotide
  source 1..23: mol_type = other DNA
caggactcgggcccgagtcctgc

SEQ ID NO: 4343 - DNA, 23 bp, synthetic construct
  misc_feature 1..23: note = Description of Artificial Sequence: Syntheticoligonucleotide
  source 1..23: mol_type = other DNA
ctggactcgggcccgagtccagc

SEQ ID NO: 4344 - DNA, 23 bp, synthetic construct
  misc_feature 1..23: note = Description of Artificial Sequence: Syntheticoligonucleotide
  source 1..23: mol_type = other DNA
gaggactcgggcccgagtcctcg

SEQ ID NO: 4345 - DNA, 23 bp, synthetic construct
  misc_feature 1..23: note = Description of Artificial Sequence: Syntheticoligonucleotide
  source 1..23: mol_type = other DNA
gtggactcgggcccgagtccacg

SEQ ID NO: 4346 - DNA, 23 bp, synthetic construct
  misc_feature 1..23: note = Description of Artificial Sequence: Syntheticoligonucleotide
  source 1..23: mol_type = other DNA
accgactcgggcccgagtcggtg

SEQ ID NO: 4347 - DNA, 23 bp, synthetic construct
  misc_feature 1..23: note = Description of Artificial Sequence: Syntheticoligonucleotide
  source 1..23: mol_type = other DNA
tccgactcgggcccgagtcggag

SEQ ID NO: 4348 - DNA, 23 bp, synthetic construct
  misc_feature 1..23: note = Description of Artificial Sequence: Syntheticoligonucleotide
  source 1..23: mol_type = other DNA
cgggactcgggcccgagtcccgc

SEQ ID NO: 4349 - DNA, 23 bp, synthetic construct
  misc_feature 1..23: note = Description of Artificial Sequence: Syntheticoligonucleotide
  source 1..23: mol_type = other DNA
agggactcgggcccgagtccctc

SEQ ID NO: 4350 - DNA, 23 bp, synthetic construct
  misc_feature 1..23: note = Description of Artificial Sequence: Syntheticoligonucleotide
  source 1..23: mol_type = other DNA
tgggactcgggcccgagtcccac

SEQ ID NO: 4351 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcggcgccgagtcnnnn

SEQ ID NO: 4352 - DNA, 23 bp, synthetic construct
  misc_feature 1..23: note = Description of Artificial Sequence: Syntheticoligonucleotide
  source 1..23: mol_type = other DNA
gcggactcggcgccgagtccgcc

SEQ ID NO: 4353 - DNA, 23 bp, synthetic construct
  misc_feature 1..23: note = Description of Artificial Sequence: Syntheticoligonucleotide
  source 1..23: mol_type = other DNA
gcggactcggcgccgagtccgct

SEQ ID NO: 4354 - DNA, 23 bp, synthetic construct
  misc_feature 1..23: note = Description of Artificial Sequence: Syntheticoligonucleotide
  source 1..23: mol_type = other DNA
acggactcggcgccgagtccgtc

SEQ ID NO: 4355 - DNA, 23 bp, synthetic construct
  misc_feature 1..23: note = Description of Artificial Sequence: Syntheticoligonucleotide
  source 1..23: mol_type = other DNA
gaggactcggcgccgagtcctcc

SEQ ID NO: 4356 - DNA, 23 bp, synthetic construct
  misc_feature 1..23: note = Description of Artificial Sequence: Syntheticoligonucleotide
  source 1..23: mol_type = other DNA
gcagactcggcgccgagtctgcc

SEQ ID NO: 4357 - DNA, 23 bp, synthetic construct
  misc_feature 1..23: note = Description of Artificial Sequence: Syntheticoligonucleotide
  source 1..23: mol_type = other DNA
gcggactcggcgccgagtccgca

SEQ ID NO: 4358 - DNA, 23 bp, synthetic construct
  misc_feature 1..23: note = Description of Artificial Sequence: Syntheticoligonucleotide
  source 1..23: mol_type = other DNA
tcggactcggcgccgagtccgac

SEQ ID NO: 4359 - DNA, 23 bp, synthetic construct
  misc_feature 1..23: note = Description of Artificial Sequence: Syntheticoligonucleotide
  source 1..23: mol_type = other DNA
gtggactcggcgccgagtccacc

SEQ ID NO: 4360 - DNA, 23 bp, synthetic construct
  misc_feature 1..23: note = Description of Artificial Sequence: Syntheticoligonucleotide
  source 1..23: mol_type = other DNA
gctgactcggcgccgagtcagcc

SEQ ID NO: 4361 - DNA, 23 bp, synthetic construct
  misc_feature 1..23: note = Description of Artificial Sequence: Syntheticoligonucleotide
  source 1..23: mol_type = other DNA
cccgactcggcgccgagtcgggc

SEQ ID NO: 4362 - DNA, 23 bp, synthetic construct
  misc_feature 1..23: note = Description of Artificial Sequence: Syntheticoligonucleotide
  source 1..23: mol_type = other DNA
cccgactcggcgccgagtcgggt

SEQ ID NO: 4363 - DNA, 23 bp, synthetic construct
  misc_feature 1..23: note = Description of Artificial Sequence: Syntheticoligonucleotide
  source 1..23: mol_type = other DNA
accgactcggcgccgagtcggtc

SEQ ID NO: 4364 - DNA, 23 bp, synthetic construct
  misc_feature 1..23: note = Description of Artificial Sequence: Syntheticoligonucleotide
  source 1..23: mol_type = other DNA
cacgactcggcgccgagtcgtgc

SEQ ID NO: 4365 - DNA, 23 bp, synthetic construct
  misc_feature 1..23: note = Description of Artificial Sequence: Syntheticoligonucleotide
  source 1..23: mol_type = other DNA
ccagactcggcgccgagtctggc

SEQ ID NO: 4366 - DNA, 23 bp, synthetic construct
  misc_feature 1..23: note = Description of Artificial Sequence: Syntheticoligonucleotide
  source 1..23: mol_type = other DNA
cccgactcggcgccgagtcggga

SEQ ID NO: 4367 - DNA, 23 bp, synthetic construct
  misc_feature 1..23: note = Description of Artificial Sequence: Syntheticoligonucleotide
  source 1..23: mol_type = other DNA
tccgactcggcgccgagtcggac

SEQ ID NO: 4368 - DNA, 23 bp, synthetic construct
  misc_feature 1..23: note = Description of Artificial Sequence: Syntheticoligonucleotide
  source 1..23: mol_type = other DNA
cctgactcggcgccgagtcaggc

SEQ ID NO: 4369 - DNA, 23 bp, synthetic construct
  misc_feature 1..23: note = Description of Artificial Sequence: Syntheticoligonucleotide
  source 1..23: mol_type = other DNA
ggcgactcggcgccgagtcgccc

SEQ ID NO: 4370 - DNA, 23 bp, synthetic construct
  misc_feature 1..23: note = Description of Artificial Sequence: Syntheticoligonucleotide
  source 1..23: mol_type = other DNA
ggcgactcggcgccgagtcgcct

SEQ ID NO: 4371 - DNA, 23 bp, synthetic construct
  misc_feature 1..23: note = Description of Artificial Sequence: Syntheticoligonucleotide
  source 1..23: mol_type = other DNA
agcgactcggcgccgagtcgctc

SEQ ID NO: 4372 - DNA, 23 bp, synthetic construct
  misc_feature 1..23: note = Description of Artificial Sequence: Syntheticoligonucleotide
  source 1..23: mol_type = other DNA
gacgactcggcgccgagtcgtcc

SEQ ID NO: 4373 - DNA, 23 bp, synthetic construct
  misc_feature 1..23: note = Description of Artificial Sequence: Syntheticoligonucleotide
  source 1..23: mol_type = other DNA
ggagactcggcgccgagtctccc

SEQ ID NO: 4374 - DNA, 23 bp, synthetic construct
  misc_feature 1..23: note = Description of Artificial Sequence: Syntheticoligonucleotide
  source 1..23: mol_type = other DNA
ggcgactcggcgccgagtcgcca

SEQ ID NO: 4375 - DNA, 23 bp, synthetic construct
  misc_feature 1..23: note = Description of Artificial Sequence: Syntheticoligonucleotide
  source 1..23: mol_type = other DNA
tgcgactcggcgccgagtcgcac

SEQ ID NO: 4376 - DNA, 23 bp, synthetic construct
  misc_feature 1..23: note = Description of Artificial Sequence: Syntheticoligonucleotide
  source 1..23: mol_type = other DNA
ggtgactcggcgccgagtcaccc

SEQ ID NO: 4377 - DNA, 23 bp, synthetic construct
  misc_feature 1..23: note = Description of Artificial Sequence: Syntheticoligonucleotide
  source 1..23: mol_type = other DNA
cgggactcggcgccgagtcccgt

SEQ ID NO: 4378 - DNA, 23 bp, synthetic construct
  misc_feature 1..23: note = Description of Artificial Sequence: Syntheticoligonucleotide
  source 1..23: mol_type = other DNA
agggactcggcgccgagtccctg

SEQ ID NO: 4379 - DNA, 23 bp, synthetic construct
  misc_feature 1..23: note = Description of Artificial Sequence: Syntheticoligonucleotide
  source 1..23: mol_type = other DNA
caggactcggcgccgagtcctgg

SEQ ID NO: 4380 - DNA, 23 bp, synthetic construct
  misc_feature 1..23: note = Description of Artificial Sequence: Syntheticoligonucleotide
  source 1..23: mol_type = other DNA
cgagactcggcgccgagtctcgg

SEQ ID NO: 4381 - DNA, 23 bp, synthetic construct
  misc_feature 1..23: note = Description of Artificial Sequence: Syntheticoligonucleotide
  source 1..23: mol_type = other DNA
cgggactcggcgccgagtcccga

SEQ ID NO: 4382 - DNA, 23 bp, synthetic construct
  misc_feature 1..23: note = Description of Artificial Sequence: Syntheticoligonucleotide
  source 1..23: mol_type = other DNA
tgggactcggcgccgagtcccag

SEQ ID NO: 4383 - DNA, 23 bp, synthetic construct
  misc_feature 1..23: note = Description of Artificial Sequence: Syntheticoligonucleotide
  source 1..23: mol_type = other DNA
ctggactcggcgccgagtccagg

SEQ ID NO: 4384 - DNA, 23 bp, synthetic construct
  misc_feature 1..23: note = Description of Artificial Sequence: Syntheticoligonucleotide
  source 1..23: mol_type = other DNA
cgtgactcggcgccgagtcacgg

SEQ ID NO: 4385 - DNA, 23 bp, synthetic construct
  misc_feature 1..23: note = Description of Artificial Sequence: Syntheticoligonucleotide
  source 1..23: mol_type = other DNA
ggcgactcggcgccgagtcgccg

SEQ ID NO: 4386 - DNA, 23 bp, synthetic construct
  misc_feature 1..23: note = Description of Artificial Sequence: Syntheticoligonucleotide
  source 1..23: mol_type = other DNA
agcgactcggcgccgagtcgctg

SEQ ID NO: 4387 - DNA, 23 bp, synthetic construct
  misc_feature 1..23: note = Description of Artificial Sequence: Syntheticoligonucleotide
  source 1..23: mol_type = other DNA
gacgactcggcgccgagtcgtcg

SEQ ID NO: 4388 - DNA, 23 bp, synthetic construct
  misc_feature 1..23: note = Description of Artificial Sequence: Syntheticoligonucleotide
  source 1..23: mol_type = other DNA
ggagactcggcgccgagtctccg

SEQ ID NO: 4389 - DNA, 23 bp, synthetic construct
  misc_feature 1..23: note = Description of Artificial Sequence: Syntheticoligonucleotide
  source 1..23: mol_type = other DNA
tgcgactcggcgccgagtcgcag

SEQ ID NO: 4390 - DNA, 23 bp, synthetic construct
  misc_feature 1..23: note = Description of Artificial Sequence: Syntheticoligonucleotide
  source 1..23: mol_type = other DNA
ggtgactcggcgccgagtcaccg

SEQ ID NO: 4391 - DNA, 23 bp, synthetic construct
  misc_feature 1..23: note = Description of Artificial Sequence: Syntheticoligonucleotide
  source 1..23: mol_type = other DNA
acggactcggcgccgagtccgtg

SEQ ID NO: 4392 - DNA, 23 bp, synthetic construct
  misc_feature 1..23: note = Description of Artificial Sequence: Syntheticoligonucleotide
  source 1..23: mol_type = other DNA
ccagactcggcgccgagtctggg

SEQ ID NO: 4393 - DNA, 23 bp, synthetic construct
  misc_feature 1..23: note = Description of Artificial Sequence: Syntheticoligonucleotide
  source 1..23: mol_type = other DNA
tcggactcggcgccgagtccgag

SEQ ID NO: 4394 - DNA, 23 bp, synthetic construct
  misc_feature 1..23: note = Description of Artificial Sequence: Syntheticoligonucleotide
  source 1..23: mol_type = other DNA
cctgactcggcgccgagtcaggg

SEQ ID NO: 4395 - DNA, 23 bp, synthetic construct
  misc_feature 1..23: note = Description of Artificial Sequence: Syntheticoligonucleotide
  source 1..23: mol_type = other DNA
cacgactcggcgccgagtcgtgg

SEQ ID NO: 4396 - DNA, 23 bp, synthetic construct
  misc_feature 1..23: note = Description of Artificial Sequence: Syntheticoligonucleotide
  source 1..23: mol_type = other DNA
gccgactcggcgccgagtcggct

SEQ ID NO: 4397 - DNA, 23 bp, synthetic construct
  misc_feature 1..23: note = Description of Artificial Sequence: Syntheticoligonucleotide
  source 1..23: mol_type = other DNA
gccgactcggcgccgagtcggca

SEQ ID NO: 4398 - DNA, 23 bp, synthetic construct
  misc_feature 1..23: note = Description of Artificial Sequence: Syntheticoligonucleotide
  source 1..23: mol_type = other DNA
cgagactcggcgccgagtctcgc

SEQ ID NO: 4399 - DNA, 23 bp, synthetic construct
  misc_feature 1..23: note = Description of Artificial Sequence: Syntheticoligonucleotide
  source 1..23: mol_type = other DNA
cgtgactcggcgccgagtcacgc

SEQ ID NO: 4400 - DNA, 23 bp, synthetic construct
  misc_feature 1..23: note = Description of Artificial Sequence: Syntheticoligonucleotide
  source 1..23: mol_type = other DNA
caggactcggcgccgagtcctgc

SEQ ID NO: 4401 - DNA, 23 bp, synthetic construct
  misc_feature 1..23: note = Description of Artificial Sequence: Syntheticoligonucleotide
  source 1..23: mol_type = other DNA
ctggactcggcgccgagtccagc

SEQ ID NO: 4402 - DNA, 23 bp, synthetic construct
  misc_feature 1..23: note = Description of Artificial Sequence: Syntheticoligonucleotide
  source 1..23: mol_type = other DNA
gaggactcggcgccgagtcctcg

SEQ ID NO: 4403 - DNA, 23 bp, synthetic construct
  misc_feature 1..23: note = Description of Artificial Sequence: Syntheticoligonucleotide
  source 1..23: mol_type = other DNA
gtggactcggcgccgagtccacg

SEQ ID NO: 4404 - DNA, 23 bp, synthetic construct
  misc_feature 1..23: note = Description of Artificial Sequence: Syntheticoligonucleotide
  source 1..23: mol_type = other DNA
accgactcggcgccgagtcggtg

SEQ ID NO: 4405 - DNA, 23 bp, synthetic construct
  misc_feature 1..23: note = Description of Artificial Sequence: Syntheticoligonucleotide
  source 1..23: mol_type = other DNA
tccgactcggcgccgagtcggag

SEQ ID NO: 4406 - DNA, 23 bp, synthetic construct
  misc_feature 1..23: note = Description of Artificial Sequence: Syntheticoligonucleotide
  source 1..23: mol_type = other DNA
cgggactcggcgccgagtcccgc

SEQ ID NO: 4407 - DNA, 23 bp, synthetic construct
  misc_feature 1..23: note = Description of Artificial Sequence: Syntheticoligonucleotide
  source 1..23: mol_type = other DNA
agggactcggcgccgagtccctc

SEQ ID NO: 4408 - DNA, 23 bp, synthetic construct
  misc_feature 1..23: note = Description of Artificial Sequence: Syntheticoligonucleotide
  source 1..23: mol_type = other DNA
tgggactcggcgccgagtcccac

SEQ ID NO: 4409 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcccatgggagtcnnnn

SEQ ID NO: 4410 - DNA, 23 bp, synthetic construct
  misc_feature 1..23: note = Description of Artificial Sequence: Syntheticoligonucleotide
  source 1..23: mol_type = other DNA
gcggactcccatgggagtccgcc

SEQ ID NO: 4411 - DNA, 23 bp, synthetic construct
  misc_feature 1..23: note = Description of Artificial Sequence: Syntheticoligonucleotide
  source 1..23: mol_type = other DNA
gcggactcccatgggagtccgct

SEQ ID NO: 4412 - DNA, 23 bp, synthetic construct
  misc_feature 1..23: note = Description of Artificial Sequence: Syntheticoligonucleotide
  source 1..23: mol_type = other DNA
acggactcccatgggagtccgtc

SEQ ID NO: 4413 - DNA, 23 bp, synthetic construct
  misc_feature 1..23: note = Description of Artificial Sequence: Syntheticoligonucleotide
  source 1..23: mol_type = other DNA
gaggactcccatgggagtcctcc

SEQ ID NO: 4414 - DNA, 23 bp, synthetic construct
  misc_feature 1..23: note = Description of Artificial Sequence: Syntheticoligonucleotide
  source 1..23: mol_type = other DNA
gcagactcccatgggagtctgcc

SEQ ID NO: 4415 - DNA, 23 bp, synthetic construct
  misc_feature 1..23: note = Description of Artificial Sequence: Syntheticoligonucleotide
  source 1..23: mol_type = other DNA
gcggactcccatgggagtccgca

SEQ ID NO: 4416 - DNA, 23 bp, synthetic construct
  misc_feature 1..23: note = Description of Artificial Sequence: Syntheticoligonucleotide
  source 1..23: mol_type = other DNA
tcggactcccatgggagtccgac

SEQ ID NO: 4417 - DNA, 23 bp, synthetic construct
  misc_feature 1..23: note = Description of Artificial Sequence: Syntheticoligonucleotide
  source 1..23: mol_type = other DNA
gtggactcccatgggagtccacc

SEQ ID NO: 4418 - DNA, 23 bp, synthetic construct
  misc_feature 1..23: note = Description of Artificial Sequence: Syntheticoligonucleotide
  source 1..23: mol_type = other DNA
gctgactcccatgggagtcagcc

SEQ ID NO: 4419 - DNA, 23 bp, synthetic construct
  misc_feature 1..23: note = Description of Artificial Sequence: Syntheticoligonucleotide
  source 1..23: mol_type = other DNA
cccgactcccatgggagtcgggc

SEQ ID NO: 4420 - DNA, 23 bp, synthetic construct
  misc_feature 1..23: note = Description of Artificial Sequence: Syntheticoligonucleotide
  source 1..23: mol_type = other DNA
cccgactcccatgggagtcgggt

SEQ ID NO: 4421 - DNA, 23 bp, synthetic construct
  misc_feature 1..23: note = Description of Artificial Sequence: Syntheticoligonucleotide
  source 1..23: mol_type = other DNA
accgactcccatgggagtcggtc

SEQ ID NO: 4422 - DNA, 23 bp, synthetic construct
  misc_feature 1..23: note = Description of Artificial Sequence: Syntheticoligonucleotide
  source 1..23: mol_type = other DNA
cacgactcccatgggagtcgtgc

SEQ ID NO: 4423 - DNA, 23 bp, synthetic construct
  misc_feature 1..23: note = Description of Artificial Sequence: Syntheticoligonucleotide
  source 1..23: mol_type = other DNA
ccagactcccatgggagtctggc

SEQ ID NO: 4424 - DNA, 23 bp, synthetic construct
  misc_feature 1..23: note = Description of Artificial Sequence: Syntheticoligonucleotide
  source 1..23: mol_type = other DNA
cccgactcccatgggagtcggga

SEQ ID NO: 4425 - DNA, 23 bp, synthetic construct
  misc_feature 1..23: note = Description of Artificial Sequence: Syntheticoligonucleotide
  source 1..23: mol_type = other DNA
tccgactcccatgggagtcggac

SEQ ID NO: 4426 - DNA, 23 bp, synthetic construct
  misc_feature 1..23: note = Description of Artificial Sequence: Syntheticoligonucleotide
  source 1..23: mol_type = other DNA
cctgactcccatgggagtcaggc

SEQ ID NO: 4427 - DNA, 23 bp, synthetic construct
  misc_feature 1..23: note = Description of Artificial Sequence: Syntheticoligonucleotide
  source 1..23: mol_type = other DNA
ggcgactcccatgggagtcgccc

SEQ ID NO: 4428 - DNA, 23 bp, synthetic construct
  misc_feature 1..23: note = Description of Artificial Sequence: Syntheticoligonucleotide
  source 1..23: mol_type = other DNA
ggcgactcccatgggagtcgcct

SEQ ID NO: 4429 - DNA, 23 bp, synthetic construct
  misc_feature 1..23: note = Description of Artificial Sequence: Syntheticoligonucleotide
  source 1..23: mol_type = other DNA
agcgactcccatgggagtcgctc

SEQ ID NO: 4430 - DNA, 23 bp, synthetic construct
  misc_feature 1..23: note = Description of Artificial Sequence: Syntheticoligonucleotide
  source 1..23: mol_type = other DNA
gacgactcccatgggagtcgtcc

SEQ ID NO: 4431 - DNA, 23 bp, synthetic construct
  misc_feature 1..23: note = Description of Artificial Sequence: Syntheticoligonucleotide
  source 1..23: mol_type = other DNA
ggagactcccatgggagtctccc

SEQ ID NO: 4432 - DNA, 23 bp, synthetic construct
  misc_feature 1..23: note = Description of Artificial Sequence: Syntheticoligonucleotide
  source 1..23: mol_type = other DNA
ggcgactcccatgggagtcgcca

SEQ ID NO: 4433 - DNA, 23 bp, synthetic construct
  misc_feature 1..23: note = Description of Artificial Sequence: Syntheticoligonucleotide
  source 1..23: mol_type = other DNA
tgcgactcccatgggagtcgcac

SEQ ID NO: 4434 - DNA, 23 bp, synthetic construct
  misc_feature 1..23: note = Description of Artificial Sequence: Syntheticoligonucleotide
  source 1..23: mol_type = other DNA
ggtgactcccatgggagtcaccc

SEQ ID NO: 4435 - DNA, 23 bp, synthetic construct
  misc_feature 1..23: note = Description of Artificial Sequence: Syntheticoligonucleotide
  source 1..23: mol_type = other DNA
cgggactcccatgggagtcccgt

SEQ ID NO: 4436 - DNA, 23 bp, synthetic construct
  misc_feature 1..23: note = Description of Artificial Sequence: Syntheticoligonucleotide
  source 1..23: mol_type = other DNA
agggactcccatgggagtccctg

SEQ ID NO: 4437 - DNA, 23 bp, synthetic construct
  misc_feature 1..23: note = Description of Artificial Sequence: Syntheticoligonucleotide
  source 1..23: mol_type = other DNA
caggactcccatgggagtcctgg

SEQ ID NO: 4438 - DNA, 23 bp, synthetic construct
  misc_feature 1..23: note = Description of Artificial Sequence: Syntheticoligonucleotide
  source 1..23: mol_type = other DNA
cgagactcccatgggagtctcgg

SEQ ID NO: 4439 - DNA, 23 bp, synthetic construct
  misc_feature 1..23: note = Description of Artificial Sequence: Syntheticoligonucleotide
  source 1..23: mol_type = other DNA
cgggactcccatgggagtcccga

SEQ ID NO: 4440 - DNA, 23 bp, synthetic construct
  misc_feature 1..23: note = Description of Artificial Sequence: Syntheticoligonucleotide
  source 1..23: mol_type = other DNA
tgggactcccatgggagtcccag

SEQ ID NO: 4441 - DNA, 23 bp, synthetic construct
  misc_feature 1..23: note = Description of Artificial Sequence: Syntheticoligonucleotide
  source 1..23: mol_type = other DNA
ctggactcccatgggagtccagg

SEQ ID NO: 4442 - DNA, 23 bp, synthetic construct
  misc_feature 1..23: note = Description of Artificial Sequence: Syntheticoligonucleotide
  source 1..23: mol_type = other DNA
cgtgactcccatgggagtcacgg

SEQ ID NO: 4443 - DNA, 23 bp, synthetic construct
  misc_feature 1..23: note = Description of Artificial Sequence: Syntheticoligonucleotide
  source 1..23: mol_type = other DNA
ggcgactcccatgggagtcgccg

SEQ ID NO: 4444 - DNA, 23 bp, synthetic construct
  misc_feature 1..23: note = Description of Artificial Sequence: Syntheticoligonucleotide
  source 1..23: mol_type = other DNA
agcgactcccatgggagtcgctg

SEQ ID NO: 4445 - DNA, 23 bp, synthetic construct
  misc_feature 1..23: note = Description of Artificial Sequence: Syntheticoligonucleotide
  source 1..23: mol_type = other DNA
gacgactcccatgggagtcgtcg

SEQ ID NO: 4446 - DNA, 23 bp, synthetic construct
  misc_feature 1..23: note = Description of Artificial Sequence: Syntheticoligonucleotide
  source 1..23: mol_type = other DNA
ggagactcccatgggagtctccg

SEQ ID NO: 4447 - DNA, 23 bp, synthetic construct
  misc_feature 1..23: note = Description of Artificial Sequence: Syntheticoligonucleotide
  source 1..23: mol_type = other DNA
tgcgactcccatgggagtcgcag

SEQ ID NO: 4448 - DNA, 23 bp, synthetic construct
  misc_feature 1..23: note = Description of Artificial Sequence: Syntheticoligonucleotide
  source 1..23: mol_type = other DNA
ggtgactcccatgggagtcaccg

SEQ ID NO: 4449 - DNA, 23 bp, synthetic construct
  misc_feature 1..23: note = Description of Artificial Sequence: Syntheticoligonucleotide
  source 1..23: mol_type = other DNA
acggactcccatgggagtccgtg

SEQ ID NO: 4450 - DNA, 23 bp, synthetic construct
  misc_feature 1..23: note = Description of Artificial Sequence: Syntheticoligonucleotide
  source 1..23: mol_type = other DNA
ccagactcccatgggagtctggg

SEQ ID NO: 4451 - DNA, 23 bp, synthetic construct
  misc_feature 1..23: note = Description of Artificial Sequence: Syntheticoligonucleotide
  source 1..23: mol_type = other DNA
tcggactcccatgggagtccgag

SEQ ID NO: 4452 - DNA, 23 bp, synthetic construct
  misc_feature 1..23: note = Description of Artificial Sequence: Syntheticoligonucleotide
  source 1..23: mol_type = other DNA
cctgactcccatgggagtcaggg

SEQ ID NO: 4453 - DNA, 23 bp, synthetic construct
  misc_feature 1..23: note = Description of Artificial Sequence: Syntheticoligonucleotide
  source 1..23: mol_type = other DNA
cacgactcccatgggagtcgtgg

SEQ ID NO: 4454 - DNA, 23 bp, synthetic construct
  misc_feature 1..23: note = Description of Artificial Sequence: Syntheticoligonucleotide
  source 1..23: mol_type = other DNA
gccgactcccatgggagtcggct

SEQ ID NO: 4455 - DNA, 23 bp, synthetic construct
  misc_feature 1..23: note = Description of Artificial Sequence: Syntheticoligonucleotide
  source 1..23: mol_type = other DNA
gccgactcccatgggagtcggca

SEQ ID NO: 4456 - DNA, 23 bp, synthetic construct
  misc_feature 1..23: note = Description of Artificial Sequence: Syntheticoligonucleotide
  source 1..23: mol_type = other DNA
cgagactcccatgggagtctcgc

SEQ ID NO: 4457 - DNA, 23 bp, synthetic construct
  misc_feature 1..23: note = Description of Artificial Sequence: Syntheticoligonucleotide
  source 1..23: mol_type = other DNA
cgtgactcccatgggagtcacgc

SEQ ID NO: 4458 - DNA, 23 bp, synthetic construct
  misc_feature 1..23: note = Description of Artificial Sequence: Syntheticoligonucleotide
  source 1..23: mol_type = other DNA
caggactcccatgggagtcctgc

SEQ ID NO: 4459 - DNA, 23 bp, synthetic construct
  misc_feature 1..23: note = Description of Artificial Sequence: Syntheticoligonucleotide
  source 1..23: mol_type = other DNA
ctggactcccatgggagtccagc

SEQ ID NO: 4460 - DNA, 23 bp, synthetic construct
  misc_feature 1..23: note = Description of Artificial Sequence: Syntheticoligonucleotide
  source 1..23: mol_type = other DNA
gaggactcccatgggagtcctcg

SEQ ID NO: 4461 - DNA, 23 bp, synthetic construct
  misc_feature 1..23: note = Description of Artificial Sequence: Syntheticoligonucleotide
  source 1..23: mol_type = other DNA
gtggactcccatgggagtccacg

SEQ ID NO: 4462 - DNA, 23 bp, synthetic construct
  misc_feature 1..23: note = Description of Artificial Sequence: Syntheticoligonucleotide
  source 1..23: mol_type = other DNA
accgactcccatgggagtcggtg

SEQ ID NO: 4463 - DNA, 23 bp, synthetic construct
  misc_feature 1..23: note = Description of Artificial Sequence: Syntheticoligonucleotide
  source 1..23: mol_type = other DNA
tccgactcccatgggagtcggag

SEQ ID NO: 4464 - DNA, 23 bp, synthetic construct
  misc_feature 1..23: note = Description of Artificial Sequence: Syntheticoligonucleotide
  source 1..23: mol_type = other DNA
cgggactcccatgggagtcccgc

SEQ ID NO: 4465 - DNA, 23 bp, synthetic construct
  misc_feature 1..23: note = Description of Artificial Sequence: Syntheticoligonucleotide
  source 1..23: mol_type = other DNA
agggactcccatgggagtccctc

SEQ ID NO: 4466 - DNA, 23 bp, synthetic construct
  misc_feature 1..23: note = Description of Artificial Sequence: Syntheticoligonucleotide
  source 1..23: mol_type = other DNA
tgggactcccatgggagtcccac

SEQ ID NO: 4467 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactccctagggagtcnnnn

SEQ ID NO: 4468 - DNA, 23 bp, synthetic construct
  misc_feature 1..23: note = Description of Artificial Sequence: Syntheticoligonucleotide
  source 1..23: mol_type = other DNA
gcggactccctagggagtccgcc

SEQ ID NO: 4469 - DNA, 23 bp, synthetic construct
  misc_feature 1..23: note = Description of Artificial Sequence: Syntheticoligonucleotide
  source 1..23: mol_type = other DNA
gcggactccctagggagtccgct

SEQ ID NO: 4470 - DNA, 23 bp, synthetic construct
  misc_feature 1..23: note = Description of Artificial Sequence: Syntheticoligonucleotide
  source 1..23: mol_type = other DNA
acggactccctagggagtccgtc

SEQ ID NO: 4471 - DNA, 23 bp, synthetic construct
  misc_feature 1..23: note = Description of Artificial Sequence: Syntheticoligonucleotide
  source 1..23: mol_type = other DNA
gaggactccctagggagtcctcc

SEQ ID NO: 4472 - DNA, 23 bp, synthetic construct
  misc_feature 1..23: note = Description of Artificial Sequence: Syntheticoligonucleotide
  source 1..23: mol_type = other DNA
gcagactccctagggagtctgcc

SEQ ID NO: 4473 - DNA, 23 bp, synthetic construct
  misc_feature 1..23: note = Description of Artificial Sequence: Syntheticoligonucleotide
  source 1..23: mol_type = other DNA
gcggactccctagggagtccgca

SEQ ID NO: 4474 - DNA, 23 bp, synthetic construct
  misc_feature 1..23: note = Description of Artificial Sequence: Syntheticoligonucleotide
  source 1..23: mol_type = other DNA
tcggactccctagggagtccgac

SEQ ID NO: 4475 - DNA, 23 bp, synthetic construct
  misc_feature 1..23: note = Description of Artificial Sequence: Syntheticoligonucleotide
  source 1..23: mol_type = other DNA
gtggactccctagggagtccacc

SEQ ID NO: 4476 - DNA, 23 bp, synthetic construct
  misc_feature 1..23: note = Description of Artificial Sequence: Syntheticoligonucleotide
  source 1..23: mol_type = other DNA
gctgactccctagggagtcagcc

SEQ ID NO: 4477 - DNA, 23 bp, synthetic construct
  misc_feature 1..23: note = Description of Artificial Sequence: Syntheticoligonucleotide
  source 1..23: mol_type = other DNA
cccgactccctagggagtcgggc

SEQ ID NO: 4478 - DNA, 23 bp, synthetic construct
  misc_feature 1..23: note = Description of Artificial Sequence: Syntheticoligonucleotide
  source 1..23: mol_type = other DNA
cccgactccctagggagtcgggt

SEQ ID NO: 4479 - DNA, 23 bp, synthetic construct
  misc_feature 1..23: note = Description of Artificial Sequence: Syntheticoligonucleotide
  source 1..23: mol_type = other DNA
accgactccctagggagtcggtc

SEQ ID NO: 4480 - DNA, 23 bp, synthetic construct
  misc_feature 1..23: note = Description of Artificial Sequence: Syntheticoligonucleotide
  source 1..23: mol_type = other DNA
cacgactccctagggagtcgtgc

SEQ ID NO: 4481 - DNA, 23 bp, synthetic construct
  misc_feature 1..23: note = Description of Artificial Sequence: Syntheticoligonucleotide
  source 1..23: mol_type = other DNA
ccagactccctagggagtctggc

SEQ ID NO: 4482 - DNA, 23 bp, synthetic construct
  misc_feature 1..23: note = Description of Artificial Sequence: Syntheticoligonucleotide
  source 1..23: mol_type = other DNA
cccgactccctagggagtcggga

SEQ ID NO: 4483 - DNA, 23 bp, synthetic construct
  misc_feature 1..23: note = Description of Artificial Sequence: Syntheticoligonucleotide
  source 1..23: mol_type = other DNA
tccgactccctagggagtcggac

SEQ ID NO: 4484 - DNA, 23 bp, synthetic construct
  misc_feature 1..23: note = Description of Artificial Sequence: Syntheticoligonucleotide
  source 1..23: mol_type = other DNA
cctgactccctagggagtcaggc

SEQ ID NO: 4485 - DNA, 23 bp, synthetic construct
  misc_feature 1..23: note = Description of Artificial Sequence: Syntheticoligonucleotide
  source 1..23: mol_type = other DNA
ggcgactccctagggagtcgccc

SEQ ID NO: 4486 - DNA, 23 bp, synthetic construct
  misc_feature 1..23: note = Description of Artificial Sequence: Syntheticoligonucleotide
  source 1..23: mol_type = other DNA
ggcgactccctagggagtcgcct

SEQ ID NO: 4487 - DNA, 23 bp, synthetic construct
  misc_feature 1..23: note = Description of Artificial Sequence: Syntheticoligonucleotide
  source 1..23: mol_type = other DNA
agcgactccctagggagtcgctc

SEQ ID NO: 4488 - DNA, 23 bp, synthetic construct
  misc_feature 1..23: note = Description of Artificial Sequence: Syntheticoligonucleotide
  source 1..23: mol_type = other DNA
gacgactccctagggagtcgtcc

SEQ ID NO: 4489 - DNA, 23 bp, synthetic construct
  misc_feature 1..23: note = Description of Artificial Sequence: Syntheticoligonucleotide
  source 1..23: mol_type = other DNA
ggagactccctagggagtctccc

SEQ ID NO: 4490 - DNA, 23 bp, synthetic construct
  misc_feature 1..23: note = Description of Artificial Sequence: Syntheticoligonucleotide
  source 1..23: mol_type = other DNA
ggcgactccctagggagtcgcca

SEQ ID NO: 4491 - DNA, 23 bp, synthetic construct
  misc_feature 1..23: note = Description of Artificial Sequence: Syntheticoligonucleotide
  source 1..23: mol_type = other DNA
tgcgactccctagggagtcgcac

SEQ ID NO: 4492 - DNA, 23 bp, synthetic construct
  misc_feature 1..23: note = Description of Artificial Sequence: Syntheticoligonucleotide
  source 1..23: mol_type = other DNA
ggtgactccctagggagtcaccc

SEQ ID NO: 4493 - DNA, 23 bp, synthetic construct
  misc_feature 1..23: note = Description of Artificial Sequence: Syntheticoligonucleotide
  source 1..23: mol_type = other DNA
cgggactccctagggagtcccgt

SEQ ID NO: 4494 - DNA, 23 bp, synthetic construct
  misc_feature 1..23: note = Description of Artificial Sequence: Syntheticoligonucleotide
  source 1..23: mol_type = other DNA
agggactccctagggagtccctg

SEQ ID NO: 4495 - DNA, 23 bp, synthetic construct
  misc_feature 1..23: note = Description of Artificial Sequence: Syntheticoligonucleotide
  source 1..23: mol_type = other DNA
caggactccctagggagtcctgg

SEQ ID NO: 4496 - DNA, 23 bp, synthetic construct
  misc_feature 1..23: note = Description of Artificial Sequence: Syntheticoligonucleotide
  source 1..23: mol_type = other DNA
cgagactccctagggagtctcgg

SEQ ID NO: 4497 - DNA, 23 bp, synthetic construct
  misc_feature 1..23: note = Description of Artificial Sequence: Syntheticoligonucleotide
  source 1..23: mol_type = other DNA
cgggactccctagggagtcccga

SEQ ID NO: 4498 - DNA, 23 bp, synthetic construct
  misc_feature 1..23: note = Description of Artificial Sequence: Syntheticoligonucleotide
  source 1..23: mol_type = other DNA
tgggactccctagggagtcccag

SEQ ID NO: 4499 - DNA, 23 bp, synthetic construct
  misc_feature 1..23: note = Description of Artificial Sequence: Syntheticoligonucleotide
  source 1..23: mol_type = other DNA
ctggactccctagggagtccagg

SEQ ID NO: 4500 - DNA, 23 bp, synthetic construct
  misc_feature 1..23: note = Description of Artificial Sequence: Syntheticoligonucleotide
  source 1..23: mol_type = other DNA
cgtgactccctagggagtcacgg

SEQ ID NO: 4501 - DNA, 23 bp, synthetic construct
  misc_feature 1..23: note = Description of Artificial Sequence: Syntheticoligonucleotide
  source 1..23: mol_type = other DNA
ggcgactccctagggagtcgccg

SEQ ID NO: 4502 - DNA, 23 bp, synthetic construct
  misc_feature 1..23: note = Description of Artificial Sequence: Syntheticoligonucleotide
  source 1..23: mol_type = other DNA
agcgactccctagggagtcgctg

SEQ ID NO: 4503 - DNA, 23 bp, synthetic construct
  misc_feature 1..23: note = Description of Artificial Sequence: Syntheticoligonucleotide
  source 1..23: mol_type = other DNA
gacgactccctagggagtcgtcg

SEQ ID NO: 4504 - DNA, 23 bp, synthetic construct
  misc_feature 1..23: note = Description of Artificial Sequence: Syntheticoligonucleotide
  source 1..23: mol_type = other DNA
ggagactccctagggagtctccg

SEQ ID NO: 4505 - DNA, 23 bp, synthetic construct
  misc_feature 1..23: note = Description of Artificial Sequence: Syntheticoligonucleotide
  source 1..23: mol_type = other DNA
tgcgactccctagggagtcgcag

SEQ ID NO: 4506 - DNA, 23 bp, synthetic construct
  misc_feature 1..23: note = Description of Artificial Sequence: Syntheticoligonucleotide
  source 1..23: mol_type = other DNA
ggtgactccctagggagtcaccg

SEQ ID NO: 4507 - DNA, 23 bp, synthetic construct
  misc_feature 1..23: note = Description of Artificial Sequence: Syntheticoligonucleotide
  source 1..23: mol_type = other DNA
acggactccctagggagtccgtg

SEQ ID NO: 4508 - DNA, 23 bp, synthetic construct
  misc_feature 1..23: note = Description of Artificial Sequence: Syntheticoligonucleotide
  source 1..23: mol_type = other DNA
ccagactccctagggagtctggg

SEQ ID NO: 4509 - DNA, 23 bp, synthetic construct
  misc_feature 1..23: note = Description of Artificial Sequence: Syntheticoligonucleotide
  source 1..23: mol_type = other DNA
tcggactccctagggagtccgag

SEQ ID NO: 4510 - DNA, 23 bp, synthetic construct
  misc_feature 1..23: note = Description of Artificial Sequence: Syntheticoligonucleotide
  source 1..23: mol_type = other DNA
cctgactccctagggagtcaggg

SEQ ID NO: 4511 - DNA, 23 bp, synthetic construct
  misc_feature 1..23: note = Description of Artificial Sequence: Syntheticoligonucleotide
  source 1..23: mol_type = other DNA
cacgactccctagggagtcgtgg

SEQ ID NO: 4512 - DNA, 23 bp, synthetic construct
  misc_feature 1..23: note = Description of Artificial Sequence: Syntheticoligonucleotide
  source 1..23: mol_type = other DNA
gccgactccctagggagtcggct

SEQ ID NO: 4513 - DNA, 23 bp, synthetic construct
  misc_feature 1..23: note = Description of Artificial Sequence: Syntheticoligonucleotide
  source 1..23: mol_type = other DNA
gccgactccctagggagtcggca

SEQ ID NO: 4514 - DNA, 23 bp, synthetic construct
  misc_feature 1..23: note = Description of Artificial Sequence: Syntheticoligonucleotide
  source 1..23: mol_type = other DNA
cgagactccctagggagtctcgc

SEQ ID NO: 4515 - DNA, 23 bp, synthetic construct
  misc_feature 1..23: note = Description of Artificial Sequence: Syntheticoligonucleotide
  source 1..23: mol_type = other DNA
cgtgactccctagggagtcacgc

SEQ ID NO: 4516 - DNA, 23 bp, synthetic construct
  misc_feature 1..23: note = Description of Artificial Sequence: Syntheticoligonucleotide
  source 1..23: mol_type = other DNA
caggactccctagggagtcctgc

SEQ ID NO: 4517 - DNA, 23 bp, synthetic construct
  misc_feature 1..23: note = Description of Artificial Sequence: Syntheticoligonucleotide
  source 1..23: mol_type = other DNA
ctggactccctagggagtccagc

SEQ ID NO: 4518 - DNA, 23 bp, synthetic construct
  misc_feature 1..23: note = Description of Artificial Sequence: Syntheticoligonucleotide
  source 1..23: mol_type = other DNA
gaggactccctagggagtcctcg

SEQ ID NO: 4519 - DNA, 23 bp, synthetic construct
  misc_feature 1..23: note = Description of Artificial Sequence: Syntheticoligonucleotide
  source 1..23: mol_type = other DNA
gtggactccctagggagtccacg

SEQ ID NO: 4520 - DNA, 23 bp, synthetic construct
  misc_feature 1..23: note = Description of Artificial Sequence: Syntheticoligonucleotide
  source 1..23: mol_type = other DNA
accgactccctagggagtcggtg

SEQ ID NO: 4521 - DNA, 23 bp, synthetic construct
  misc_feature 1..23: note = Description of Artificial Sequence: Syntheticoligonucleotide
  source 1..23: mol_type = other DNA
tccgactccctagggagtcggag

SEQ ID NO: 4522 - DNA, 23 bp, synthetic construct
  misc_feature 1..23: note = Description of Artificial Sequence: Syntheticoligonucleotide
  source 1..23: mol_type = other DNA
cgggactccctagggagtcccgc

SEQ ID NO: 4523 - DNA, 23 bp, synthetic construct
  misc_feature 1..23: note = Description of Artificial Sequence: Syntheticoligonucleotide
  source 1..23: mol_type = other DNA
agggactccctagggagtccctc

SEQ ID NO: 4524 - DNA, 23 bp, synthetic construct
  misc_feature 1..23: note = Description of Artificial Sequence: Syntheticoligonucleotide
  source 1..23: mol_type = other DNA
tgggactccctagggagtcccac

SEQ ID NO: 4525 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcccgcgggagtcnnnn

SEQ ID NO: 4526 - DNA, 23 bp, synthetic construct
  misc_feature 1..23: note = Description of Artificial Sequence: Syntheticoligonucleotide
  source 1..23: mol_type = other DNA
gcggactcccgcgggagtccgcc

SEQ ID NO: 4527 - DNA, 23 bp, synthetic construct
  misc_feature 1..23: note = Description of Artificial Sequence: Syntheticoligonucleotide
  source 1..23: mol_type = other DNA
gcggactcccgcgggagtccgct

SEQ ID NO: 4528 - DNA, 23 bp, synthetic construct
  misc_feature 1..23: note = Description of Artificial Sequence: Syntheticoligonucleotide
  source 1..23: mol_type = other DNA
acggactcccgcgggagtccgtc

SEQ ID NO: 4529 - DNA, 23 bp, synthetic construct
  misc_feature 1..23: note = Description of Artificial Sequence: Syntheticoligonucleotide
  source 1..23: mol_type = other DNA
gaggactcccgcgggagtcctcc

SEQ ID NO: 4530 - DNA, 23 bp, synthetic construct
  misc_feature 1..23: note = Description of Artificial Sequence: Syntheticoligonucleotide
  source 1..23: mol_type = other DNA
gcagactcccgcgggagtctgcc

SEQ ID NO: 4531 - DNA, 23 bp, synthetic construct
  misc_feature 1..23: note = Description of Artificial Sequence: Syntheticoligonucleotide
  source 1..23: mol_type = other DNA
gcggactcccgcgggagtccgca

SEQ ID NO: 4532 - DNA, 23 bp, synthetic construct
  misc_feature 1..23: note = Description of Artificial Sequence: Syntheticoligonucleotide
  source 1..23: mol_type = other DNA
tcggactcccgcgggagtccgac

SEQ ID NO: 4533 - DNA, 23 bp, synthetic construct
  misc_feature 1..23: note = Description of Artificial Sequence: Syntheticoligonucleotide
  source 1..23: mol_type = other DNA
gtggactcccgcgggagtccacc

SEQ ID NO: 4534 - DNA, 23 bp, synthetic construct
  misc_feature 1..23: note = Description of Artificial Sequence: Syntheticoligonucleotide
  source 1..23: mol_type = other DNA
gctgactcccgcgggagtcagcc

SEQ ID NO: 4535 - DNA, 23 bp, synthetic construct
  misc_feature 1..23: note = Description of Artificial Sequence: Syntheticoligonucleotide
  source 1..23: mol_type = other DNA
cccgactcccgcgggagtcgggc

SEQ ID NO: 4536 - DNA, 23 bp, synthetic construct
  misc_feature 1..23: note = Description of Artificial Sequence: Syntheticoligonucleotide
  source 1..23: mol_type = other DNA
cccgactcccgcgggagtcgggt

SEQ ID NO: 4537 - DNA, 23 bp, synthetic construct
  misc_feature 1..23: note = Description of Artificial Sequence: Syntheticoligonucleotide
  source 1..23: mol_type = other DNA
accgactcccgcgggagtcggtc

SEQ ID NO: 4538 - DNA, 23 bp, synthetic construct
  misc_feature 1..23: note = Description of Artificial Sequence: Syntheticoligonucleotide
  source 1..23: mol_type = other DNA
cacgactcccgcgggagtcgtgc

SEQ ID NO: 4539 - DNA, 23 bp, synthetic construct
  misc_feature 1..23: note = Description of Artificial Sequence: Syntheticoligonucleotide
  source 1..23: mol_type = other DNA
ccagactcccgcgggagtctggc

SEQ ID NO: 4540 - DNA, 23 bp, synthetic construct
  misc_feature 1..23: note = Description of Artificial Sequence: Syntheticoligonucleotide
  source 1..23: mol_type = other DNA
cccgactcccgcgggagtcggga

SEQ ID NO: 4541 - DNA, 23 bp, synthetic construct
  misc_feature 1..23: note = Description of Artificial Sequence: Syntheticoligonucleotide
  source 1..23: mol_type = other DNA
tccgactcccgcgggagtcggac

SEQ ID NO: 4542 - DNA, 23 bp, synthetic construct
  misc_feature 1..23: note = Description of Artificial Sequence: Syntheticoligonucleotide
  source 1..23: mol_type = other DNA
cctgactcccgcgggagtcaggc

SEQ ID NO: 4543 - DNA, 23 bp, synthetic construct
  misc_feature 1..23: note = Description of Artificial Sequence: Syntheticoligonucleotide
  source 1..23: mol_type = other DNA
ggcgactcccgcgggagtcgccc

SEQ ID NO: 4544 - DNA, 23 bp, synthetic construct
  misc_feature 1..23: note = Description of Artificial Sequence: Syntheticoligonucleotide
  source 1..23: mol_type = other DNA
ggcgactcccgcgggagtcgcct

SEQ ID NO: 4545 - DNA, 23 bp, synthetic construct
  misc_feature 1..23: note = Description of Artificial Sequence: Syntheticoligonucleotide
  source 1..23: mol_type = other DNA
agcgactcccgcgggagtcgctc

SEQ ID NO: 4546 - DNA, 23 bp, synthetic construct
  misc_feature 1..23: note = Description of Artificial Sequence: Syntheticoligonucleotide
  source 1..23: mol_type = other DNA
gacgactcccgcgggagtcgtcc

SEQ ID NO: 4547 - DNA, 23 bp, synthetic construct
  misc_feature 1..23: note = Description of Artificial Sequence: Syntheticoligonucleotide
  source 1..23: mol_type = other DNA
ggagactcccgcgggagtctccc

SEQ ID NO: 4548 - DNA, 23 bp, synthetic construct
  misc_feature 1..23: note = Description of Artificial Sequence: Syntheticoligonucleotide
  source 1..23: mol_type = other DNA
ggcgactcccgcgggagtcgcca

SEQ ID NO: 4549 - DNA, 23 bp, synthetic construct
  misc_feature 1..23: note = Description of Artificial Sequence: Syntheticoligonucleotide
  source 1..23: mol_type = other DNA
tgcgactcccgcgggagtcgcac

SEQ ID NO: 4550 - DNA, 23 bp, synthetic construct
  misc_feature 1..23: note = Description of Artificial Sequence: Syntheticoligonucleotide
  source 1..23: mol_type = other DNA
ggtgactcccgcgggagtcaccc

SEQ ID NO: 4551 - DNA, 23 bp, synthetic construct
  misc_feature 1..23: note = Description of Artificial Sequence: Syntheticoligonucleotide
  source 1..23: mol_type = other DNA
cgggactcccgcgggagtcccgt

SEQ ID NO: 4552 - DNA, 23 bp, synthetic construct
  misc_feature 1..23: note = Description of Artificial Sequence: Syntheticoligonucleotide
  source 1..23: mol_type = other DNA
agggactcccgcgggagtccctg

SEQ ID NO: 4553 - DNA, 23 bp, synthetic construct
  misc_feature 1..23: note = Description of Artificial Sequence: Syntheticoligonucleotide
  source 1..23: mol_type = other DNA
caggactcccgcgggagtcctgg

SEQ ID NO: 4554 - DNA, 23 bp, synthetic construct
  misc_feature 1..23: note = Description of Artificial Sequence: Syntheticoligonucleotide
  source 1..23: mol_type = other DNA
cgagactcccgcgggagtctcgg

SEQ ID NO: 4555 - DNA, 23 bp, synthetic construct
  misc_feature 1..23: note = Description of Artificial Sequence: Syntheticoligonucleotide
  source 1..23: mol_type = other DNA
cgggactcccgcgggagtcccga

SEQ ID NO: 4556 - DNA, 23 bp, synthetic construct
  misc_feature 1..23: note = Description of Artificial Sequence: Syntheticoligonucleotide
  source 1..23: mol_type = other DNA
tgggactcccgcgggagtcccag

SEQ ID NO: 4557 - DNA, 23 bp, synthetic construct
  misc_feature 1..23: note = Description of Artificial Sequence: Syntheticoligonucleotide
  source 1..23: mol_type = other DNA
ctggactcccgcgggagtccagg

SEQ ID NO: 4558 - DNA, 23 bp, synthetic construct
  misc_feature 1..23: note = Description of Artificial Sequence: Syntheticoligonucleotide
  source 1..23: mol_type = other DNA
cgtgactcccgcgggagtcacgg

SEQ ID NO: 4559 - DNA, 23 bp, synthetic construct
  misc_feature 1..23: note = Description of Artificial Sequence: Syntheticoligonucleotide
  source 1..23: mol_type = other DNA
ggcgactcccgcgggagtcgccg

SEQ ID NO: 4560 - DNA, 23 bp, synthetic construct
  misc_feature 1..23: note = Description of Artificial Sequence: Syntheticoligonucleotide
  source 1..23: mol_type = other DNA
agcgactcccgcgggagtcgctg

SEQ ID NO: 4561 - DNA, 23 bp, synthetic construct
  misc_feature 1..23: note = Description of Artificial Sequence: Syntheticoligonucleotide
  source 1..23: mol_type = other DNA
gacgactcccgcgggagtcgtcg

SEQ ID NO: 4562 - DNA, 23 bp, synthetic construct
  misc_feature 1..23: note = Description of Artificial Sequence: Syntheticoligonucleotide
  source 1..23: mol_type = other DNA
ggagactcccgcgggagtctccg

SEQ ID NO: 4563 - DNA, 23 bp, synthetic construct
  misc_feature 1..23: note = Description of Artificial Sequence: Syntheticoligonucleotide
  source 1..23: mol_type = other DNA
tgcgactcccgcgggagtcgcag

SEQ ID NO: 4564 - DNA, 23 bp, synthetic construct
  misc_feature 1..23: note = Description of Artificial Sequence: Syntheticoligonucleotide
  source 1..23: mol_type = other DNA
ggtgactcccgcgggagtcaccg

SEQ ID NO: 4565 - DNA, 23 bp, synthetic construct
  misc_feature 1..23: note = Description of Artificial Sequence: Syntheticoligonucleotide
  source 1..23: mol_type = other DNA
acggactcccgcgggagtccgtg

SEQ ID NO: 4566 - DNA, 23 bp, synthetic construct
  misc_feature 1..23: note = Description of Artificial Sequence: Syntheticoligonucleotide
  source 1..23: mol_type = other DNA
ccagactcccgcgggagtctggg

SEQ ID NO: 4567 - DNA, 23 bp, synthetic construct
  misc_feature 1..23: note = Description of Artificial Sequence: Syntheticoligonucleotide
  source 1..23: mol_type = other DNA
tcggactcccgcgggagtccgag

SEQ ID NO: 4568 - DNA, 23 bp, synthetic construct
  misc_feature 1..23: note = Description of Artificial Sequence: Syntheticoligonucleotide
  source 1..23: mol_type = other DNA
cctgactcccgcgggagtcaggg

SEQ ID NO: 4569 - DNA, 23 bp, synthetic construct
  misc_feature 1..23: note = Description of Artificial Sequence: Syntheticoligonucleotide
  source 1..23: mol_type = other DNA
cacgactcccgcgggagtcgtgg

SEQ ID NO: 4570 - DNA, 23 bp, synthetic construct
  misc_feature 1..23: note = Description of Artificial Sequence: Syntheticoligonucleotide
  source 1..23: mol_type = other DNA
gccgactcccgcgggagtcggct

SEQ ID NO: 4571 - DNA, 23 bp, synthetic construct
  misc_feature 1..23: note = Description of Artificial Sequence: Syntheticoligonucleotide
  source 1..23: mol_type = other DNA
gccgactcccgcgggagtcggca

SEQ ID NO: 4572 - DNA, 23 bp, synthetic construct
  misc_feature 1..23: note = Description of Artificial Sequence: Syntheticoligonucleotide
  source 1..23: mol_type = other DNA
cgagactcccgcgggagtctcgc

SEQ ID NO: 4573 - DNA, 23 bp, synthetic construct
  misc_feature 1..23: note = Description of Artificial Sequence: Syntheticoligonucleotide
  source 1..23: mol_type = other DNA
cgtgactcccgcgggagtcacgc

SEQ ID NO: 4574 - DNA, 23 bp, synthetic construct
  misc_feature 1..23: note = Description of Artificial Sequence: Syntheticoligonucleotide
  source 1..23: mol_type = other DNA
caggactcccgcgggagtcctgc

SEQ ID NO: 4575 - DNA, 23 bp, synthetic construct
  misc_feature 1..23: note = Description of Artificial Sequence: Syntheticoligonucleotide
  source 1..23: mol_type = other DNA
ctggactcccgcgggagtccagc

SEQ ID NO: 4576 - DNA, 23 bp, synthetic construct
  misc_feature 1..23: note = Description of Artificial Sequence: Syntheticoligonucleotide
  source 1..23: mol_type = other DNA
gaggactcccgcgggagtcctcg

SEQ ID NO: 4577 - DNA, 23 bp, synthetic construct
  misc_feature 1..23: note = Description of Artificial Sequence: Syntheticoligonucleotide
  source 1..23: mol_type = other DNA
gtggactcccgcgggagtccacg

SEQ ID NO: 4578 - DNA, 23 bp, synthetic construct
  misc_feature 1..23: note = Description of Artificial Sequence: Syntheticoligonucleotide
  source 1..23: mol_type = other DNA
accgactcccgcgggagtcggtg

SEQ ID NO: 4579 - DNA, 23 bp, synthetic construct
  misc_feature 1..23: note = Description of Artificial Sequence: Syntheticoligonucleotide
  source 1..23: mol_type = other DNA
tccgactcccgcgggagtcggag

SEQ ID NO: 4580 - DNA, 23 bp, synthetic construct
  misc_feature 1..23: note = Description of Artificial Sequence: Syntheticoligonucleotide
  source 1..23: mol_type = other DNA
cgggactcccgcgggagtcccgc

SEQ ID NO: 4581 - DNA, 23 bp, synthetic construct
  misc_feature 1..23: note = Description of Artificial Sequence: Syntheticoligonucleotide
  source 1..23: mol_type = other DNA
agggactcccgcgggagtccctc

SEQ ID NO: 4582 - DNA, 23 bp, synthetic construct
  misc_feature 1..23: note = Description of Artificial Sequence: Syntheticoligonucleotide
  source 1..23: mol_type = other DNA
tgggactcccgcgggagtcccac

SEQ ID NO: 4583 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactccccggggagtcnnnn

SEQ ID NO: 4584 - DNA, 23 bp, synthetic construct
  misc_feature 1..23: note = Description of Artificial Sequence: Syntheticoligonucleotide
  source 1..23: mol_type = other DNA
gcggactccccggggagtccgcc

SEQ ID NO: 4585 - DNA, 23 bp, synthetic construct
  misc_feature 1..23: note = Description of Artificial Sequence: Syntheticoligonucleotide
  source 1..23: mol_type = other DNA
gcggactccccggggagtccgct

SEQ ID NO: 4586 - DNA, 23 bp, synthetic construct
  misc_feature 1..23: note = Description of Artificial Sequence: Syntheticoligonucleotide
  source 1..23: mol_type = other DNA
acggactccccggggagtccgtc

SEQ ID NO: 4587 - DNA, 23 bp, synthetic construct
  misc_feature 1..23: note = Description of Artificial Sequence: Syntheticoligonucleotide
  source 1..23: mol_type = other DNA
gaggactccccggggagtcctcc

SEQ ID NO: 4588 - DNA, 23 bp, synthetic construct
  misc_feature 1..23: note = Description of Artificial Sequence: Syntheticoligonucleotide
  source 1..23: mol_type = other DNA
gcagactccccggggagtctgcc

SEQ ID NO: 4589 - DNA, 23 bp, synthetic construct
  misc_feature 1..23: note = Description of Artificial Sequence: Syntheticoligonucleotide
  source 1..23: mol_type = other DNA
gcggactccccggggagtccgca

SEQ ID NO: 4590 - DNA, 23 bp, synthetic construct
  misc_feature 1..23: note = Description of Artificial Sequence: Syntheticoligonucleotide
  source 1..23: mol_type = other DNA
tcggactccccggggagtccgac

SEQ ID NO: 4591 - DNA, 23 bp, synthetic construct
  misc_feature 1..23: note = Description of Artificial Sequence: Syntheticoligonucleotide
  source 1..23: mol_type = other DNA
gtggactccccggggagtccacc

SEQ ID NO: 4592 - DNA, 23 bp, synthetic construct
  misc_feature 1..23: note = Description of Artificial Sequence: Syntheticoligonucleotide
  source 1..23: mol_type = other DNA
gctgactccccggggagtcagcc

SEQ ID NO: 4593 - DNA, 23 bp, synthetic construct
  misc_feature 1..23: note = Description of Artificial Sequence: Syntheticoligonucleotide
  source 1..23: mol_type = other DNA
cccgactccccggggagtcgggc

SEQ ID NO: 4594 - DNA, 23 bp, synthetic construct
  misc_feature 1..23: note = Description of Artificial Sequence: Syntheticoligonucleotide
  source 1..23: mol_type = other DNA
cccgactccccggggagtcgggt

SEQ ID NO: 4595 - DNA, 23 bp, synthetic construct
  misc_feature 1..23: note = Description of Artificial Sequence: Syntheticoligonucleotide
  source 1..23: mol_type = other DNA
accgactccccggggagtcggtc

SEQ ID NO: 4596 - DNA, 23 bp, synthetic construct
  misc_feature 1..23: note = Description of Artificial Sequence: Syntheticoligonucleotide
  source 1..23: mol_type = other DNA
cacgactccccggggagtcgtgc

SEQ ID NO: 4597 - DNA, 23 bp, synthetic construct
  misc_feature 1..23: note = Description of Artificial Sequence: Syntheticoligonucleotide
  source 1..23: mol_type = other DNA
ccagactccccggggagtctggc

SEQ ID NO: 4598 - DNA, 23 bp, synthetic construct
  misc_feature 1..23: note = Description of Artificial Sequence: Syntheticoligonucleotide
  source 1..23: mol_type = other DNA
cccgactccccggggagtcggga

SEQ ID NO: 4599 - DNA, 23 bp, synthetic construct
  misc_feature 1..23: note = Description of Artificial Sequence: Syntheticoligonucleotide
  source 1..23: mol_type = other DNA
tccgactccccggggagtcggac

SEQ ID NO: 4600 - DNA, 23 bp, synthetic construct
  misc_feature 1..23: note = Description of Artificial Sequence: Syntheticoligonucleotide
  source 1..23: mol_type = other DNA
cctgactccccggggagtcaggc

SEQ ID NO: 4601 - DNA, 23 bp, synthetic construct
  misc_feature 1..23: note = Description of Artificial Sequence: Syntheticoligonucleotide
  source 1..23: mol_type = other DNA
ggcgactccccggggagtcgccc

SEQ ID NO: 4602 - DNA, 23 bp, synthetic construct
  misc_feature 1..23: note = Description of Artificial Sequence: Syntheticoligonucleotide
  source 1..23: mol_type = other DNA
ggcgactccccggggagtcgcct

SEQ ID NO: 4603 - DNA, 23 bp, synthetic construct
  misc_feature 1..23: note = Description of Artificial Sequence: Syntheticoligonucleotide
  source 1..23: mol_type = other DNA
agcgactccccggggagtcgctc

SEQ ID NO: 4604 - DNA, 23 bp, synthetic construct
  misc_feature 1..23: note = Description of Artificial Sequence: Syntheticoligonucleotide
  source 1..23: mol_type = other DNA
gacgactccccggggagtcgtcc

SEQ ID NO: 4605 - DNA, 23 bp, synthetic construct
  misc_feature 1..23: note = Description of Artificial Sequence: Syntheticoligonucleotide
  source 1..23: mol_type = other DNA
ggagactccccggggagtctccc

SEQ ID NO: 4606 - DNA, 23 bp, synthetic construct
  misc_feature 1..23: note = Description of Artificial Sequence: Syntheticoligonucleotide
  source 1..23: mol_type = other DNA
ggcgactccccggggagtcgcca

SEQ ID NO: 4607 - DNA, 23 bp, synthetic construct
  misc_feature 1..23: note = Description of Artificial Sequence: Syntheticoligonucleotide
  source 1..23: mol_type = other DNA
tgcgactccccggggagtcgcac

SEQ ID NO: 4608 - DNA, 23 bp, synthetic construct
  misc_feature 1..23: note = Description of Artificial Sequence: Syntheticoligonucleotide
  source 1..23: mol_type = other DNA
ggtgactccccggggagtcaccc

SEQ ID NO: 4609 - DNA, 23 bp, synthetic construct
  misc_feature 1..23: note = Description of Artificial Sequence: Syntheticoligonucleotide
  source 1..23: mol_type = other DNA
cgggactccccggggagtcccgt

SEQ ID NO: 4610 - DNA, 23 bp, synthetic construct
  misc_feature 1..23: note = Description of Artificial Sequence: Syntheticoligonucleotide
  source 1..23: mol_type = other DNA
agggactccccggggagtccctg

SEQ ID NO: 4611 - DNA, 23 bp, synthetic construct
  misc_feature 1..23: note = Description of Artificial Sequence: Syntheticoligonucleotide
  source 1..23: mol_type = other DNA
caggactccccggggagtcctgg

SEQ ID NO: 4612 - DNA, 23 bp, synthetic construct
  misc_feature 1..23: note = Description of Artificial Sequence: Syntheticoligonucleotide
  source 1..23: mol_type = other DNA
cgagactccccggggagtctcgg

SEQ ID NO: 4613 - DNA, 23 bp, synthetic construct
  misc_feature 1..23: note = Description of Artificial Sequence: Syntheticoligonucleotide
  source 1..23: mol_type = other DNA
cgggactccccggggagtcccga

SEQ ID NO: 4614 - DNA, 23 bp, synthetic construct
  misc_feature 1..23: note = Description of Artificial Sequence: Syntheticoligonucleotide
  source 1..23: mol_type = other DNA
tgggactccccggggagtcccag

SEQ ID NO: 4615 - DNA, 23 bp, synthetic construct
  misc_feature 1..23: note = Description of Artificial Sequence: Syntheticoligonucleotide
  source 1..23: mol_type = other DNA
ctggactccccggggagtccagg

SEQ ID NO: 4616 - DNA, 23 bp, synthetic construct
  misc_feature 1..23: note = Description of Artificial Sequence: Syntheticoligonucleotide
  source 1..23: mol_type = other DNA
cgtgactccccggggagtcacgg

SEQ ID NO: 4617 - DNA, 23 bp, synthetic construct
  misc_feature 1..23: note = Description of Artificial Sequence: Syntheticoligonucleotide
  source 1..23: mol_type = other DNA
ggcgactccccggggagtcgccg

SEQ ID NO: 4618 - DNA, 23 bp, synthetic construct
  misc_feature 1..23: note = Description of Artificial Sequence: Syntheticoligonucleotide
  source 1..23: mol_type = other DNA
agcgactccccggggagtcgctg

SEQ ID NO: 4619 - DNA, 23 bp, synthetic construct
  misc_feature 1..23: note = Description of Artificial Sequence: Syntheticoligonucleotide
  source 1..23: mol_type = other DNA
gacgactccccggggagtcgtcg

SEQ ID NO: 4620 - DNA, 23 bp, synthetic construct
  misc_feature 1..23: note = Description of Artificial Sequence: Syntheticoligonucleotide
  source 1..23: mol_type = other DNA
ggagactccccggggagtctccg

SEQ ID NO: 4621 - DNA, 23 bp, synthetic construct
  misc_feature 1..23: note = Description of Artificial Sequence: Syntheticoligonucleotide
  source 1..23: mol_type = other DNA
tgcgactccccggggagtcgcag

SEQ ID NO: 4622 - DNA, 23 bp, synthetic construct
  misc_feature 1..23: note = Description of Artificial Sequence: Syntheticoligonucleotide
  source 1..23: mol_type = other DNA
ggtgactccccggggagtcaccg

SEQ ID NO: 4623 - DNA, 23 bp, synthetic construct
  misc_feature 1..23: note = Description of Artificial Sequence: Syntheticoligonucleotide
  source 1..23: mol_type = other DNA
acggactccccggggagtccgtg

SEQ ID NO: 4624 - DNA, 23 bp, synthetic construct
  misc_feature 1..23: note = Description of Artificial Sequence: Syntheticoligonucleotide
  source 1..23: mol_type = other DNA
ccagactccccggggagtctggg

SEQ ID NO: 4625 - DNA, 23 bp, synthetic construct
  misc_feature 1..23: note = Description of Artificial Sequence: Syntheticoligonucleotide
  source 1..23: mol_type = other DNA
tcggactccccggggagtccgag

SEQ ID NO: 4626 - DNA, 23 bp, synthetic construct
  misc_feature 1..23: note = Description of Artificial Sequence: Syntheticoligonucleotide
  source 1..23: mol_type = other DNA
cctgactccccggggagtcaggg

SEQ ID NO: 4627 - DNA, 23 bp, synthetic construct
  misc_feature 1..23: note = Description of Artificial Sequence: Syntheticoligonucleotide
  source 1..23: mol_type = other DNA
cacgactccccggggagtcgtgg

SEQ ID NO: 4628 - DNA, 23 bp, synthetic construct
  misc_feature 1..23: note = Description of Artificial Sequence: Syntheticoligonucleotide
  source 1..23: mol_type = other DNA
gccgactccccggggagtcggct

SEQ ID NO: 4629 - DNA, 23 bp, synthetic construct
  misc_feature 1..23: note = Description of Artificial Sequence: Syntheticoligonucleotide
  source 1..23: mol_type = other DNA
gccgactccccggggagtcggca

SEQ ID NO: 4630 - DNA, 23 bp, synthetic construct
  misc_feature 1..23: note = Description of Artificial Sequence: Syntheticoligonucleotide
  source 1..23: mol_type = other DNA
cgagactccccggggagtctcgc

SEQ ID NO: 4631 - DNA, 23 bp, synthetic construct
  misc_feature 1..23: note = Description of Artificial Sequence: Syntheticoligonucleotide
  source 1..23: mol_type = other DNA
cgtgactccccggggagtcacgc

SEQ ID NO: 4632 - DNA, 23 bp, synthetic construct
  misc_feature 1..23: note = Description of Artificial Sequence: Syntheticoligonucleotide
  source 1..23: mol_type = other DNA
caggactccccggggagtcctgc

SEQ ID NO: 4633 - DNA, 23 bp, synthetic construct
  misc_feature 1..23: note = Description of Artificial Sequence: Syntheticoligonucleotide
  source 1..23: mol_type = other DNA
ctggactccccggggagtccagc

SEQ ID NO: 4634 - DNA, 23 bp, synthetic construct
  misc_feature 1..23: note = Description of Artificial Sequence: Syntheticoligonucleotide
  source 1..23: mol_type = other DNA
gaggactccccggggagtcctcg

SEQ ID NO: 4635 - DNA, 23 bp, synthetic construct
  misc_feature 1..23: note = Description of Artificial Sequence: Syntheticoligonucleotide
  source 1..23: mol_type = other DNA
gtggactccccggggagtccacg

SEQ ID NO: 4636 - DNA, 23 bp, synthetic construct
  misc_feature 1..23: note = Description of Artificial Sequence: Syntheticoligonucleotide
  source 1..23: mol_type = other DNA
accgactccccggggagtcggtg

SEQ ID NO: 4637 - DNA, 23 bp, synthetic construct
  misc_feature 1..23: note = Description of Artificial Sequence: Syntheticoligonucleotide
  source 1..23: mol_type = other DNA
tccgactccccggggagtcggag

SEQ ID NO: 4638 - DNA, 23 bp, synthetic construct
  misc_feature 1..23: note = Description of Artificial Sequence: Syntheticoligonucleotide
  source 1..23: mol_type = other DNA
cgggactccccggggagtcccgc

SEQ ID NO: 4639 - DNA, 23 bp, synthetic construct
  misc_feature 1..23: note = Description of Artificial Sequence: Syntheticoligonucleotide
  source 1..23: mol_type = other DNA
agggactccccggggagtccctc

SEQ ID NO: 4640 - DNA, 23 bp, synthetic construct
  misc_feature 1..23: note = Description of Artificial Sequence: Syntheticoligonucleotide
  source 1..23: mol_type = other DNA
tgggactccccggggagtcccac

SEQ ID NO: 4641 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcgtatacgagtcnnnn

SEQ ID NO: 4642 - DNA, 23 bp, synthetic construct
  misc_feature 1..23: note = Description of Artificial Sequence: Syntheticoligonucleotide
  source 1..23: mol_type = other DNA
gcggactcgtatacgagtccgcc

SEQ ID NO: 4643 - DNA, 23 bp, synthetic construct
  misc_feature 1..23: note = Description of Artificial Sequence: Syntheticoligonucleotide
  source 1..23: mol_type = other DNA
gcggactcgtatacgagtccgct

SEQ ID NO: 4644 - DNA, 23 bp, synthetic construct
  misc_feature 1..23: note = Description of Artificial Sequence: Syntheticoligonucleotide
  source 1..23: mol_type = other DNA
acggactcgtatacgagtccgtc

SEQ ID NO: 4645 - DNA, 23 bp, synthetic construct
  misc_feature 1..23: note = Description of Artificial Sequence: Syntheticoligonucleotide
  source 1..23: mol_type = other DNA
gaggactcgtatacgagtcctcc

SEQ ID NO: 4646 - DNA, 23 bp, synthetic construct
  misc_feature 1..23: note = Description of Artificial Sequence: Syntheticoligonucleotide
  source 1..23: mol_type = other DNA
gcagactcgtatacgagtctgcc

SEQ ID NO: 4647 - DNA, 23 bp, synthetic construct
  misc_feature 1..23: note = Description of Artificial Sequence: Syntheticoligonucleotide
  source 1..23: mol_type = other DNA
gcggactcgtatacgagtccgca

SEQ ID NO: 4648 - DNA, 23 bp, synthetic construct
  misc_feature 1..23: note = Description of Artificial Sequence: Syntheticoligonucleotide
  source 1..23: mol_type = other DNA
tcggactcgtatacgagtccgac

SEQ ID NO: 4649 - DNA, 23 bp, synthetic construct
  misc_feature 1..23: note = Description of Artificial Sequence: Syntheticoligonucleotide
  source 1..23: mol_type = other DNA
gtggactcgtatacgagtccacc

SEQ ID NO: 4650 - DNA, 23 bp, synthetic construct
  misc_feature 1..23: note = Description of Artificial Sequence: Syntheticoligonucleotide
  source 1..23: mol_type = other DNA
gctgactcgtatacgagtcagcc

SEQ ID NO: 4651 - DNA, 23 bp, synthetic construct
  misc_feature 1..23: note = Description of Artificial Sequence: Syntheticoligonucleotide
  source 1..23: mol_type = other DNA
cccgactcgtatacgagtcgggc

SEQ ID NO: 4652 - DNA, 23 bp, synthetic construct
  misc_feature 1..23: note = Description of Artificial Sequence: Syntheticoligonucleotide
  source 1..23: mol_type = other DNA
cccgactcgtatacgagtcgggt

SEQ ID NO: 4653 - DNA, 23 bp, synthetic construct
  misc_feature 1..23: note = Description of Artificial Sequence: Syntheticoligonucleotide
  source 1..23: mol_type = other DNA
accgactcgtatacgagtcggtc

SEQ ID NO: 4654 - DNA, 23 bp, synthetic construct
  misc_feature 1..23: note = Description of Artificial Sequence: Syntheticoligonucleotide
  source 1..23: mol_type = other DNA
cacgactcgtatacgagtcgtgc

SEQ ID NO: 4655 - DNA, 23 bp, synthetic construct
  misc_feature 1..23: note = Description of Artificial Sequence: Syntheticoligonucleotide
  source 1..23: mol_type = other DNA
ccagactcgtatacgagtctggc

SEQ ID NO: 4656 - DNA, 23 bp, synthetic construct
  misc_feature 1..23: note = Description of Artificial Sequence: Syntheticoligonucleotide
  source 1..23: mol_type = other DNA
cccgactcgtatacgagtcggga

SEQ ID NO: 4657 - DNA, 23 bp, synthetic construct
  misc_feature 1..23: note = Description of Artificial Sequence: Syntheticoligonucleotide
  source 1..23: mol_type = other DNA
tccgactcgtatacgagtcggac

SEQ ID NO: 4658 - DNA, 23 bp, synthetic construct
  misc_feature 1..23: note = Description of Artificial Sequence: Syntheticoligonucleotide
  source 1..23: mol_type = other DNA
cctgactcgtatacgagtcaggc

SEQ ID NO: 4659 - DNA, 23 bp, synthetic construct
  misc_feature 1..23: note = Description of Artificial Sequence: Syntheticoligonucleotide
  source 1..23: mol_type = other DNA
ggcgactcgtatacgagtcgccc

SEQ ID NO: 4660 - DNA, 23 bp, synthetic construct
  misc_feature 1..23: note = Description of Artificial Sequence: Syntheticoligonucleotide
  source 1..23: mol_type = other DNA
ggcgactcgtatacgagtcgcct

SEQ ID NO: 4661 - DNA, 23 bp, synthetic construct
  misc_feature 1..23: note = Description of Artificial Sequence: Syntheticoligonucleotide
  source 1..23: mol_type = other DNA
agcgactcgtatacgagtcgctc

SEQ ID NO: 4662 - DNA, 23 bp, synthetic construct
  misc_feature 1..23: note = Description of Artificial Sequence: Syntheticoligonucleotide
  source 1..23: mol_type = other DNA
gacgactcgtatacgagtcgtcc

SEQ ID NO: 4663 - DNA, 23 bp, synthetic construct
  misc_feature 1..23: note = Description of Artificial Sequence: Syntheticoligonucleotide
  source 1..23: mol_type = other DNA
ggagactcgtatacgagtctccc

SEQ ID NO: 4664 - DNA, 23 bp, synthetic construct
  misc_feature 1..23: note = Description of Artificial Sequence: Syntheticoligonucleotide
  source 1..23: mol_type = other DNA
ggcgactcgtatacgagtcgcca

SEQ ID NO: 4665 - DNA, 23 bp, synthetic construct
  misc_feature 1..23: note = Description of Artificial Sequence: Syntheticoligonucleotide
  source 1..23: mol_type = other DNA
tgcgactcgtatacgagtcgcac

SEQ ID NO: 4666 - DNA, 23 bp, synthetic construct
  misc_feature 1..23: note = Description of Artificial Sequence: Syntheticoligonucleotide
  source 1..23: mol_type = other DNA
ggtgactcgtatacgagtcaccc

SEQ ID NO: 4667 - DNA, 23 bp, synthetic construct
  misc_feature 1..23: note = Description of Artificial Sequence: Syntheticoligonucleotide
  source 1..23: mol_type = other DNA
cgggactcgtatacgagtcccgt

SEQ ID NO: 4668 - DNA, 23 bp, synthetic construct
  misc_feature 1..23: note = Description of Artificial Sequence: Syntheticoligonucleotide
  source 1..23: mol_type = other DNA
agggactcgtatacgagtccctg

SEQ ID NO: 4669 - DNA, 23 bp, synthetic construct
  misc_feature 1..23: note = Description of Artificial Sequence: Syntheticoligonucleotide
  source 1..23: mol_type = other DNA
caggactcgtatacgagtcctgg

SEQ ID NO: 4670 - DNA, 23 bp, synthetic construct
  misc_feature 1..23: note = Description of Artificial Sequence: Syntheticoligonucleotide
  source 1..23: mol_type = other DNA
cgagactcgtatacgagtctcgg

SEQ ID NO: 4671 - DNA, 23 bp, synthetic construct
  misc_feature 1..23: note = Description of Artificial Sequence: Syntheticoligonucleotide
  source 1..23: mol_type = other DNA
cgggactcgtatacgagtcccga

SEQ ID NO: 4672 - DNA, 23 bp, synthetic construct
  misc_feature 1..23: note = Description of Artificial Sequence: Syntheticoligonucleotide
  source 1..23: mol_type = other DNA
tgggactcgtatacgagtcccag

SEQ ID NO: 4673 - DNA, 23 bp, synthetic construct
  misc_feature 1..23: note = Description of Artificial Sequence: Syntheticoligonucleotide
  source 1..23: mol_type = other DNA
ctggactcgtatacgagtccagg

SEQ ID NO: 4674 - DNA, 23 bp, synthetic construct
  misc_feature 1..23: note = Description of Artificial Sequence: Syntheticoligonucleotide
  source 1..23: mol_type = other DNA
cgtgactcgtatacgagtcacgg

SEQ ID NO: 4675 - DNA, 23 bp, synthetic construct
  misc_feature 1..23: note = Description of Artificial Sequence: Syntheticoligonucleotide
  source 1..23: mol_type = other DNA
ggcgactcgtatacgagtcgccg

SEQ ID NO: 4676 - DNA, 23 bp, synthetic construct
  misc_feature 1..23: note = Description of Artificial Sequence: Syntheticoligonucleotide
  source 1..23: mol_type = other DNA
agcgactcgtatacgagtcgctg

SEQ ID NO: 4677 - DNA, 23 bp, synthetic construct
  misc_feature 1..23: note = Description of Artificial Sequence: Syntheticoligonucleotide
  source 1..23: mol_type = other DNA
gacgactcgtatacgagtcgtcg

SEQ ID NO: 4678 - DNA, 23 bp, synthetic construct
  misc_feature 1..23: note = Description of Artificial Sequence: Syntheticoligonucleotide
  source 1..23: mol_type = other DNA
ggagactcgtatacgagtctccg

SEQ ID NO: 4679 - DNA, 23 bp, synthetic construct
  misc_feature 1..23: note = Description of Artificial Sequence: Syntheticoligonucleotide
  source 1..23: mol_type = other DNA
tgcgactcgtatacgagtcgcag

SEQ ID NO: 4680 - DNA, 23 bp, synthetic construct
  misc_feature 1..23: note = Description of Artificial Sequence: Syntheticoligonucleotide
  source 1..23: mol_type = other DNA
ggtgactcgtatacgagtcaccg

SEQ ID NO: 4681 - DNA, 23 bp, synthetic construct
  misc_feature 1..23: note = Description of Artificial Sequence: Syntheticoligonucleotide
  source 1..23: mol_type = other DNA
acggactcgtatacgagtccgtg

SEQ ID NO: 4682 - DNA, 23 bp, synthetic construct
  misc_feature 1..23: note = Description of Artificial Sequence: Syntheticoligonucleotide
  source 1..23: mol_type = other DNA
ccagactcgtatacgagtctggg

SEQ ID NO: 4683 - DNA, 23 bp, synthetic construct
  misc_feature 1..23: note = Description of Artificial Sequence: Syntheticoligonucleotide
  source 1..23: mol_type = other DNA
tcggactcgtatacgagtccgag

SEQ ID NO: 4684 - DNA, 23 bp, synthetic construct
  misc_feature 1..23: note = Description of Artificial Sequence: Syntheticoligonucleotide
  source 1..23: mol_type = other DNA
cctgactcgtatacgagtcaggg

SEQ ID NO: 4685 - DNA, 23 bp, synthetic construct
  misc_feature 1..23: note = Description of Artificial Sequence: Syntheticoligonucleotide
  source 1..23: mol_type = other DNA
cacgactcgtatacgagtcgtgg

SEQ ID NO: 4686 - DNA, 23 bp, synthetic construct
  misc_feature 1..23: note = Description of Artificial Sequence: Syntheticoligonucleotide
  source 1..23: mol_type = other DNA
gccgactcgtatacgagtcggct

SEQ ID NO: 4687 - DNA, 23 bp, synthetic construct
  misc_feature 1..23: note = Description of Artificial Sequence: Syntheticoligonucleotide
  source 1..23: mol_type = other DNA
gccgactcgtatacgagtcggca

SEQ ID NO: 4688 - DNA, 23 bp, synthetic construct
  misc_feature 1..23: note = Description of Artificial Sequence: Syntheticoligonucleotide
  source 1..23: mol_type = other DNA
cgagactcgtatacgagtctcgc

SEQ ID NO: 4689 - DNA, 23 bp, synthetic construct
  misc_feature 1..23: note = Description of Artificial Sequence: Syntheticoligonucleotide
  source 1..23: mol_type = other DNA
cgtgactcgtatacgagtcacgc

SEQ ID NO: 4690 - DNA, 23 bp, synthetic construct
  misc_feature 1..23: note = Description of Artificial Sequence: Syntheticoligonucleotide
  source 1..23: mol_type = other DNA
caggactcgtatacgagtcctgc

SEQ ID NO: 4691 - DNA, 23 bp, synthetic construct
  misc_feature 1..23: note = Description of Artificial Sequence: Syntheticoligonucleotide
  source 1..23: mol_type = other DNA
ctggactcgtatacgagtccagc

SEQ ID NO: 4692 - DNA, 23 bp, synthetic construct
  misc_feature 1..23: note = Description of Artificial Sequence: Syntheticoligonucleotide
  source 1..23: mol_type = other DNA
gaggactcgtatacgagtcctcg

SEQ ID NO: 4693 - DNA, 23 bp, synthetic construct
  misc_feature 1..23: note = Description of Artificial Sequence: Syntheticoligonucleotide
  source 1..23: mol_type = other DNA
gtggactcgtatacgagtccacg

SEQ ID NO: 4694 - DNA, 23 bp, synthetic construct
  misc_feature 1..23: note = Description of Artificial Sequence: Syntheticoligonucleotide
  source 1..23: mol_type = other DNA
accgactcgtatacgagtcggtg

SEQ ID NO: 4695 - DNA, 23 bp, synthetic construct
  misc_feature 1..23: note = Description of Artificial Sequence: Syntheticoligonucleotide
  source 1..23: mol_type = other DNA
tccgactcgtatacgagtcggag

SEQ ID NO: 4696 - DNA, 23 bp, synthetic construct
  misc_feature 1..23: note = Description of Artificial Sequence: Syntheticoligonucleotide
  source 1..23: mol_type = other DNA
cgggactcgtatacgagtcccgc

SEQ ID NO: 4697 - DNA, 23 bp, synthetic construct
  misc_feature 1..23: note = Description of Artificial Sequence: Syntheticoligonucleotide
  source 1..23: mol_type = other DNA
agggactcgtatacgagtccctc

SEQ ID NO: 4698 - DNA, 23 bp, synthetic construct
  misc_feature 1..23: note = Description of Artificial Sequence: Syntheticoligonucleotide
  source 1..23: mol_type = other DNA
tgggactcgtatacgagtcccac

SEQ ID NO: 4699 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcgttaacgagtcnnnn

SEQ ID NO: 4700 - DNA, 23 bp, synthetic construct
  misc_feature 1..23: note = Description of Artificial Sequence: Syntheticoligonucleotide
  source 1..23: mol_type = other DNA
gcggactcgttaacgagtccgcc

SEQ ID NO: 4701 - DNA, 23 bp, synthetic construct
  misc_feature 1..23: note = Description of Artificial Sequence: Syntheticoligonucleotide
  source 1..23: mol_type = other DNA
gcggactcgttaacgagtccgct

SEQ ID NO: 4702 - DNA, 23 bp, synthetic construct
  misc_feature 1..23: note = Description of Artificial Sequence: Syntheticoligonucleotide
  source 1..23: mol_type = other DNA
acggactcgttaacgagtccgtc

SEQ ID NO: 4703 - DNA, 23 bp, synthetic construct
  misc_feature 1..23: note = Description of Artificial Sequence: Syntheticoligonucleotide
  source 1..23: mol_type = other DNA
gaggactcgttaacgagtcctcc

SEQ ID NO: 4704 - DNA, 23 bp, synthetic construct
  misc_feature 1..23: note = Description of Artificial Sequence: Syntheticoligonucleotide
  source 1..23: mol_type = other DNA
gcagactcgttaacgagtctgcc

SEQ ID NO: 4705 - DNA, 23 bp, synthetic construct
  misc_feature 1..23: note = Description of Artificial Sequence: Syntheticoligonucleotide
  source 1..23: mol_type = other DNA
gcggactcgttaacgagtccgca

SEQ ID NO: 4706 - DNA, 23 bp, synthetic construct
  misc_feature 1..23: note = Description of Artificial Sequence: Syntheticoligonucleotide
  source 1..23: mol_type = other DNA
tcggactcgttaacgagtccgac

SEQ ID NO: 4707 - DNA, 23 bp, synthetic construct
  misc_feature 1..23: note = Description of Artificial Sequence: Syntheticoligonucleotide
  source 1..23: mol_type = other DNA
gtggactcgttaacgagtccacc

SEQ ID NO: 4708 - DNA, 23 bp, synthetic construct
  misc_feature 1..23: note = Description of Artificial Sequence: Syntheticoligonucleotide
  source 1..23: mol_type = other DNA
gctgactcgttaacgagtcagcc

SEQ ID NO: 4709 - DNA, 23 bp, synthetic construct
  misc_feature 1..23: note = Description of Artificial Sequence: Syntheticoligonucleotide
  source 1..23: mol_type = other DNA
cccgactcgttaacgagtcgggc

SEQ ID NO: 4710 - DNA, 23 bp, synthetic construct
  misc_feature 1..23: note = Description of Artificial Sequence: Syntheticoligonucleotide
  source 1..23: mol_type = other DNA
cccgactcgttaacgagtcgggt

SEQ ID NO: 4711 - DNA, 23 bp, synthetic construct
  misc_feature 1..23: note = Description of Artificial Sequence: Syntheticoligonucleotide
  source 1..23: mol_type = other DNA
accgactcgttaacgagtcggtc

SEQ ID NO: 4712 - DNA, 23 bp, synthetic construct
  misc_feature 1..23: note = Description of Artificial Sequence: Syntheticoligonucleotide
  source 1..23: mol_type = other DNA
cacgactcgttaacgagtcgtgc

SEQ ID NO: 4713 - DNA, 23 bp, synthetic construct
  misc_feature 1..23: note = Description of Artificial Sequence: Syntheticoligonucleotide
  source 1..23: mol_type = other DNA
ccagactcgttaacgagtctggc

SEQ ID NO: 4714 - DNA, 23 bp, synthetic construct
  misc_feature 1..23: note = Description of Artificial Sequence: Syntheticoligonucleotide
  source 1..23: mol_type = other DNA
cccgactcgttaacgagtcggga

SEQ ID NO: 4715 - DNA, 23 bp, synthetic construct
  misc_feature 1..23: note = Description of Artificial Sequence: Syntheticoligonucleotide
  source 1..23: mol_type = other DNA
tccgactcgttaacgagtcggac

SEQ ID NO: 4716 - DNA, 23 bp, synthetic construct
  misc_feature 1..23: note = Description of Artificial Sequence: Syntheticoligonucleotide
  source 1..23: mol_type = other DNA
cctgactcgttaacgagtcaggc

SEQ ID NO: 4717 - DNA, 23 bp, synthetic construct
  misc_feature 1..23: note = Description of Artificial Sequence: Syntheticoligonucleotide
  source 1..23: mol_type = other DNA
ggcgactcgttaacgagtcgccc

SEQ ID NO: 4718 - DNA, 23 bp, synthetic construct
  misc_feature 1..23: note = Description of Artificial Sequence: Syntheticoligonucleotide
  source 1..23: mol_type = other DNA
ggcgactcgttaacgagtcgcct

SEQ ID NO: 4719 - DNA, 23 bp, synthetic construct
  misc_feature 1..23: note = Description of Artificial Sequence: Syntheticoligonucleotide
  source 1..23: mol_type = other DNA
agcgactcgttaacgagtcgctc

SEQ ID NO: 4720 - DNA, 23 bp, synthetic construct
  misc_feature 1..23: note = Description of Artificial Sequence: Syntheticoligonucleotide
  source 1..23: mol_type = other DNA
gacgactcgttaacgagtcgtcc

SEQ ID NO: 4721 - DNA, 23 bp, synthetic construct
  misc_feature 1..23: note = Description of Artificial Sequence: Syntheticoligonucleotide
  source 1..23: mol_type = other DNA
ggagactcgttaacgagtctccc

SEQ ID NO: 4722 - DNA, 23 bp, synthetic construct
  misc_feature 1..23: note = Description of Artificial Sequence: Syntheticoligonucleotide
  source 1..23: mol_type = other DNA
ggcgactcgttaacgagtcgcca

SEQ ID NO: 4723 - DNA, 23 bp, synthetic construct
  misc_feature 1..23: note = Description of Artificial Sequence: Syntheticoligonucleotide
  source 1..23: mol_type = other DNA
tgcgactcgttaacgagtcgcac

SEQ ID NO: 4724 - DNA, 23 bp, synthetic construct
  misc_feature 1..23: note = Description of Artificial Sequence: Syntheticoligonucleotide
  source 1..23: mol_type = other DNA
ggtgactcgttaacgagtcaccc

SEQ ID NO: 4725 - DNA, 23 bp, synthetic construct
  misc_feature 1..23: note = Description of Artificial Sequence: Syntheticoligonucleotide
  source 1..23: mol_type = other DNA
cgggactcgttaacgagtcccgt

SEQ ID NO: 4726 - DNA, 23 bp, synthetic construct
  misc_feature 1..23: note = Description of Artificial Sequence: Syntheticoligonucleotide
  source 1..23: mol_type = other DNA
agggactcgttaacgagtccctg

SEQ ID NO: 4727 - DNA, 23 bp, synthetic construct
  misc_feature 1..23: note = Description of Artificial Sequence: Syntheticoligonucleotide
  source 1..23: mol_type = other DNA
caggactcgttaacgagtcctgg

SEQ ID NO: 4728 - DNA, 23 bp, synthetic construct
  misc_feature 1..23: note = Description of Artificial Sequence: Syntheticoligonucleotide
  source 1..23: mol_type = other DNA
cgagactcgttaacgagtctcgg

SEQ ID NO: 4729 - DNA, 23 bp, synthetic construct
  misc_feature 1..23: note = Description of Artificial Sequence: Syntheticoligonucleotide
  source 1..23: mol_type = other DNA
cgggactcgttaacgagtcccga

SEQ ID NO: 4730 - DNA, 23 bp, synthetic construct
  misc_feature 1..23: note = Description of Artificial Sequence: Syntheticoligonucleotide
  source 1..23: mol_type = other DNA
tgggactcgttaacgagtcccag

SEQ ID NO: 4731 - DNA, 23 bp, synthetic construct
  misc_feature 1..23: note = Description of Artificial Sequence: Syntheticoligonucleotide
  source 1..23: mol_type = other DNA
ctggactcgttaacgagtccagg

SEQ ID NO: 4732 - DNA, 23 bp, synthetic construct
  misc_feature 1..23: note = Description of Artificial Sequence: Syntheticoligonucleotide
  source 1..23: mol_type = other DNA
cgtgactcgttaacgagtcacgg

SEQ ID NO: 4733 - DNA, 23 bp, synthetic construct
  misc_feature 1..23: note = Description of Artificial Sequence: Syntheticoligonucleotide
  source 1..23: mol_type = other DNA
ggcgactcgttaacgagtcgccg

SEQ ID NO: 4734 - DNA, 23 bp, synthetic construct
  misc_feature 1..23: note = Description of Artificial Sequence: Syntheticoligonucleotide
  source 1..23: mol_type = other DNA
agcgactcgttaacgagtcgctg

SEQ ID NO: 4735 - DNA, 23 bp, synthetic construct
  misc_feature 1..23: note = Description of Artificial Sequence: Syntheticoligonucleotide
  source 1..23: mol_type = other DNA
gacgactcgttaacgagtcgtcg

SEQ ID NO: 4736 - DNA, 23 bp, synthetic construct
  misc_feature 1..23: note = Description of Artificial Sequence: Syntheticoligonucleotide
  source 1..23: mol_type = other DNA
ggagactcgttaacgagtctccg

SEQ ID NO: 4737 - DNA, 23 bp, synthetic construct
  misc_feature 1..23: note = Description of Artificial Sequence: Syntheticoligonucleotide
  source 1..23: mol_type = other DNA
tgcgactcgttaacgagtcgcag

SEQ ID NO: 4738 - DNA, 23 bp, synthetic construct
  misc_feature 1..23: note = Description of Artificial Sequence: Syntheticoligonucleotide
  source 1..23: mol_type = other DNA
ggtgactcgttaacgagtcaccg

SEQ ID NO: 4739 - DNA, 23 bp, synthetic construct
  misc_feature 1..23: note = Description of Artificial Sequence: Syntheticoligonucleotide
  source 1..23: mol_type = other DNA
acggactcgttaacgagtccgtg

SEQ ID NO: 4740 - DNA, 23 bp, synthetic construct
  misc_feature 1..23: note = Description of Artificial Sequence: Syntheticoligonucleotide
  source 1..23: mol_type = other DNA
ccagactcgttaacgagtctggg

SEQ ID NO: 4741 - DNA, 23 bp, synthetic construct
  misc_feature 1..23: note = Description of Artificial Sequence: Syntheticoligonucleotide
  source 1..23: mol_type = other DNA
tcggactcgttaacgagtccgag

SEQ ID NO: 4742 - DNA, 23 bp, synthetic construct
  misc_feature 1..23: note = Description of Artificial Sequence: Syntheticoligonucleotide
  source 1..23: mol_type = other DNA
cctgactcgttaacgagtcaggg

SEQ ID NO: 4743 - DNA, 23 bp, synthetic construct
  misc_feature 1..23: note = Description of Artificial Sequence: Syntheticoligonucleotide
  source 1..23: mol_type = other DNA
cacgactcgttaacgagtcgtgg

SEQ ID NO: 4744 - DNA, 23 bp, synthetic construct
  misc_feature 1..23: note = Description of Artificial Sequence: Syntheticoligonucleotide
  source 1..23: mol_type = other DNA
gccgactcgttaacgagtcggct

SEQ ID NO: 4745 - DNA, 23 bp, synthetic construct
  misc_feature 1..23: note = Description of Artificial Sequence: Syntheticoligonucleotide
  source 1..23: mol_type = other DNA
gccgactcgttaacgagtcggca

SEQ ID NO: 4746 - DNA, 23 bp, synthetic construct
  misc_feature 1..23: note = Description of Artificial Sequence: Syntheticoligonucleotide
  source 1..23: mol_type = other DNA
cgagactcgttaacgagtctcgc

SEQ ID NO: 4747 - DNA, 23 bp, synthetic construct
  misc_feature 1..23: note = Description of Artificial Sequence: Syntheticoligonucleotide
  source 1..23: mol_type = other DNA
cgtgactcgttaacgagtcacgc

SEQ ID NO: 4748 - DNA, 23 bp, synthetic construct
  misc_feature 1..23: note = Description of Artificial Sequence: Syntheticoligonucleotide
  source 1..23: mol_type = other DNA
caggactcgttaacgagtcctgc

SEQ ID NO: 4749 - DNA, 23 bp, synthetic construct
  misc_feature 1..23: note = Description of Artificial Sequence: Syntheticoligonucleotide
  source 1..23: mol_type = other DNA
ctggactcgttaacgagtccagc

SEQ ID NO: 4750 - DNA, 23 bp, synthetic construct
  misc_feature 1..23: note = Description of Artificial Sequence: Syntheticoligonucleotide
  source 1..23: mol_type = other DNA
gaggactcgttaacgagtcctcg

SEQ ID NO: 4751 - DNA, 23 bp, synthetic construct
  misc_feature 1..23: note = Description of Artificial Sequence: Syntheticoligonucleotide
  source 1..23: mol_type = other DNA
gtggactcgttaacgagtccacg

SEQ ID NO: 4752 - DNA, 23 bp, synthetic construct
  misc_feature 1..23: note = Description of Artificial Sequence: Syntheticoligonucleotide
  source 1..23: mol_type = other DNA
accgactcgttaacgagtcggtg

SEQ ID NO: 4753 - DNA, 23 bp, synthetic construct
  misc_feature 1..23: note = Description of Artificial Sequence: Syntheticoligonucleotide
  source 1..23: mol_type = other DNA
tccgactcgttaacgagtcggag

SEQ ID NO: 4754 - DNA, 23 bp, synthetic construct
  misc_feature 1..23: note = Description of Artificial Sequence: Syntheticoligonucleotide
  source 1..23: mol_type = other DNA
cgggactcgttaacgagtcccgc

SEQ ID NO: 4755 - DNA, 23 bp, synthetic construct
  misc_feature 1..23: note = Description of Artificial Sequence: Syntheticoligonucleotide
  source 1..23: mol_type = other DNA
agggactcgttaacgagtccctc

SEQ ID NO: 4756 - DNA, 23 bp, synthetic construct
  misc_feature 1..23: note = Description of Artificial Sequence: Syntheticoligonucleotide
  source 1..23: mol_type = other DNA
tgggactcgttaacgagtcccac

SEQ ID NO: 4757 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcgtgcacgagtcnnnn

SEQ ID NO: 4758 - DNA, 23 bp, synthetic construct
  misc_feature 1..23: note = Description of Artificial Sequence: Syntheticoligonucleotide
  source 1..23: mol_type = other DNA
gcggactcgtgcacgagtccgcc

SEQ ID NO: 4759 - DNA, 23 bp, synthetic construct
  misc_feature 1..23: note = Description of Artificial Sequence: Syntheticoligonucleotide
  source 1..23: mol_type = other DNA
gcggactcgtgcacgagtccgct

SEQ ID NO: 4760 - DNA, 23 bp, synthetic construct
  misc_feature 1..23: note = Description of Artificial Sequence: Syntheticoligonucleotide
  source 1..23: mol_type = other DNA
acggactcgtgcacgagtccgtc

SEQ ID NO: 4761 - DNA, 23 bp, synthetic construct
  misc_feature 1..23: note = Description of Artificial Sequence: Syntheticoligonucleotide
  source 1..23: mol_type = other DNA
gaggactcgtgcacgagtcctcc

SEQ ID NO: 4762 - DNA, 23 bp, synthetic construct
  misc_feature 1..23: note = Description of Artificial Sequence: Syntheticoligonucleotide
  source 1..23: mol_type = other DNA
gcagactcgtgcacgagtctgcc

SEQ ID NO: 4763 - DNA, 23 bp, synthetic construct
  misc_feature 1..23: note = Description of Artificial Sequence: Syntheticoligonucleotide
  source 1..23: mol_type = other DNA
gcggactcgtgcacgagtccgca

SEQ ID NO: 4764 - DNA, 23 bp, synthetic construct
  misc_feature 1..23: note = Description of Artificial Sequence: Syntheticoligonucleotide
  source 1..23: mol_type = other DNA
tcggactcgtgcacgagtccgac

SEQ ID NO: 4765 - DNA, 23 bp, synthetic construct
  misc_feature 1..23: note = Description of Artificial Sequence: Syntheticoligonucleotide
  source 1..23: mol_type = other DNA
gtggactcgtgcacgagtccacc

SEQ ID NO: 4766 - DNA, 23 bp, synthetic construct
  misc_feature 1..23: note = Description of Artificial Sequence: Syntheticoligonucleotide
  source 1..23: mol_type = other DNA
gctgactcgtgcacgagtcagcc

SEQ ID NO: 4767 - DNA, 23 bp, synthetic construct
  misc_feature 1..23: note = Description of Artificial Sequence: Syntheticoligonucleotide
  source 1..23: mol_type = other DNA
cccgactcgtgcacgagtcgggc

SEQ ID NO: 4768 - DNA, 23 bp, synthetic construct
  misc_feature 1..23: note = Description of Artificial Sequence: Syntheticoligonucleotide
  source 1..23: mol_type = other DNA
cccgactcgtgcacgagtcgggt

SEQ ID NO: 4769 - DNA, 23 bp, synthetic construct
  misc_feature 1..23: note = Description of Artificial Sequence: Syntheticoligonucleotide
  source 1..23: mol_type = other DNA
accgactcgtgcacgagtcggtc

SEQ ID NO: 4770 - DNA, 23 bp, synthetic construct
  misc_feature 1..23: note = Description of Artificial Sequence: Syntheticoligonucleotide
  source 1..23: mol_type = other DNA
cacgactcgtgcacgagtcgtgc

SEQ ID NO: 4771 - DNA, 23 bp, synthetic construct
  misc_feature 1..23: note = Description of Artificial Sequence: Syntheticoligonucleotide
  source 1..23: mol_type = other DNA
ccagactcgtgcacgagtctggc

SEQ ID NO: 4772 - DNA, 23 bp, synthetic construct
  misc_feature 1..23: note = Description of Artificial Sequence: Syntheticoligonucleotide
  source 1..23: mol_type = other DNA
cccgactcgtgcacgagtcggga

SEQ ID NO: 4773 - DNA, 23 bp, synthetic construct
  misc_feature 1..23: note = Description of Artificial Sequence: Syntheticoligonucleotide
  source 1..23: mol_type = other DNA
tccgactcgtgcacgagtcggac

SEQ ID NO: 4774 - DNA, 23 bp, synthetic construct
  misc_feature 1..23: note = Description of Artificial Sequence: Syntheticoligonucleotide
  source 1..23: mol_type = other DNA
cctgactcgtgcacgagtcaggc

SEQ ID NO: 4775 - DNA, 23 bp, synthetic construct
  misc_feature 1..23: note = Description of Artificial Sequence: Syntheticoligonucleotide
  source 1..23: mol_type = other DNA
ggcgactcgtgcacgagtcgccc

SEQ ID NO: 4776 - DNA, 23 bp, synthetic construct
  misc_feature 1..23: note = Description of Artificial Sequence: Syntheticoligonucleotide
  source 1..23: mol_type = other DNA
ggcgactcgtgcacgagtcgcct

SEQ ID NO: 4777 - DNA, 23 bp, synthetic construct
  misc_feature 1..23: note = Description of Artificial Sequence: Syntheticoligonucleotide
  source 1..23: mol_type = other DNA
agcgactcgtgcacgagtcgctc

SEQ ID NO: 4778 - DNA, 23 bp, synthetic construct
  misc_feature 1..23: note = Description of Artificial Sequence: Syntheticoligonucleotide
  source 1..23: mol_type = other DNA
gacgactcgtgcacgagtcgtcc

SEQ ID NO: 4779 - DNA, 23 bp, synthetic construct
  misc_feature 1..23: note = Description of Artificial Sequence: Syntheticoligonucleotide
  source 1..23: mol_type = other DNA
ggagactcgtgcacgagtctccc

SEQ ID NO: 4780 - DNA, 23 bp, synthetic construct
  misc_feature 1..23: note = Description of Artificial Sequence: Syntheticoligonucleotide
  source 1..23: mol_type = other DNA
ggcgactcgtgcacgagtcgcca

SEQ ID NO: 4781 - DNA, 23 bp, synthetic construct
  misc_feature 1..23: note = Description of Artificial Sequence: Syntheticoligonucleotide
  source 1..23: mol_type = other DNA
tgcgactcgtgcacgagtcgcac

SEQ ID NO: 4782 - DNA, 23 bp, synthetic construct
  misc_feature 1..23: note = Description of Artificial Sequence: Syntheticoligonucleotide
  source 1..23: mol_type = other DNA
ggtgactcgtgcacgagtcaccc

SEQ ID NO: 4783 - DNA, 23 bp, synthetic construct
  misc_feature 1..23: note = Description of Artificial Sequence: Syntheticoligonucleotide
  source 1..23: mol_type = other DNA
cgggactcgtgcacgagtcccgt

SEQ ID NO: 4784 - DNA, 23 bp, synthetic construct
  misc_feature 1..23: note = Description of Artificial Sequence: Syntheticoligonucleotide
  source 1..23: mol_type = other DNA
agggactcgtgcacgagtccctg

SEQ ID NO: 4785 - DNA, 23 bp, synthetic construct
  misc_feature 1..23: note = Description of Artificial Sequence: Syntheticoligonucleotide
  source 1..23: mol_type = other DNA
caggactcgtgcacgagtcctgg

SEQ ID NO: 4786 - DNA, 23 bp, synthetic construct
  misc_feature 1..23: note = Description of Artificial Sequence: Syntheticoligonucleotide
  source 1..23: mol_type = other DNA
cgagactcgtgcacgagtctcgg

SEQ ID NO: 4787 - DNA, 23 bp, synthetic construct
  misc_feature 1..23: note = Description of Artificial Sequence: Syntheticoligonucleotide
  source 1..23: mol_type = other DNA
cgggactcgtgcacgagtcccga

SEQ ID NO: 4788 - DNA, 23 bp, synthetic construct
  misc_feature 1..23: note = Description of Artificial Sequence: Syntheticoligonucleotide
  source 1..23: mol_type = other DNA
tgggactcgtgcacgagtcccag

SEQ ID NO: 4789 - DNA, 23 bp, synthetic construct
  misc_feature 1..23: note = Description of Artificial Sequence: Syntheticoligonucleotide
  source 1..23: mol_type = other DNA
ctggactcgtgcacgagtccagg

SEQ ID NO: 4790 - DNA, 23 bp, synthetic construct
  misc_feature 1..23: note = Description of Artificial Sequence: Syntheticoligonucleotide
  source 1..23: mol_type = other DNA
cgtgactcgtgcacgagtcacgg

SEQ ID NO: 4791 - DNA, 23 bp, synthetic construct
  misc_feature 1..23: note = Description of Artificial Sequence: Syntheticoligonucleotide
  source 1..23: mol_type = other DNA
ggcgactcgtgcacgagtcgccg

SEQ ID NO: 4792 - DNA, 23 bp, synthetic construct
  misc_feature 1..23: note = Description of Artificial Sequence: Syntheticoligonucleotide
  source 1..23: mol_type = other DNA
agcgactcgtgcacgagtcgctg

SEQ ID NO: 4793 - DNA, 23 bp, synthetic construct
  misc_feature 1..23: note = Description of Artificial Sequence: Syntheticoligonucleotide
  source 1..23: mol_type = other DNA
gacgactcgtgcacgagtcgtcg

SEQ ID NO: 4794 - DNA, 23 bp, synthetic construct
  misc_feature 1..23: note = Description of Artificial Sequence: Syntheticoligonucleotide
  source 1..23: mol_type = other DNA
ggagactcgtgcacgagtctccg

SEQ ID NO: 4795 - DNA, 23 bp, synthetic construct
  misc_feature 1..23: note = Description of Artificial Sequence: Syntheticoligonucleotide
  source 1..23: mol_type = other DNA
tgcgactcgtgcacgagtcgcag

SEQ ID NO: 4796 - DNA, 23 bp, synthetic construct
  misc_feature 1..23: note = Description of Artificial Sequence: Syntheticoligonucleotide
  source 1..23: mol_type = other DNA
ggtgactcgtgcacgagtcaccg

SEQ ID NO: 4797 - DNA, 23 bp, synthetic construct
  misc_feature 1..23: note = Description of Artificial Sequence: Syntheticoligonucleotide
  source 1..23: mol_type = other DNA
acggactcgtgcacgagtccgtg

SEQ ID NO: 4798 - DNA, 23 bp, synthetic construct
  misc_feature 1..23: note = Description of Artificial Sequence: Syntheticoligonucleotide
  source 1..23: mol_type = other DNA
ccagactcgtgcacgagtctggg

SEQ ID NO: 4799 - DNA, 23 bp, synthetic construct
  misc_feature 1..23: note = Description of Artificial Sequence: Syntheticoligonucleotide
  source 1..23: mol_type = other DNA
tcggactcgtgcacgagtccgag

SEQ ID NO: 4800 - DNA, 23 bp, synthetic construct
  misc_feature 1..23: note = Description of Artificial Sequence: Syntheticoligonucleotide
  source 1..23: mol_type = other DNA
cctgactcgtgcacgagtcaggg

SEQ ID NO: 4801 - DNA, 23 bp, synthetic construct
  misc_feature 1..23: note = Description of Artificial Sequence: Syntheticoligonucleotide
  source 1..23: mol_type = other DNA
cacgactcgtgcacgagtcgtgg

SEQ ID NO: 4802 - DNA, 23 bp, synthetic construct
  misc_feature 1..23: note = Description of Artificial Sequence: Syntheticoligonucleotide
  source 1..23: mol_type = other DNA
gccgactcgtgcacgagtcggct

SEQ ID NO: 4803 - DNA, 23 bp, synthetic construct
  misc_feature 1..23: note = Description of Artificial Sequence: Syntheticoligonucleotide
  source 1..23: mol_type = other DNA
gccgactcgtgcacgagtcggca

SEQ ID NO: 4804 - DNA, 23 bp, synthetic construct
  misc_feature 1..23: note = Description of Artificial Sequence: Syntheticoligonucleotide
  source 1..23: mol_type = other DNA
cgagactcgtgcacgagtctcgc

SEQ ID NO: 4805 - DNA, 23 bp, synthetic construct
  misc_feature 1..23: note = Description of Artificial Sequence: Syntheticoligonucleotide
  source 1..23: mol_type = other DNA
cgtgactcgtgcacgagtcacgc

SEQ ID NO: 4806 - DNA, 23 bp, synthetic construct
  misc_feature 1..23: note = Description of Artificial Sequence: Syntheticoligonucleotide
  source 1..23: mol_type = other DNA
caggactcgtgcacgagtcctgc

SEQ ID NO: 4807 - DNA, 23 bp, synthetic construct
  misc_feature 1..23: note = Description of Artificial Sequence: Syntheticoligonucleotide
  source 1..23: mol_type = other DNA
ctggactcgtgcacgagtccagc

SEQ ID NO: 4808 - DNA, 23 bp, synthetic construct
  misc_feature 1..23: note = Description of Artificial Sequence: Syntheticoligonucleotide
  source 1..23: mol_type = other DNA
gaggactcgtgcacgagtcctcg

SEQ ID NO: 4809 - DNA, 23 bp, synthetic construct
  misc_feature 1..23: note = Description of Artificial Sequence: Syntheticoligonucleotide
  source 1..23: mol_type = other DNA
gtggactcgtgcacgagtccacg

SEQ ID NO: 4810 - DNA, 23 bp, synthetic construct
  misc_feature 1..23: note = Description of Artificial Sequence: Syntheticoligonucleotide
  source 1..23: mol_type = other DNA
accgactcgtgcacgagtcggtg

SEQ ID NO: 4811 - DNA, 23 bp, synthetic construct
  misc_feature 1..23: note = Description of Artificial Sequence: Syntheticoligonucleotide
  source 1..23: mol_type = other DNA
tccgactcgtgcacgagtcggag

SEQ ID NO: 4812 - DNA, 23 bp, synthetic construct
  misc_feature 1..23: note = Description of Artificial Sequence: Syntheticoligonucleotide
  source 1..23: mol_type = other DNA
cgggactcgtgcacgagtcccgc

SEQ ID NO: 4813 - DNA, 23 bp, synthetic construct
  misc_feature 1..23: note = Description of Artificial Sequence: Syntheticoligonucleotide
  source 1..23: mol_type = other DNA
agggactcgtgcacgagtccctc

SEQ ID NO: 4814 - DNA, 23 bp, synthetic construct
  misc_feature 1..23: note = Description of Artificial Sequence: Syntheticoligonucleotide
  source 1..23: mol_type = other DNA
tgggactcgtgcacgagtcccac

SEQ ID NO: 4815 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcgtcgacgagtcnnnn

SEQ ID NO: 4816 - DNA, 23 bp, synthetic construct
  misc_feature 1..23: note = Description of Artificial Sequence: Syntheticoligonucleotide
  source 1..23: mol_type = other DNA
gcggactcgtcgacgagtccgcc

SEQ ID NO: 4817 - DNA, 23 bp, synthetic construct
  misc_feature 1..23: note = Description of Artificial Sequence: Syntheticoligonucleotide
  source 1..23: mol_type = other DNA
gcggactcgtcgacgagtccgct

SEQ ID NO: 4818 - DNA, 23 bp, synthetic construct
  misc_feature 1..23: note = Description of Artificial Sequence: Syntheticoligonucleotide
  source 1..23: mol_type = other DNA
acggactcgtcgacgagtccgtc

SEQ ID NO: 4819 - DNA, 23 bp, synthetic construct
  misc_feature 1..23: note = Description of Artificial Sequence: Syntheticoligonucleotide
  source 1..23: mol_type = other DNA
gaggactcgtcgacgagtcctcc

SEQ ID NO: 4820 - DNA, 23 bp, synthetic construct
  misc_feature 1..23: note = Description of Artificial Sequence: Syntheticoligonucleotide
  source 1..23: mol_type = other DNA
gcagactcgtcgacgagtctgcc

SEQ ID NO: 4821 - DNA, 23 bp, synthetic construct
  misc_feature 1..23: note = Description of Artificial Sequence: Syntheticoligonucleotide
  source 1..23: mol_type = other DNA
gcggactcgtcgacgagtccgca

SEQ ID NO: 4822 - DNA, 23 bp, synthetic construct
  misc_feature 1..23: note = Description of Artificial Sequence: Syntheticoligonucleotide
  source 1..23: mol_type = other DNA
tcggactcgtcgacgagtccgac

SEQ ID NO: 4823 - DNA, 23 bp, synthetic construct
  misc_feature 1..23: note = Description of Artificial Sequence: Syntheticoligonucleotide
  source 1..23: mol_type = other DNA
gtggactcgtcgacgagtccacc

SEQ ID NO: 4824 - DNA, 23 bp, synthetic construct
  misc_feature 1..23: note = Description of Artificial Sequence: Syntheticoligonucleotide
  source 1..23: mol_type = other DNA
gctgactcgtcgacgagtcagcc

SEQ ID NO: 4825 - DNA, 23 bp, synthetic construct
  misc_feature 1..23: note = Description of Artificial Sequence: Syntheticoligonucleotide
  source 1..23: mol_type = other DNA
cccgactcgtcgacgagtcgggc

SEQ ID NO: 4826 - DNA, 23 bp, synthetic construct
  misc_feature 1..23: note = Description of Artificial Sequence: Syntheticoligonucleotide
  source 1..23: mol_type = other DNA
cccgactcgtcgacgagtcgggt

SEQ ID NO: 4827 - DNA, 23 bp, synthetic construct
  misc_feature 1..23: note = Description of Artificial Sequence: Syntheticoligonucleotide
  source 1..23: mol_type = other DNA
accgactcgtcgacgagtcggtc

SEQ ID NO: 4828 - DNA, 23 bp, synthetic construct
  misc_feature 1..23: note = Description of Artificial Sequence: Syntheticoligonucleotide
  source 1..23: mol_type = other DNA
cacgactcgtcgacgagtcgtgc

SEQ ID NO: 4829 - DNA, 23 bp, synthetic construct
  misc_feature 1..23: note = Description of Artificial Sequence: Syntheticoligonucleotide
  source 1..23: mol_type = other DNA
ccagactcgtcgacgagtctggc

SEQ ID NO: 4830 - DNA, 23 bp, synthetic construct
  misc_feature 1..23: note = Description of Artificial Sequence: Syntheticoligonucleotide
  source 1..23: mol_type = other DNA
cccgactcgtcgacgagtcggga

SEQ ID NO: 4831 - DNA, 23 bp, synthetic construct
  misc_feature 1..23: note = Description of Artificial Sequence: Syntheticoligonucleotide
  source 1..23: mol_type = other DNA
tccgactcgtcgacgagtcggac

SEQ ID NO: 4832 - DNA, 23 bp, synthetic construct
  misc_feature 1..23: note = Description of Artificial Sequence: Syntheticoligonucleotide
  source 1..23: mol_type = other DNA
cctgactcgtcgacgagtcaggc

SEQ ID NO: 4833 - DNA, 23 bp, synthetic construct
  misc_feature 1..23: note = Description of Artificial Sequence: Syntheticoligonucleotide
  source 1..23: mol_type = other DNA
ggcgactcgtcgacgagtcgccc

SEQ ID NO: 4834 - DNA, 23 bp, synthetic construct
  misc_feature 1..23: note = Description of Artificial Sequence: Syntheticoligonucleotide
  source 1..23: mol_type = other DNA
ggcgactcgtcgacgagtcgcct

SEQ ID NO: 4835 - DNA, 23 bp, synthetic construct
  misc_feature 1..23: note = Description of Artificial Sequence: Syntheticoligonucleotide
  source 1..23: mol_type = other DNA
agcgactcgtcgacgagtcgctc

SEQ ID NO: 4836 - DNA, 23 bp, synthetic construct
  misc_feature 1..23: note = Description of Artificial Sequence: Syntheticoligonucleotide
  source 1..23: mol_type = other DNA
gacgactcgtcgacgagtcgtcc

SEQ ID NO: 4837 - DNA, 23 bp, synthetic construct
  misc_feature 1..23: note = Description of Artificial Sequence: Syntheticoligonucleotide
  source 1..23: mol_type = other DNA
ggagactcgtcgacgagtctccc

SEQ ID NO: 4838 - DNA, 23 bp, synthetic construct
  misc_feature 1..23: note = Description of Artificial Sequence: Syntheticoligonucleotide
  source 1..23: mol_type = other DNA
ggcgactcgtcgacgagtcgcca

SEQ ID NO: 4839 - DNA, 23 bp, synthetic construct
  misc_feature 1..23: note = Description of Artificial Sequence: Syntheticoligonucleotide
  source 1..23: mol_type = other DNA
tgcgactcgtcgacgagtcgcac

SEQ ID NO: 4840 - DNA, 23 bp, synthetic construct
  misc_feature 1..23: note = Description of Artificial Sequence: Syntheticoligonucleotide
  source 1..23: mol_type = other DNA
ggtgactcgtcgacgagtcaccc

SEQ ID NO: 4841 - DNA, 23 bp, synthetic construct
  misc_feature 1..23: note = Description of Artificial Sequence: Syntheticoligonucleotide
  source 1..23: mol_type = other DNA
cgggactcgtcgacgagtcccgt

SEQ ID NO: 4842 - DNA, 23 bp, synthetic construct
  misc_feature 1..23: note = Description of Artificial Sequence: Syntheticoligonucleotide
  source 1..23: mol_type = other DNA
agggactcgtcgacgagtccctg

SEQ ID NO: 4843 - DNA, 23 bp, synthetic construct
  misc_feature 1..23: note = Description of Artificial Sequence: Syntheticoligonucleotide
  source 1..23: mol_type = other DNA
caggactcgtcgacgagtcctgg

SEQ ID NO: 4844 - DNA, 23 bp, synthetic construct
  misc_feature 1..23: note = Description of Artificial Sequence: Syntheticoligonucleotide
  source 1..23: mol_type = other DNA
cgagactcgtcgacgagtctcgg

SEQ ID NO: 4845 - DNA, 23 bp, synthetic construct
  misc_feature 1..23: note = Description of Artificial Sequence: Syntheticoligonucleotide
  source 1..23: mol_type = other DNA
cgggactcgtcgacgagtcccga

SEQ ID NO: 4846 - DNA, 23 bp, synthetic construct
  misc_feature 1..23: note = Description of Artificial Sequence: Syntheticoligonucleotide
  source 1..23: mol_type = other DNA
tgggactcgtcgacgagtcccag

SEQ ID NO: 4847 - DNA, 23 bp, synthetic construct
  misc_feature 1..23: note = Description of Artificial Sequence: Syntheticoligonucleotide
  source 1..23: mol_type = other DNA
ctggactcgtcgacgagtccagg

SEQ ID NO: 4848 - DNA, 23 bp, synthetic construct
  misc_feature 1..23: note = Description of Artificial Sequence: Syntheticoligonucleotide
  source 1..23: mol_type = other DNA
cgtgactcgtcgacgagtcacgg

SEQ ID NO: 4849 - DNA, 23 bp, synthetic construct
  misc_feature 1..23: note = Description of Artificial Sequence: Syntheticoligonucleotide
  source 1..23: mol_type = other DNA
ggcgactcgtcgacgagtcgccg

SEQ ID NO: 4850 - DNA, 23 bp, synthetic construct
  misc_feature 1..23: note = Description of Artificial Sequence: Syntheticoligonucleotide
  source 1..23: mol_type = other DNA
agcgactcgtcgacgagtcgctg

SEQ ID NO: 4851 - DNA, 23 bp, synthetic construct
  misc_feature 1..23: note = Description of Artificial Sequence: Syntheticoligonucleotide
  source 1..23: mol_type = other DNA
gacgactcgtcgacgagtcgtcg

SEQ ID NO: 4852 - DNA, 23 bp, synthetic construct
  misc_feature 1..23: note = Description of Artificial Sequence: Syntheticoligonucleotide
  source 1..23: mol_type = other DNA
ggagactcgtcgacgagtctccg

SEQ ID NO: 4853 - DNA, 23 bp, synthetic construct
  misc_feature 1..23: note = Description of Artificial Sequence: Syntheticoligonucleotide
  source 1..23: mol_type = other DNA
tgcgactcgtcgacgagtcgcag

SEQ ID NO: 4854 - DNA, 23 bp, synthetic construct
  misc_feature 1..23: note = Description of Artificial Sequence: Syntheticoligonucleotide
  source 1..23: mol_type = other DNA
ggtgactcgtcgacgagtcaccg

SEQ ID NO: 4855 - DNA, 23 bp, synthetic construct
  misc_feature 1..23: note = Description of Artificial Sequence: Syntheticoligonucleotide
  source 1..23: mol_type = other DNA
acggactcgtcgacgagtccgtg

SEQ ID NO: 4856 - DNA, 23 bp, synthetic construct
  misc_feature 1..23: note = Description of Artificial Sequence: Syntheticoligonucleotide
  source 1..23: mol_type = other DNA
ccagactcgtcgacgagtctggg

SEQ ID NO: 4857 - DNA, 23 bp, synthetic construct
  misc_feature 1..23: note = Description of Artificial Sequence: Syntheticoligonucleotide
  source 1..23: mol_type = other DNA
tcggactcgtcgacgagtccgag

SEQ ID NO: 4858 - DNA, 23 bp, synthetic construct
  misc_feature 1..23: note = Description of Artificial Sequence: Syntheticoligonucleotide
  source 1..23: mol_type = other DNA
cctgactcgtcgacgagtcaggg

SEQ ID NO: 4859 - DNA, 23 bp, synthetic construct
  misc_feature 1..23: note = Description of Artificial Sequence: Syntheticoligonucleotide
  source 1..23: mol_type = other DNA
cacgactcgtcgacgagtcgtgg

SEQ ID NO: 4860 - DNA, 23 bp, synthetic construct
  misc_feature 1..23: note = Description of Artificial Sequence: Syntheticoligonucleotide
  source 1..23: mol_type = other DNA
gccgactcgtcgacgagtcggct

SEQ ID NO: 4861 - DNA, 23 bp, synthetic construct
  misc_feature 1..23: note = Description of Artificial Sequence: Syntheticoligonucleotide
  source 1..23: mol_type = other DNA
gccgactcgtcgacgagtcggca

SEQ ID NO: 4862 - DNA, 23 bp, synthetic construct
  misc_feature 1..23: note = Description of Artificial Sequence: Syntheticoligonucleotide
  source 1..23: mol_type = other DNA
cgagactcgtcgacgagtctcgc

SEQ ID NO: 4863 - DNA, 23 bp, synthetic construct
  misc_feature 1..23: note = Description of Artificial Sequence: Syntheticoligonucleotide
  source 1..23: mol_type = other DNA
cgtgactcgtcgacgagtcacgc

SEQ ID NO: 4864 - DNA, 23 bp, synthetic construct
  misc_feature 1..23: note = Description of Artificial Sequence: Syntheticoligonucleotide
  source 1..23: mol_type = other DNA
caggactcgtcgacgagtcctgc

SEQ ID NO: 4865 - DNA, 23 bp, synthetic construct
  misc_feature 1..23: note = Description of Artificial Sequence: Syntheticoligonucleotide
  source 1..23: mol_type = other DNA
ctggactcgtcgacgagtccagc

SEQ ID NO: 4866 - DNA, 23 bp, synthetic construct
  misc_feature 1..23: note = Description of Artificial Sequence: Syntheticoligonucleotide
  source 1..23: mol_type = other DNA
gaggactcgtcgacgagtcctcg

SEQ ID NO: 4867 - DNA, 23 bp, synthetic construct
  misc_feature 1..23: note = Description of Artificial Sequence: Syntheticoligonucleotide
  source 1..23: mol_type = other DNA
gtggactcgtcgacgagtccacg

SEQ ID NO: 4868 - DNA, 23 bp, synthetic construct
  misc_feature 1..23: note = Description of Artificial Sequence: Syntheticoligonucleotide
  source 1..23: mol_type = other DNA
accgactcgtcgacgagtcggtg

SEQ ID NO: 4869 - DNA, 23 bp, synthetic construct
  misc_feature 1..23: note = Description of Artificial Sequence: Syntheticoligonucleotide
  source 1..23: mol_type = other DNA
tccgactcgtcgacgagtcggag

SEQ ID NO: 4870 - DNA, 23 bp, synthetic construct
  misc_feature 1..23: note = Description of Artificial Sequence: Syntheticoligonucleotide
  source 1..23: mol_type = other DNA
cgggactcgtcgacgagtcccgc

SEQ ID NO: 4871 - DNA, 23 bp, synthetic construct
  misc_feature 1..23: note = Description of Artificial Sequence: Syntheticoligonucleotide
  source 1..23: mol_type = other DNA
agggactcgtcgacgagtccctc

SEQ ID NO: 4872 - DNA, 23 bp, synthetic construct
  misc_feature 1..23: note = Description of Artificial Sequence: Syntheticoligonucleotide
  source 1..23: mol_type = other DNA
tgggactcgtcgacgagtcccac

SEQ ID NO: 4873 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcctataggagtcnnnn

SEQ ID NO: 4874 - DNA, 23 bp, synthetic construct
  misc_feature 1..23: note = Description of Artificial Sequence: Syntheticoligonucleotide
  source 1..23: mol_type = other DNA
gcggactcctataggagtccgcc

SEQ ID NO: 4875 - DNA, 23 bp, synthetic construct
  misc_feature 1..23: note = Description of Artificial Sequence: Syntheticoligonucleotide
  source 1..23: mol_type = other DNA
gcggactcctataggagtccgct

SEQ ID NO: 4876 - DNA, 23 bp, synthetic construct
  misc_feature 1..23: note = Description of Artificial Sequence: Syntheticoligonucleotide
  source 1..23: mol_type = other DNA
acggactcctataggagtccgtc

SEQ ID NO: 4877 - DNA, 23 bp, synthetic construct
  misc_feature 1..23: note = Description of Artificial Sequence: Syntheticoligonucleotide
  source 1..23: mol_type = other DNA
gaggactcctataggagtcctcc

SEQ ID NO: 4878 - DNA, 23 bp, synthetic construct
  misc_feature 1..23: note = Description of Artificial Sequence: Syntheticoligonucleotide
  source 1..23: mol_type = other DNA
gcagactcctataggagtctgcc

SEQ ID NO: 4879 - DNA, 23 bp, synthetic construct
  misc_feature 1..23: note = Description of Artificial Sequence: Syntheticoligonucleotide
  source 1..23: mol_type = other DNA
gcggactcctataggagtccgca

SEQ ID NO: 4880 - DNA, 23 bp, synthetic construct
  misc_feature 1..23: note = Description of Artificial Sequence: Syntheticoligonucleotide
  source 1..23: mol_type = other DNA
tcggactcctataggagtccgac

SEQ ID NO: 4881 - DNA, 23 bp, synthetic construct
  misc_feature 1..23: note = Description of Artificial Sequence: Syntheticoligonucleotide
  source 1..23: mol_type = other DNA
gtggactcctataggagtccacc

SEQ ID NO: 4882 - DNA, 23 bp, synthetic construct
  misc_feature 1..23: note = Description of Artificial Sequence: Syntheticoligonucleotide
  source 1..23: mol_type = other DNA
gctgactcctataggagtcagcc

SEQ ID NO: 4883 - DNA, 23 bp, synthetic construct
  misc_feature 1..23: note = Description of Artificial Sequence: Syntheticoligonucleotide
  source 1..23: mol_type = other DNA
cccgactcctataggagtcgggc

SEQ ID NO: 4884 - DNA, 23 bp, synthetic construct
  misc_feature 1..23: note = Description of Artificial Sequence: Syntheticoligonucleotide
  source 1..23: mol_type = other DNA
cccgactcctataggagtcgggt

SEQ ID NO: 4885 - DNA, 23 bp, synthetic construct
  misc_feature 1..23: note = Description of Artificial Sequence: Syntheticoligonucleotide
  source 1..23: mol_type = other DNA
accgactcctataggagtcggtc

SEQ ID NO: 4886 - DNA, 23 bp, synthetic construct
  misc_feature 1..23: note = Description of Artificial Sequence: Syntheticoligonucleotide
  source 1..23: mol_type = other DNA
cacgactcctataggagtcgtgc

SEQ ID NO: 4887 - DNA, 23 bp, synthetic construct
  misc_feature 1..23: note = Description of Artificial Sequence: Syntheticoligonucleotide
  source 1..23: mol_type = other DNA
ccagactcctataggagtctggc

SEQ ID NO: 4888 - DNA, 23 bp, synthetic construct
  misc_feature 1..23: note = Description of Artificial Sequence: Syntheticoligonucleotide
  source 1..23: mol_type = other DNA
cccgactcctataggagtcggga

SEQ ID NO: 4889 - DNA, 23 bp, synthetic construct
  misc_feature 1..23: note = Description of Artificial Sequence: Syntheticoligonucleotide
  source 1..23: mol_type = other DNA
tccgactcctataggagtcggac

SEQ ID NO: 4890 - DNA, 23 bp, synthetic construct
  misc_feature 1..23: note = Description of Artificial Sequence: Syntheticoligonucleotide
  source 1..23: mol_type = other DNA
cctgactcctataggagtcaggc

SEQ ID NO: 4891 - DNA, 23 bp, synthetic construct
  misc_feature 1..23: note = Description of Artificial Sequence: Syntheticoligonucleotide
  source 1..23: mol_type = other DNA
ggcgactcctataggagtcgccc

SEQ ID NO: 4892 - DNA, 23 bp, synthetic construct
  misc_feature 1..23: note = Description of Artificial Sequence: Syntheticoligonucleotide
  source 1..23: mol_type = other DNA
ggcgactcctataggagtcgcct

SEQ ID NO: 4893 - DNA, 23 bp, synthetic construct
  misc_feature 1..23: note = Description of Artificial Sequence: Syntheticoligonucleotide
  source 1..23: mol_type = other DNA
agcgactcctataggagtcgctc

SEQ ID NO: 4894 - DNA, 23 bp, synthetic construct
  misc_feature 1..23: note = Description of Artificial Sequence: Syntheticoligonucleotide
  source 1..23: mol_type = other DNA
gacgactcctataggagtcgtcc

SEQ ID NO: 4895 - DNA, 23 bp, synthetic construct
  misc_feature 1..23: note = Description of Artificial Sequence: Syntheticoligonucleotide
  source 1..23: mol_type = other DNA
ggagactcctataggagtctccc

SEQ ID NO: 4896 - DNA, 23 bp, synthetic construct
  misc_feature 1..23: note = Description of Artificial Sequence: Syntheticoligonucleotide
  source 1..23: mol_type = other DNA
ggcgactcctataggagtcgcca

SEQ ID NO: 4897 - DNA, 23 bp, synthetic construct
  misc_feature 1..23: note = Description of Artificial Sequence: Syntheticoligonucleotide
  source 1..23: mol_type = other DNA
tgcgactcctataggagtcgcac

SEQ ID NO: 4898 - DNA, 23 bp, synthetic construct
  misc_feature 1..23: note = Description of Artificial Sequence: Syntheticoligonucleotide
  source 1..23: mol_type = other DNA
ggtgactcctataggagtcaccc

SEQ ID NO: 4899 - DNA, 23 bp, synthetic construct
  misc_feature 1..23: note = Description of Artificial Sequence: Syntheticoligonucleotide
  source 1..23: mol_type = other DNA
cgggactcctataggagtcccgt

SEQ ID NO: 4900 - DNA, 23 bp, synthetic construct
  misc_feature 1..23: note = Description of Artificial Sequence: Syntheticoligonucleotide
  source 1..23: mol_type = other DNA
agggactcctataggagtccctg

SEQ ID NO: 4901 - DNA, 23 bp, synthetic construct
  misc_feature 1..23: note = Description of Artificial Sequence: Syntheticoligonucleotide
  source 1..23: mol_type = other DNA
caggactcctataggagtcctgg

SEQ ID NO: 4902 - DNA, 23 bp, synthetic construct
  misc_feature 1..23: note = Description of Artificial Sequence: Syntheticoligonucleotide
  source 1..23: mol_type = other DNA
cgagactcctataggagtctcgg

SEQ ID NO: 4903 - DNA, 23 bp, synthetic construct
  misc_feature 1..23: note = Description of Artificial Sequence: Syntheticoligonucleotide
  source 1..23: mol_type = other DNA
cgggactcctataggagtcccga

SEQ ID NO: 4904 - DNA, 23 bp, synthetic construct
  misc_feature 1..23: note = Description of Artificial Sequence: Syntheticoligonucleotide
  source 1..23: mol_type = other DNA
tgggactcctataggagtcccag

SEQ ID NO: 4905 - DNA, 23 bp, synthetic construct
  misc_feature 1..23: note = Description of Artificial Sequence: Syntheticoligonucleotide
  source 1..23: mol_type = other DNA
ctggactcctataggagtccagg

SEQ ID NO: 4906 - DNA, 23 bp, synthetic construct
  misc_feature 1..23: note = Description of Artificial Sequence: Syntheticoligonucleotide
  source 1..23: mol_type = other DNA
cgtgactcctataggagtcacgg

SEQ ID NO: 4907 - DNA, 23 bp, synthetic construct
  misc_feature 1..23: note = Description of Artificial Sequence: Syntheticoligonucleotide
  source 1..23: mol_type = other DNA
ggcgactcctataggagtcgccg

SEQ ID NO: 4908 - DNA, 23 bp, synthetic construct
  misc_feature 1..23: note = Description of Artificial Sequence: Syntheticoligonucleotide
  source 1..23: mol_type = other DNA
agcgactcctataggagtcgctg

SEQ ID NO: 4909 - DNA, 23 bp, synthetic construct
  misc_feature 1..23: note = Description of Artificial Sequence: Syntheticoligonucleotide
  source 1..23: mol_type = other DNA
gacgactcctataggagtcgtcg

SEQ ID NO: 4910 - DNA, 23 bp, synthetic construct
  misc_feature 1..23: note = Description of Artificial Sequence: Syntheticoligonucleotide
  source 1..23: mol_type = other DNA
ggagactcctataggagtctccg

SEQ ID NO: 4911 - DNA, 23 bp, synthetic construct
  misc_feature 1..23: note = Description of Artificial Sequence: Syntheticoligonucleotide
  source 1..23: mol_type = other DNA
tgcgactcctataggagtcgcag

SEQ ID NO: 4912 - DNA, 23 bp, synthetic construct
  misc_feature 1..23: note = Description of Artificial Sequence: Syntheticoligonucleotide
  source 1..23: mol_type = other DNA
ggtgactcctataggagtcaccg

SEQ ID NO: 4913 - DNA, 23 bp, synthetic construct
  misc_feature 1..23: note = Description of Artificial Sequence: Syntheticoligonucleotide
  source 1..23: mol_type = other DNA
acggactcctataggagtccgtg

SEQ ID NO: 4914 - DNA, 23 bp, synthetic construct
  misc_feature 1..23: note = Description of Artificial Sequence: Syntheticoligonucleotide
  source 1..23: mol_type = other DNA
ccagactcctataggagtctggg

SEQ ID NO: 4915 - DNA, 23 bp, synthetic construct
  misc_feature 1..23: note = Description of Artificial Sequence: Syntheticoligonucleotide
  source 1..23: mol_type = other DNA
tcggactcctataggagtccgag

SEQ ID NO: 4916 - DNA, 23 bp, synthetic construct
  misc_feature 1..23: note = Description of Artificial Sequence: Syntheticoligonucleotide
  source 1..23: mol_type = other DNA
cctgactcctataggagtcaggg

SEQ ID NO: 4917 - DNA, 23 bp, synthetic construct
  misc_feature 1..23: note = Description of Artificial Sequence: Syntheticoligonucleotide
  source 1..23: mol_type = other DNA
cacgactcctataggagtcgtgg

SEQ ID NO: 4918 - DNA, 23 bp, synthetic construct
  misc_feature 1..23: note = Description of Artificial Sequence: Syntheticoligonucleotide
  source 1..23: mol_type = other DNA
gccgactcctataggagtcggct

SEQ ID NO: 4919 - DNA, 23 bp, synthetic construct
  misc_feature 1..23: note = Description of Artificial Sequence: Syntheticoligonucleotide
  source 1..23: mol_type = other DNA
gccgactcctataggagtcggca

SEQ ID NO: 4920 - DNA, 23 bp, synthetic construct
  misc_feature 1..23: note = Description of Artificial Sequence: Syntheticoligonucleotide
  source 1..23: mol_type = other DNA
cgagactcctataggagtctcgc

SEQ ID NO: 4921 - DNA, 23 bp, synthetic construct
  misc_feature 1..23: note = Description of Artificial Sequence: Syntheticoligonucleotide
  source 1..23: mol_type = other DNA
cgtgactcctataggagtcacgc

SEQ ID NO: 4922 - DNA, 23 bp, synthetic construct
  misc_feature 1..23: note = Description of Artificial Sequence: Syntheticoligonucleotide
  source 1..23: mol_type = other DNA
caggactcctataggagtcctgc

SEQ ID NO: 4923 - DNA, 23 bp, synthetic construct
  misc_feature 1..23: note = Description of Artificial Sequence: Syntheticoligonucleotide
  source 1..23: mol_type = other DNA
ctggactcctataggagtccagc

SEQ ID NO: 4924 - DNA, 23 bp, synthetic construct
  misc_feature 1..23: note = Description of Artificial Sequence: Syntheticoligonucleotide
  source 1..23: mol_type = other DNA
gaggactcctataggagtcctcg

SEQ ID NO: 4925 - DNA, 23 bp, synthetic construct
  misc_feature 1..23: note = Description of Artificial Sequence: Syntheticoligonucleotide
  source 1..23: mol_type = other DNA
gtggactcctataggagtccacg

SEQ ID NO: 4926 - DNA, 23 bp, synthetic construct
  misc_feature 1..23: note = Description of Artificial Sequence: Syntheticoligonucleotide
  source 1..23: mol_type = other DNA
accgactcctataggagtcggtg

SEQ ID NO: 4927 - DNA, 23 bp, synthetic construct
  misc_feature 1..23: note = Description of Artificial Sequence: Syntheticoligonucleotide
  source 1..23: mol_type = other DNA
tccgactcctataggagtcggag

SEQ ID NO: 4928 - DNA, 23 bp, synthetic construct
  misc_feature 1..23: note = Description of Artificial Sequence: Syntheticoligonucleotide
  source 1..23: mol_type = other DNA
cgggactcctataggagtcccgc

SEQ ID NO: 4929 - DNA, 23 bp, synthetic construct
  misc_feature 1..23: note = Description of Artificial Sequence: Syntheticoligonucleotide
  source 1..23: mol_type = other DNA
agggactcctataggagtccctc

SEQ ID NO: 4930 - DNA, 23 bp, synthetic construct
  misc_feature 1..23: note = Description of Artificial Sequence: Syntheticoligonucleotide
  source 1..23: mol_type = other DNA
tgggactcctataggagtcccac

SEQ ID NO: 4931 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactccttaaggagtcnnnn

SEQ ID NO: 4932 - DNA, 23 bp, synthetic construct
  misc_feature 1..23: note = Description of Artificial Sequence: Syntheticoligonucleotide
  source 1..23: mol_type = other DNA
gcggactccttaaggagtccgcc

SEQ ID NO: 4933 - DNA, 23 bp, synthetic construct
  misc_feature 1..23: note = Description of Artificial Sequence: Syntheticoligonucleotide
  source 1..23: mol_type = other DNA
gcggactccttaaggagtccgct

SEQ ID NO: 4934 - DNA, 23 bp, synthetic construct
  misc_feature 1..23: note = Description of Artificial Sequence: Syntheticoligonucleotide
  source 1..23: mol_type = other DNA
acggactccttaaggagtccgtc

SEQ ID NO: 4935 - DNA, 23 bp, synthetic construct
  misc_feature 1..23: note = Description of Artificial Sequence: Syntheticoligonucleotide
  source 1..23: mol_type = other DNA
gaggactccttaaggagtcctcc

SEQ ID NO: 4936 - DNA, 23 bp, synthetic construct
  misc_feature 1..23: note = Description of Artificial Sequence: Syntheticoligonucleotide
  source 1..23: mol_type = other DNA
gcagactccttaaggagtctgcc

SEQ ID NO: 4937 - DNA, 23 bp, synthetic construct
  misc_feature 1..23: note = Description of Artificial Sequence: Syntheticoligonucleotide
  source 1..23: mol_type = other DNA
gcggactccttaaggagtccgca

SEQ ID NO: 4938 - DNA, 23 bp, synthetic construct
  misc_feature 1..23: note = Description of Artificial Sequence: Syntheticoligonucleotide
  source 1..23: mol_type = other DNA
tcggactccttaaggagtccgac

SEQ ID NO: 4939 - DNA, 23 bp, synthetic construct
  misc_feature 1..23: note = Description of Artificial Sequence: Syntheticoligonucleotide
  source 1..23: mol_type = other DNA
gtggactccttaaggagtccacc

SEQ ID NO: 4940 - DNA, 23 bp, synthetic construct
  misc_feature 1..23: note = Description of Artificial Sequence: Syntheticoligonucleotide
  source 1..23: mol_type = other DNA
gctgactccttaaggagtcagcc

SEQ ID NO: 4941 - DNA, 23 bp, synthetic construct
  misc_feature 1..23: note = Description of Artificial Sequence: Syntheticoligonucleotide
  source 1..23: mol_type = other DNA
cccgactccttaaggagtcgggc

SEQ ID NO: 4942 - DNA, 23 bp, synthetic construct
  misc_feature 1..23: note = Description of Artificial Sequence: Syntheticoligonucleotide
  source 1..23: mol_type = other DNA
cccgactccttaaggagtcgggt

SEQ ID NO: 4943 - DNA, 23 bp, synthetic construct
  misc_feature 1..23: note = Description of Artificial Sequence: Syntheticoligonucleotide
  source 1..23: mol_type = other DNA
accgactccttaaggagtcggtc

SEQ ID NO: 4944 - DNA, 23 bp, synthetic construct
  misc_feature 1..23: note = Description of Artificial Sequence: Syntheticoligonucleotide
  source 1..23: mol_type = other DNA
cacgactccttaaggagtcgtgc

SEQ ID NO: 4945 - DNA, 23 bp, synthetic construct
  misc_feature 1..23: note = Description of Artificial Sequence: Syntheticoligonucleotide
  source 1..23: mol_type = other DNA
ccagactccttaaggagtctggc

SEQ ID NO: 4946 - DNA, 23 bp, synthetic construct
  misc_feature 1..23: note = Description of Artificial Sequence: Syntheticoligonucleotide
  source 1..23: mol_type = other DNA
cccgactccttaaggagtcggga

SEQ ID NO: 4947 - DNA, 23 bp, synthetic construct
  misc_feature 1..23: note = Description of Artificial Sequence: Syntheticoligonucleotide
  source 1..23: mol_type = other DNA
tccgactccttaaggagtcggac

SEQ ID NO: 4948 - DNA, 23 bp, synthetic construct
  misc_feature 1..23: note = Description of Artificial Sequence: Syntheticoligonucleotide
  source 1..23: mol_type = other DNA
cctgactccttaaggagtcaggc

SEQ ID NO: 4949 - DNA, 23 bp, synthetic construct
  misc_feature 1..23: note = Description of Artificial Sequence: Syntheticoligonucleotide
  source 1..23: mol_type = other DNA
ggcgactccttaaggagtcgccc

SEQ ID NO: 4950 - DNA, 23 bp, synthetic construct
  misc_feature 1..23: note = Description of Artificial Sequence: Syntheticoligonucleotide
  source 1..23: mol_type = other DNA
ggcgactccttaaggagtcgcct

SEQ ID NO: 4951 - DNA, 23 bp, synthetic construct
  misc_feature 1..23: note = Description of Artificial Sequence: Syntheticoligonucleotide
  source 1..23: mol_type = other DNA
agcgactccttaaggagtcgctc

SEQ ID NO: 4952 - DNA, 23 bp, synthetic construct
  misc_feature 1..23: note = Description of Artificial Sequence: Syntheticoligonucleotide
  source 1..23: mol_type = other DNA
gacgactccttaaggagtcgtcc

SEQ ID NO: 4953 - DNA, 23 bp, synthetic construct
  misc_feature 1..23: note = Description of Artificial Sequence: Syntheticoligonucleotide
  source 1..23: mol_type = other DNA
ggagactccttaaggagtctccc

SEQ ID NO: 4954 - DNA, 23 bp, synthetic construct
  misc_feature 1..23: note = Description of Artificial Sequence: Syntheticoligonucleotide
  source 1..23: mol_type = other DNA
ggcgactccttaaggagtcgcca

SEQ ID NO: 4955 - DNA, 23 bp, synthetic construct
  misc_feature 1..23: note = Description of Artificial Sequence: Syntheticoligonucleotide
  source 1..23: mol_type = other DNA
tgcgactccttaaggagtcgcac

SEQ ID NO: 4956 - DNA, 23 bp, synthetic construct
  misc_feature 1..23: note = Description of Artificial Sequence: Syntheticoligonucleotide
  source 1..23: mol_type = other DNA
ggtgactccttaaggagtcaccc

SEQ ID NO: 4957 - DNA, 23 bp, synthetic construct
  misc_feature 1..23: note = Description of Artificial Sequence: Syntheticoligonucleotide
  source 1..23: mol_type = other DNA
cgggactccttaaggagtcccgt

SEQ ID NO: 4958 - DNA, 23 bp, synthetic construct
  misc_feature 1..23: note = Description of Artificial Sequence: Syntheticoligonucleotide
  source 1..23: mol_type = other DNA
agggactccttaaggagtccctg

SEQ ID NO: 4959 - DNA, 23 bp, synthetic construct
  misc_feature 1..23: note = Description of Artificial Sequence: Syntheticoligonucleotide
  source 1..23: mol_type = other DNA
caggactccttaaggagtcctgg

SEQ ID NO: 4960 - DNA, 23 bp, synthetic construct
  misc_feature 1..23: note = Description of Artificial Sequence: Syntheticoligonucleotide
  source 1..23: mol_type = other DNA
cgagactccttaaggagtctcgg

SEQ ID NO: 4961 - DNA, 23 bp, synthetic construct
  misc_feature 1..23: note = Description of Artificial Sequence: Syntheticoligonucleotide
  source 1..23: mol_type = other DNA
cgggactccttaaggagtcccga

SEQ ID NO: 4962 - DNA, 23 bp, synthetic construct
  misc_feature 1..23: note = Description of Artificial Sequence: Syntheticoligonucleotide
  source 1..23: mol_type = other DNA
tgggactccttaaggagtcccag

SEQ ID NO: 4963 - DNA, 23 bp, synthetic construct
  misc_feature 1..23: note = Description of Artificial Sequence: Syntheticoligonucleotide
  source 1..23: mol_type = other DNA
ctggactccttaaggagtccagg

SEQ ID NO: 4964 - DNA, 23 bp, synthetic construct
  misc_feature 1..23: note = Description of Artificial Sequence: Syntheticoligonucleotide
  source 1..23: mol_type = other DNA
cgtgactccttaaggagtcacgg

SEQ ID NO: 4965 - DNA, 23 bp, synthetic construct
  misc_feature 1..23: note = Description of Artificial Sequence: Syntheticoligonucleotide
  source 1..23: mol_type = other DNA
ggcgactccttaaggagtcgccg

SEQ ID NO: 4966 - DNA, 23 bp, synthetic construct
  misc_feature 1..23: note = Description of Artificial Sequence: Syntheticoligonucleotide
  source 1..23: mol_type = other DNA
agcgactccttaaggagtcgctg

SEQ ID NO: 4967 - DNA, 23 bp, synthetic construct
  misc_feature 1..23: note = Description of Artificial Sequence: Syntheticoligonucleotide
  source 1..23: mol_type = other DNA
gacgactccttaaggagtcgtcg

SEQ ID NO: 4968 - DNA, 23 bp, synthetic construct
  misc_feature 1..23: note = Description of Artificial Sequence: Syntheticoligonucleotide
  source 1..23: mol_type = other DNA
ggagactccttaaggagtctccg

SEQ ID NO: 4969 - DNA, 23 bp, synthetic construct
  misc_feature 1..23: note = Description of Artificial Sequence: Syntheticoligonucleotide
  source 1..23: mol_type = other DNA
tgcgactccttaaggagtcgcag

SEQ ID NO: 4970 - DNA, 23 bp, synthetic construct
  misc_feature 1..23: note = Description of Artificial Sequence: Syntheticoligonucleotide
  source 1..23: mol_type = other DNA
ggtgactccttaaggagtcaccg

SEQ ID NO: 4971 - DNA, 23 bp, synthetic construct
  misc_feature 1..23: note = Description of Artificial Sequence: Syntheticoligonucleotide
  source 1..23: mol_type = other DNA
acggactccttaaggagtccgtg

SEQ ID NO: 4972 - DNA, 23 bp, synthetic construct
  misc_feature 1..23: note = Description of Artificial Sequence: Syntheticoligonucleotide
  source 1..23: mol_type = other DNA
ccagactccttaaggagtctggg

SEQ ID NO: 4973 - DNA, 23 bp, synthetic construct
  misc_feature 1..23: note = Description of Artificial Sequence: Syntheticoligonucleotide
  source 1..23: mol_type = other DNA
tcggactccttaaggagtccgag

SEQ ID NO: 4974 - DNA, 23 bp, synthetic construct
  misc_feature 1..23: note = Description of Artificial Sequence: Syntheticoligonucleotide
  source 1..23: mol_type = other DNA
cctgactccttaaggagtcaggg

SEQ ID NO: 4975 - DNA, 23 bp, synthetic construct
  misc_feature 1..23: note = Description of Artificial Sequence: Syntheticoligonucleotide
  source 1..23: mol_type = other DNA
cacgactccttaaggagtcgtgg

SEQ ID NO: 4976 - DNA, 23 bp, synthetic construct
  misc_feature 1..23: note = Description of Artificial Sequence: Syntheticoligonucleotide
  source 1..23: mol_type = other DNA
gccgactccttaaggagtcggct

SEQ ID NO: 4977 - DNA, 23 bp, synthetic construct
  misc_feature 1..23: note = Description of Artificial Sequence: Syntheticoligonucleotide
  source 1..23: mol_type = other DNA
gccgactccttaaggagtcggca

SEQ ID NO: 4978 - DNA, 23 bp, synthetic construct
  misc_feature 1..23: note = Description of Artificial Sequence: Syntheticoligonucleotide
  source 1..23: mol_type = other DNA
cgagactccttaaggagtctcgc

SEQ ID NO: 4979 - DNA, 23 bp, synthetic construct
  misc_feature 1..23: note = Description of Artificial Sequence: Syntheticoligonucleotide
  source 1..23: mol_type = other DNA
cgtgactccttaaggagtcacgc

SEQ ID NO: 4980 - DNA, 23 bp, synthetic construct
  misc_feature 1..23: note = Description of Artificial Sequence: Syntheticoligonucleotide
  source 1..23: mol_type = other DNA
caggactccttaaggagtcctgc

SEQ ID NO: 4981 - DNA, 23 bp, synthetic construct
  misc_feature 1..23: note = Description of Artificial Sequence: Syntheticoligonucleotide
  source 1..23: mol_type = other DNA
ctggactccttaaggagtccagc

SEQ ID NO: 4982 - DNA, 23 bp, synthetic construct
  misc_feature 1..23: note = Description of Artificial Sequence: Syntheticoligonucleotide
  source 1..23: mol_type = other DNA
gaggactccttaaggagtcctcg

SEQ ID NO: 4983 - DNA, 23 bp, synthetic construct
  misc_feature 1..23: note = Description of Artificial Sequence: Syntheticoligonucleotide
  source 1..23: mol_type = other DNA
gtggactccttaaggagtccacg

SEQ ID NO: 4984 - DNA, 23 bp, synthetic construct
  misc_feature 1..23: note = Description of Artificial Sequence: Syntheticoligonucleotide
  source 1..23: mol_type = other DNA
accgactccttaaggagtcggtg

SEQ ID NO: 4985 - DNA, 23 bp, synthetic construct
  misc_feature 1..23: note = Description of Artificial Sequence: Syntheticoligonucleotide
  source 1..23: mol_type = other DNA
tccgactccttaaggagtcggag

SEQ ID NO: 4986 - DNA, 23 bp, synthetic construct
  misc_feature 1..23: note = Description of Artificial Sequence: Syntheticoligonucleotide
  source 1..23: mol_type = other DNA
cgggactccttaaggagtcccgc

SEQ ID NO: 4987 - DNA, 23 bp, synthetic construct
  misc_feature 1..23: note = Description of Artificial Sequence: Syntheticoligonucleotide
  source 1..23: mol_type = other DNA
agggactccttaaggagtccctc

SEQ ID NO: 4988 - DNA, 23 bp, synthetic construct
  misc_feature 1..23: note = Description of Artificial Sequence: Syntheticoligonucleotide
  source 1..23: mol_type = other DNA
tgggactccttaaggagtcccac

SEQ ID NO: 4989 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcctgcaggagtcnnnn

SEQ ID NO: 4990 - DNA, 23 bp, synthetic construct
  misc_feature 1..23: note = Description of Artificial Sequence: Syntheticoligonucleotide
  source 1..23: mol_type = other DNA
gcggactcctgcaggagtccgcc

SEQ ID NO: 4991 - DNA, 23 bp, synthetic construct
  misc_feature 1..23: note = Description of Artificial Sequence: Syntheticoligonucleotide
  source 1..23: mol_type = other DNA
gcggactcctgcaggagtccgct

SEQ ID NO: 4992 - DNA, 23 bp, synthetic construct
  misc_feature 1..23: note = Description of Artificial Sequence: Syntheticoligonucleotide
  source 1..23: mol_type = other DNA
acggactcctgcaggagtccgtc

SEQ ID NO: 4993 - DNA, 23 bp, synthetic construct
  misc_feature 1..23: note = Description of Artificial Sequence: Syntheticoligonucleotide
  source 1..23: mol_type = other DNA
gaggactcctgcaggagtcctcc

SEQ ID NO: 4994 - DNA, 23 bp, synthetic construct
  misc_feature 1..23: note = Description of Artificial Sequence: Syntheticoligonucleotide
  source 1..23: mol_type = other DNA
gcagactcctgcaggagtctgcc

SEQ ID NO: 4995 - DNA, 23 bp, synthetic construct
  misc_feature 1..23: note = Description of Artificial Sequence: Syntheticoligonucleotide
  source 1..23: mol_type = other DNA
gcggactcctgcaggagtccgca

SEQ ID NO: 4996 - DNA, 23 bp, synthetic construct
  misc_feature 1..23: note = Description of Artificial Sequence: Syntheticoligonucleotide
  source 1..23: mol_type = other DNA
tcggactcctgcaggagtccgac

SEQ ID NO: 4997 - DNA, 23 bp, synthetic construct
  misc_feature 1..23: note = Description of Artificial Sequence: Syntheticoligonucleotide
  source 1..23: mol_type = other DNA
gtggactcctgcaggagtccacc

SEQ ID NO: 4998 - DNA, 23 bp, synthetic construct
  misc_feature 1..23: note = Description of Artificial Sequence: Syntheticoligonucleotide
  source 1..23: mol_type = other DNA
gctgactcctgcaggagtcagcc

SEQ ID NO: 4999 - DNA, 23 bp, synthetic construct
  misc_feature 1..23: note = Description of Artificial Sequence: Syntheticoligonucleotide
  source 1..23: mol_type = other DNA
cccgactcctgcaggagtcgggc

SEQ ID NO: 5000 - DNA, 23 bp, synthetic construct
  misc_feature 1..23: note = Description of Artificial Sequence: Syntheticoligonucleotide
  source 1..23: mol_type = other DNA
cccgactcctgcaggagtcgggt

SEQ ID NO: 5001 - DNA, 23 bp, synthetic construct
  misc_feature 1..23: note = Description of Artificial Sequence: Syntheticoligonucleotide
  source 1..23: mol_type = other DNA
accgactcctgcaggagtcggtc

SEQ ID NO: 5002 - DNA, 23 bp, synthetic construct
  misc_feature 1..23: note = Description of Artificial Sequence: Syntheticoligonucleotide
  source 1..23: mol_type = other DNA
cacgactcctgcaggagtcgtgc

SEQ ID NO: 5003 - DNA, 23 bp, synthetic construct
  misc_feature 1..23: note = Description of Artificial Sequence: Syntheticoligonucleotide
  source 1..23: mol_type = other DNA
ccagactcctgcaggagtctggc

SEQ ID NO: 5004 - DNA, 23 bp, synthetic construct
  misc_feature 1..23: note = Description of Artificial Sequence: Syntheticoligonucleotide
  source 1..23: mol_type = other DNA
cccgactcctgcaggagtcggga

SEQ ID NO: 5005 - DNA, 23 bp, synthetic construct
  misc_feature 1..23: note = Description of Artificial Sequence: Syntheticoligonucleotide
  source 1..23: mol_type = other DNA
tccgactcctgcaggagtcggac

SEQ ID NO: 5006 - DNA, 23 bp, synthetic construct
  misc_feature 1..23: note = Description of Artificial Sequence: Syntheticoligonucleotide
  source 1..23: mol_type = other DNA
cctgactcctgcaggagtcaggc

SEQ ID NO: 5007 - DNA, 23 bp, synthetic construct
  misc_feature 1..23: note = Description of Artificial Sequence: Syntheticoligonucleotide
  source 1..23: mol_type = other DNA
ggcgactcctgcaggagtcgccc

SEQ ID NO: 5008 - DNA, 23 bp, synthetic construct
  misc_feature 1..23: note = Description of Artificial Sequence: Syntheticoligonucleotide
  source 1..23: mol_type = other DNA
ggcgactcctgcaggagtcgcct

SEQ ID NO: 5009 - DNA, 23 bp, synthetic construct
  misc_feature 1..23: note = Description of Artificial Sequence: Syntheticoligonucleotide
  source 1..23: mol_type = other DNA
agcgactcctgcaggagtcgctc

SEQ ID NO: 5010 - DNA, 23 bp, synthetic construct
  misc_feature 1..23: note = Description of Artificial Sequence: Syntheticoligonucleotide
  source 1..23: mol_type = other DNA
gacgactcctgcaggagtcgtcc

SEQ ID NO: 5011 - DNA, 23 bp, synthetic construct
  misc_feature 1..23: note = Description of Artificial Sequence: Syntheticoligonucleotide
  source 1..23: mol_type = other DNA
ggagactcctgcaggagtctccc

SEQ ID NO: 5012 - DNA, 23 bp, synthetic construct
  misc_feature 1..23: note = Description of Artificial Sequence: Syntheticoligonucleotide
  source 1..23: mol_type = other DNA
ggcgactcctgcaggagtcgcca

SEQ ID NO: 5013 - DNA, 23 bp, synthetic construct
  misc_feature 1..23: note = Description of Artificial Sequence: Syntheticoligonucleotide
  source 1..23: mol_type = other DNA
tgcgactcctgcaggagtcgcac

SEQ ID NO: 5014 - DNA, 23 bp, synthetic construct
  misc_feature 1..23: note = Description of Artificial Sequence: Syntheticoligonucleotide
  source 1..23: mol_type = other DNA
ggtgactcctgcaggagtcaccc

SEQ ID NO: 5015 - DNA, 23 bp, synthetic construct
  misc_feature 1..23: note = Description of Artificial Sequence: Syntheticoligonucleotide
  source 1..23: mol_type = other DNA
cgggactcctgcaggagtcccgt

SEQ ID NO: 5016 - DNA, 23 bp, synthetic construct
  misc_feature 1..23: note = Description of Artificial Sequence: Syntheticoligonucleotide
  source 1..23: mol_type = other DNA
agggactcctgcaggagtccctg

SEQ ID NO: 5017 - DNA, 23 bp, synthetic construct
  misc_feature 1..23: note = Description of Artificial Sequence: Syntheticoligonucleotide
  source 1..23: mol_type = other DNA
caggactcctgcaggagtcctgg

SEQ ID NO: 5018 - DNA, 23 bp, synthetic construct
  misc_feature 1..23: note = Description of Artificial Sequence: Syntheticoligonucleotide
  source 1..23: mol_type = other DNA
cgagactcctgcaggagtctcgg

SEQ ID NO: 5019 - DNA, 23 bp, synthetic construct
  misc_feature 1..23: note = Description of Artificial Sequence: Syntheticoligonucleotide
  source 1..23: mol_type = other DNA
cgggactcctgcaggagtcccga

SEQ ID NO: 5020 - DNA, 23 bp, synthetic construct
  misc_feature 1..23: note = Description of Artificial Sequence: Syntheticoligonucleotide
  source 1..23: mol_type = other DNA
tgggactcctgcaggagtcccag

SEQ ID NO: 5021 - DNA, 23 bp, synthetic construct
  misc_feature 1..23: note = Description of Artificial Sequence: Syntheticoligonucleotide
  source 1..23: mol_type = other DNA
ctggactcctgcaggagtccagg

SEQ ID NO: 5022 - DNA, 23 bp, synthetic construct
  misc_feature 1..23: note = Description of Artificial Sequence: Syntheticoligonucleotide
  source 1..23: mol_type = other DNA
cgtgactcctgcaggagtcacgg

SEQ ID NO: 5023 - DNA, 23 bp, synthetic construct
  misc_feature 1..23: note = Description of Artificial Sequence: Syntheticoligonucleotide
  source 1..23: mol_type = other DNA
ggcgactcctgcaggagtcgccg

SEQ ID NO: 5024 - DNA, 23 bp, synthetic construct
  misc_feature 1..23: note = Description of Artificial Sequence: Syntheticoligonucleotide
  source 1..23: mol_type = other DNA
agcgactcctgcaggagtcgctg

SEQ ID NO: 5025 - DNA, 23 bp, synthetic construct
  misc_feature 1..23: note = Description of Artificial Sequence: Syntheticoligonucleotide
  source 1..23: mol_type = other DNA
gacgactcctgcaggagtcgtcg

SEQ ID NO: 5026 - DNA, 23 bp, synthetic construct
  misc_feature 1..23: note = Description of Artificial Sequence: Syntheticoligonucleotide
  source 1..23: mol_type = other DNA
ggagactcctgcaggagtctccg

SEQ ID NO: 5027 - DNA, 23 bp, synthetic construct
  misc_feature 1..23: note = Description of Artificial Sequence: Syntheticoligonucleotide
  source 1..23: mol_type = other DNA
tgcgactcctgcaggagtcgcag

SEQ ID NO: 5028 - DNA, 23 bp, synthetic construct
  misc_feature 1..23: note = Description of Artificial Sequence: Syntheticoligonucleotide
  source 1..23: mol_type = other DNA
ggtgactcctgcaggagtcaccg

SEQ ID NO: 5029 - DNA, 23 bp, synthetic construct
  misc_feature 1..23: note = Description of Artificial Sequence: Syntheticoligonucleotide
  source 1..23: mol_type = other DNA
acggactcctgcaggagtccgtg

SEQ ID NO: 5030 - DNA, 23 bp, synthetic construct
  misc_feature 1..23: note = Description of Artificial Sequence: Syntheticoligonucleotide
  source 1..23: mol_type = other DNA
ccagactcctgcaggagtctggg

SEQ ID NO: 5031 - DNA, 23 bp, synthetic construct
  misc_feature 1..23: note = Description of Artificial Sequence: Syntheticoligonucleotide
  source 1..23: mol_type = other DNA
tcggactcctgcaggagtccgag

SEQ ID NO: 5032 - DNA, 23 bp, synthetic construct
  misc_feature 1..23: note = Description of Artificial Sequence: Syntheticoligonucleotide
  source 1..23: mol_type = other DNA
cctgactcctgcaggagtcaggg

SEQ ID NO: 5033 - DNA, 23 bp, synthetic construct
  misc_feature 1..23: note = Description of Artificial Sequence: Syntheticoligonucleotide
  source 1..23: mol_type = other DNA
cacgactcctgcaggagtcgtgg

SEQ ID NO: 5034 - DNA, 23 bp, synthetic construct
  misc_feature 1..23: note = Description of Artificial Sequence: Syntheticoligonucleotide
  source 1..23: mol_type = other DNA
gccgactcctgcaggagtcggct

SEQ ID NO: 5035 - DNA, 23 bp, synthetic construct
  misc_feature 1..23: note = Description of Artificial Sequence: Syntheticoligonucleotide
  source 1..23: mol_type = other DNA
gccgactcctgcaggagtcggca

SEQ ID NO: 5036 - DNA, 23 bp, synthetic construct
  misc_feature 1..23: note = Description of Artificial Sequence: Syntheticoligonucleotide
  source 1..23: mol_type = other DNA
cgagactcctgcaggagtctcgc

SEQ ID NO: 5037 - DNA, 23 bp, synthetic construct
  misc_feature 1..23: note = Description of Artificial Sequence: Syntheticoligonucleotide
  source 1..23: mol_type = other DNA
cgtgactcctgcaggagtcacgc

SEQ ID NO: 5038 - DNA, 23 bp, synthetic construct
  misc_feature 1..23: note = Description of Artificial Sequence: Syntheticoligonucleotide
  source 1..23: mol_type = other DNA
caggactcctgcaggagtcctgc

SEQ ID NO: 5039 - DNA, 23 bp, synthetic construct
  misc_feature 1..23: note = Description of Artificial Sequence: Syntheticoligonucleotide
  source 1..23: mol_type = other DNA
ctggactcctgcaggagtccagc

SEQ ID NO: 5040 - DNA, 23 bp, synthetic construct
  misc_feature 1..23: note = Description of Artificial Sequence: Syntheticoligonucleotide
  source 1..23: mol_type = other DNA
gaggactcctgcaggagtcctcg

SEQ ID NO: 5041 - DNA, 23 bp, synthetic construct
  misc_feature 1..23: note = Description of Artificial Sequence: Syntheticoligonucleotide
  source 1..23: mol_type = other DNA
gtggactcctgcaggagtccacg

SEQ ID NO: 5042 - DNA, 23 bp, synthetic construct
  misc_feature 1..23: note = Description of Artificial Sequence: Syntheticoligonucleotide
  source 1..23: mol_type = other DNA
accgactcctgcaggagtcggtg

SEQ ID NO: 5043 - DNA, 23 bp, synthetic construct
  misc_feature 1..23: note = Description of Artificial Sequence: Syntheticoligonucleotide
  source 1..23: mol_type = other DNA
tccgactcctgcaggagtcggag

SEQ ID NO: 5044 - DNA, 23 bp, synthetic construct
  misc_feature 1..23: note = Description of Artificial Sequence: Syntheticoligonucleotide
  source 1..23: mol_type = other DNA
cgggactcctgcaggagtcccgc

SEQ ID NO: 5045 - DNA, 23 bp, synthetic construct
  misc_feature 1..23: note = Description of Artificial Sequence: Syntheticoligonucleotide
  source 1..23: mol_type = other DNA
agggactcctgcaggagtccctc

SEQ ID NO: 5046 - DNA, 23 bp, synthetic construct
  misc_feature 1..23: note = Description of Artificial Sequence: Syntheticoligonucleotide
  source 1..23: mol_type = other DNA
tgggactcctgcaggagtcccac

SEQ ID NO: 5047 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcctcgaggagtcnnnn

SEQ ID NO: 5048 - DNA, 23 bp, synthetic construct
  misc_feature 1..23: note = Description of Artificial Sequence: Syntheticoligonucleotide
  source 1..23: mol_type = other DNA
gcggactcctcgaggagtccgcc

SEQ ID NO: 5049 - DNA, 23 bp, synthetic construct
  misc_feature 1..23: note = Description of Artificial Sequence: Syntheticoligonucleotide
  source 1..23: mol_type = other DNA
gcggactcctcgaggagtccgct

SEQ ID NO: 5050 - DNA, 23 bp, synthetic construct
  misc_feature 1..23: note = Description of Artificial Sequence: Syntheticoligonucleotide
  source 1..23: mol_type = other DNA
acggactcctcgaggagtccgtc

SEQ ID NO: 5051 - DNA, 23 bp, synthetic construct
  misc_feature 1..23: note = Description of Artificial Sequence: Syntheticoligonucleotide
  source 1..23: mol_type = other DNA
gaggactcctcgaggagtcctcc

SEQ ID NO: 5052 - DNA, 23 bp, synthetic construct
  misc_feature 1..23: note = Description of Artificial Sequence: Syntheticoligonucleotide
  source 1..23: mol_type = other DNA
gcagactcctcgaggagtctgcc

SEQ ID NO: 5053 - DNA, 23 bp, synthetic construct
  misc_feature 1..23: note = Description of Artificial Sequence: Syntheticoligonucleotide
  source 1..23: mol_type = other DNA
gcggactcctcgaggagtccgca

SEQ ID NO: 5054 - DNA, 23 bp, synthetic construct
  misc_feature 1..23: note = Description of Artificial Sequence: Syntheticoligonucleotide
  source 1..23: mol_type = other DNA
tcggactcctcgaggagtccgac

SEQ ID NO: 5055 - DNA, 23 bp, synthetic construct
  misc_feature 1..23: note = Description of Artificial Sequence: Syntheticoligonucleotide
  source 1..23: mol_type = other DNA
gtggactcctcgaggagtccacc

SEQ ID NO: 5056 - DNA, 23 bp, synthetic construct
  misc_feature 1..23: note = Description of Artificial Sequence: Syntheticoligonucleotide
  source 1..23: mol_type = other DNA
gctgactcctcgaggagtcagcc

SEQ ID NO: 5057 - DNA, 23 bp, synthetic construct
  misc_feature 1..23: note = Description of Artificial Sequence: Syntheticoligonucleotide
  source 1..23: mol_type = other DNA
cccgactcctcgaggagtcgggc

SEQ ID NO: 5058 - DNA, 23 bp, synthetic construct
  misc_feature 1..23: note = Description of Artificial Sequence: Syntheticoligonucleotide
  source 1..23: mol_type = other DNA
cccgactcctcgaggagtcgggt

SEQ ID NO: 5059 - DNA, 23 bp, synthetic construct
  misc_feature 1..23: note = Description of Artificial Sequence: Syntheticoligonucleotide
  source 1..23: mol_type = other DNA
accgactcctcgaggagtcggtc

SEQ ID NO: 5060 - DNA, 23 bp, synthetic construct
  misc_feature 1..23: note = Description of Artificial Sequence: Syntheticoligonucleotide
  source 1..23: mol_type = other DNA
cacgactcctcgaggagtcgtgc

SEQ ID NO: 5061 - DNA, 23 bp, synthetic construct
  misc_feature 1..23: note = Description of Artificial Sequence: Syntheticoligonucleotide
  source 1..23: mol_type = other DNA
ccagactcctcgaggagtctggc

SEQ ID NO: 5062 - DNA, 23 bp, synthetic construct
  misc_feature 1..23: note = Description of Artificial Sequence: Syntheticoligonucleotide
  source 1..23: mol_type = other DNA
cccgactcctcgaggagtcggga

SEQ ID NO: 5063 - DNA, 23 bp, synthetic construct
  misc_feature 1..23: note = Description of Artificial Sequence: Syntheticoligonucleotide
  source 1..23: mol_type = other DNA
tccgactcctcgaggagtcggac

SEQ ID NO: 5064 - DNA, 23 bp, synthetic construct
  misc_feature 1..23: note = Description of Artificial Sequence: Syntheticoligonucleotide
  source 1..23: mol_type = other DNA
cctgactcctcgaggagtcaggc

SEQ ID NO: 5065 - DNA, 23 bp, synthetic construct
  misc_feature 1..23: note = Description of Artificial Sequence: Syntheticoligonucleotide
  source 1..23: mol_type = other DNA
ggcgactcctcgaggagtcgccc

SEQ ID NO: 5066 - DNA, 23 bp, synthetic construct
  misc_feature 1..23: note = Description of Artificial Sequence: Syntheticoligonucleotide
  source 1..23: mol_type = other DNA
ggcgactcctcgaggagtcgcct

SEQ ID NO: 5067 - DNA, 23 bp, synthetic construct
  misc_feature 1..23: note = Description of Artificial Sequence: Syntheticoligonucleotide
  source 1..23: mol_type = other DNA
agcgactcctcgaggagtcgctc

SEQ ID NO: 5068 - DNA, 23 bp, synthetic construct
  misc_feature 1..23: note = Description of Artificial Sequence: Syntheticoligonucleotide
  source 1..23: mol_type = other DNA
gacgactcctcgaggagtcgtcc

SEQ ID NO: 5069 - DNA, 23 bp, synthetic construct
  misc_feature 1..23: note = Description of Artificial Sequence: Syntheticoligonucleotide
  source 1..23: mol_type = other DNA
ggagactcctcgaggagtctccc

SEQ ID NO: 5070 - DNA, 23 bp, synthetic construct
  misc_feature 1..23: note = Description of Artificial Sequence: Syntheticoligonucleotide
  source 1..23: mol_type = other DNA
ggcgactcctcgaggagtcgcca

SEQ ID NO: 5071 - DNA, 23 bp, synthetic construct
  misc_feature 1..23: note = Description of Artificial Sequence: Syntheticoligonucleotide
  source 1..23: mol_type = other DNA
tgcgactcctcgaggagtcgcac

SEQ ID NO: 5072 - DNA, 23 bp, synthetic construct
  misc_feature 1..23: note = Description of Artificial Sequence: Syntheticoligonucleotide
  source 1..23: mol_type = other DNA
ggtgactcctcgaggagtcaccc

SEQ ID NO: 5073 - DNA, 23 bp, synthetic construct
  misc_feature 1..23: note = Description of Artificial Sequence: Syntheticoligonucleotide
  source 1..23: mol_type = other DNA
cgggactcctcgaggagtcccgt

SEQ ID NO: 5074 - DNA, 23 bp, synthetic construct
  misc_feature 1..23: note = Description of Artificial Sequence: Syntheticoligonucleotide
  source 1..23: mol_type = other DNA
agggactcctcgaggagtccctg

SEQ ID NO: 5075 - DNA, 23 bp, synthetic construct
  misc_feature 1..23: note = Description of Artificial Sequence: Syntheticoligonucleotide
  source 1..23: mol_type = other DNA
caggactcctcgaggagtcctgg

SEQ ID NO: 5076 - DNA, 23 bp, synthetic construct
  misc_feature 1..23: note = Description of Artificial Sequence: Syntheticoligonucleotide
  source 1..23: mol_type = other DNA
cgagactcctcgaggagtctcgg

SEQ ID NO: 5077 - DNA, 23 bp, synthetic construct
  misc_feature 1..23: note = Description of Artificial Sequence: Syntheticoligonucleotide
  source 1..23: mol_type = other DNA
cgggactcctcgaggagtcccga

SEQ ID NO: 5078 - DNA, 23 bp, synthetic construct
  misc_feature 1..23: note = Description of Artificial Sequence: Syntheticoligonucleotide
  source 1..23: mol_type = other DNA
tgggactcctcgaggagtcccag

SEQ ID NO: 5079 - DNA, 23 bp, synthetic construct
  misc_feature 1..23: note = Description of Artificial Sequence: Syntheticoligonucleotide
  source 1..23: mol_type = other DNA
ctggactcctcgaggagtccagg

SEQ ID NO: 5080 - DNA, 23 bp, synthetic construct
  misc_feature 1..23: note = Description of Artificial Sequence: Syntheticoligonucleotide
  source 1..23: mol_type = other DNA
cgtgactcctcgaggagtcacgg

SEQ ID NO: 5081 - DNA, 23 bp, synthetic construct
  misc_feature 1..23: note = Description of Artificial Sequence: Syntheticoligonucleotide
  source 1..23: mol_type = other DNA
ggcgactcctcgaggagtcgccg

SEQ ID NO: 5082 - DNA, 23 bp, synthetic construct
  misc_feature 1..23: note = Description of Artificial Sequence: Syntheticoligonucleotide
  source 1..23: mol_type = other DNA
agcgactcctcgaggagtcgctg

SEQ ID NO: 5083 - DNA, 23 bp, synthetic construct
  misc_feature 1..23: note = Description of Artificial Sequence: Syntheticoligonucleotide
  source 1..23: mol_type = other DNA
gacgactcctcgaggagtcgtcg

SEQ ID NO: 5084 - DNA, 23 bp, synthetic construct
  misc_feature 1..23: note = Description of Artificial Sequence: Syntheticoligonucleotide
  source 1..23: mol_type = other DNA
ggagactcctcgaggagtctccg

SEQ ID NO: 5085 - DNA, 23 bp, synthetic construct
  misc_feature 1..23: note = Description of Artificial Sequence: Syntheticoligonucleotide
  source 1..23: mol_type = other DNA
tgcgactcctcgaggagtcgcag

SEQ ID NO: 5086 - DNA, 23 bp, synthetic construct
  misc_feature 1..23: note = Description of Artificial Sequence: Syntheticoligonucleotide
  source 1..23: mol_type = other DNA
ggtgactcctcgaggagtcaccg

SEQ ID NO: 5087 - DNA, 23 bp, synthetic construct
  misc_feature 1..23: note = Description of Artificial Sequence: Syntheticoligonucleotide
  source 1..23: mol_type = other DNA
acggactcctcgaggagtccgtg

SEQ ID NO: 5088 - DNA, 23 bp, synthetic construct
  misc_feature 1..23: note = Description of Artificial Sequence: Syntheticoligonucleotide
  source 1..23: mol_type = other DNA
ccagactcctcgaggagtctggg

SEQ ID NO: 5089 - DNA, 23 bp, synthetic construct
  misc_feature 1..23: note = Description of Artificial Sequence: Syntheticoligonucleotide
  source 1..23: mol_type = other DNA
tcggactcctcgaggagtccgag

SEQ ID NO: 5090 - DNA, 23 bp, synthetic construct
  misc_feature 1..23: note = Description of Artificial Sequence: Syntheticoligonucleotide
  source 1..23: mol_type = other DNA
cctgactcctcgaggagtcaggg

SEQ ID NO: 5091 - DNA, 23 bp, synthetic construct
  misc_feature 1..23: note = Description of Artificial Sequence: Syntheticoligonucleotide
  source 1..23: mol_type = other DNA
cacgactcctcgaggagtcgtgg

SEQ ID NO: 5092 - DNA, 23 bp, synthetic construct
  misc_feature 1..23: note = Description of Artificial Sequence: Syntheticoligonucleotide
  source 1..23: mol_type = other DNA
gccgactcctcgaggagtcggct

SEQ ID NO: 5093 - DNA, 23 bp, synthetic construct
  misc_feature 1..23: note = Description of Artificial Sequence: Syntheticoligonucleotide
  source 1..23: mol_type = other DNA
gccgactcctcgaggagtcggca

SEQ ID NO: 5094 - DNA, 23 bp, synthetic construct
  misc_feature 1..23: note = Description of Artificial Sequence: Syntheticoligonucleotide
  source 1..23: mol_type = other DNA
cgagactcctcgaggagtctcgc

SEQ ID NO: 5095 - DNA, 23 bp, synthetic construct
  misc_feature 1..23: note = Description of Artificial Sequence: Syntheticoligonucleotide
  source 1..23: mol_type = other DNA
cgtgactcctcgaggagtcacgc

SEQ ID NO: 5096 - DNA, 23 bp, synthetic construct
  misc_feature 1..23: note = Description of Artificial Sequence: Syntheticoligonucleotide
  source 1..23: mol_type = other DNA
caggactcctcgaggagtcctgc

SEQ ID NO: 5097 - DNA, 23 bp, synthetic construct
  misc_feature 1..23: note = Description of Artificial Sequence: Syntheticoligonucleotide
  source 1..23: mol_type = other DNA
ctggactcctcgaggagtccagc

SEQ ID NO: 5098 - DNA, 23 bp, synthetic construct
  misc_feature 1..23: note = Description of Artificial Sequence: Syntheticoligonucleotide
  source 1..23: mol_type = other DNA
gaggactcctcgaggagtcctcg

SEQ ID NO: 5099 - DNA, 23 bp, synthetic construct
  misc_feature 1..23: note = Description of Artificial Sequence: Syntheticoligonucleotide
  source 1..23: mol_type = other DNA
gtggactcctcgaggagtccacg

SEQ ID NO: 5100 - DNA, 23 bp, synthetic construct
  misc_feature 1..23: note = Description of Artificial Sequence: Syntheticoligonucleotide
  source 1..23: mol_type = other DNA
accgactcctcgaggagtcggtg

SEQ ID NO: 5101 - DNA, 23 bp, synthetic construct
  misc_feature 1..23: note = Description of Artificial Sequence: Syntheticoligonucleotide
  source 1..23: mol_type = other DNA
tccgactcctcgaggagtcggag

SEQ ID NO: 5102 - DNA, 23 bp, synthetic construct
  misc_feature 1..23: note = Description of Artificial Sequence: Syntheticoligonucleotide
  source 1..23: mol_type = other DNA
cgggactcctcgaggagtcccgc

SEQ ID NO: 5103 - DNA, 23 bp, synthetic construct
  misc_feature 1..23: note = Description of Artificial Sequence: Syntheticoligonucleotide
  source 1..23: mol_type = other DNA
agggactcctcgaggagtccctc

SEQ ID NO: 5104 - DNA, 23 bp, synthetic construct
  misc_feature 1..23: note = Description of Artificial Sequence: Syntheticoligonucleotide
  source 1..23: mol_type = other DNA
tgggactcctcgaggagtcccac

SEQ ID NO: 5105 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactccaattggagtcnnnn

SEQ ID NO: 5106 - DNA, 23 bp, synthetic construct
  misc_feature 1..23: note = Description of Artificial Sequence: Syntheticoligonucleotide
  source 1..23: mol_type = other DNA
gcggactccaattggagtccgcc

SEQ ID NO: 5107 - DNA, 23 bp, synthetic construct
  misc_feature 1..23: note = Description of Artificial Sequence: Syntheticoligonucleotide
  source 1..23: mol_type = other DNA
gcggactccaattggagtccgct

SEQ ID NO: 5108 - DNA, 23 bp, synthetic construct
  misc_feature 1..23: note = Description of Artificial Sequence: Syntheticoligonucleotide
  source 1..23: mol_type = other DNA
acggactccaattggagtccgtc

SEQ ID NO: 5109 - DNA, 23 bp, synthetic construct
  misc_feature 1..23: note = Description of Artificial Sequence: Syntheticoligonucleotide
  source 1..23: mol_type = other DNA
gaggactccaattggagtcctcc

SEQ ID NO: 5110 - DNA, 23 bp, synthetic construct
  misc_feature 1..23: note = Description of Artificial Sequence: Syntheticoligonucleotide
  source 1..23: mol_type = other DNA
gcagactccaattggagtctgcc

SEQ ID NO: 5111 - DNA, 23 bp, synthetic construct
  misc_feature 1..23: note = Description of Artificial Sequence: Syntheticoligonucleotide
  source 1..23: mol_type = other DNA
gcggactccaattggagtccgca

SEQ ID NO: 5112 - DNA, 23 bp, synthetic construct
  misc_feature 1..23: note = Description of Artificial Sequence: Syntheticoligonucleotide
  source 1..23: mol_type = other DNA
tcggactccaattggagtccgac

SEQ ID NO: 5113 - DNA, 23 bp, synthetic construct
  misc_feature 1..23: note = Description of Artificial Sequence: Syntheticoligonucleotide
  source 1..23: mol_type = other DNA
gtggactccaattggagtccacc

SEQ ID NO: 5114 - DNA, 23 bp, synthetic construct
  misc_feature 1..23: note = Description of Artificial Sequence: Syntheticoligonucleotide
  source 1..23: mol_type = other DNA
gctgactccaattggagtcagcc

SEQ ID NO: 5115 - DNA, 23 bp, synthetic construct
  misc_feature 1..23: note = Description of Artificial Sequence: Syntheticoligonucleotide
  source 1..23: mol_type = other DNA
cccgactccaattggagtcgggc

SEQ ID NO: 5116 - DNA, 23 bp, synthetic construct
  misc_feature 1..23: note = Description of Artificial Sequence: Syntheticoligonucleotide
  source 1..23: mol_type = other DNA
cccgactccaattggagtcgggt

SEQ ID NO: 5117 - DNA, 23 bp, synthetic construct
  misc_feature 1..23: note = Description of Artificial Sequence: Syntheticoligonucleotide
  source 1..23: mol_type = other DNA
accgactccaattggagtcggtc

SEQ ID NO: 5118 - DNA, 23 bp, synthetic construct
  misc_feature 1..23: note = Description of Artificial Sequence: Syntheticoligonucleotide
  source 1..23: mol_type = other DNA
cacgactccaattggagtcgtgc

SEQ ID NO: 5119 - DNA, 23 bp, synthetic construct
  misc_feature 1..23: note = Description of Artificial Sequence: Syntheticoligonucleotide
  source 1..23: mol_type = other DNA
ccagactccaattggagtctggc

SEQ ID NO: 5120 - DNA, 23 bp, synthetic construct
  misc_feature 1..23: note = Description of Artificial Sequence: Syntheticoligonucleotide
  source 1..23: mol_type = other DNA
cccgactccaattggagtcggga

SEQ ID NO: 5121 - DNA, 23 bp, synthetic construct
  misc_feature 1..23: note = Description of Artificial Sequence: Syntheticoligonucleotide
  source 1..23: mol_type = other DNA
tccgactccaattggagtcggac

SEQ ID NO: 5122 - DNA, 23 bp, synthetic construct
  misc_feature 1..23: note = Description of Artificial Sequence: Syntheticoligonucleotide
  source 1..23: mol_type = other DNA
cctgactccaattggagtcaggc

SEQ ID NO: 5123 - DNA, 23 bp, synthetic construct
  misc_feature 1..23: note = Description of Artificial Sequence: Syntheticoligonucleotide
  source 1..23: mol_type = other DNA
ggcgactccaattggagtcgccc

SEQ ID NO: 5124 - DNA, 23 bp, synthetic construct
  misc_feature 1..23: note = Description of Artificial Sequence: Syntheticoligonucleotide
  source 1..23: mol_type = other DNA
ggcgactccaattggagtcgcct

SEQ ID NO: 5125 - DNA, 23 bp, synthetic construct
  misc_feature 1..23: note = Description of Artificial Sequence: Syntheticoligonucleotide
  source 1..23: mol_type = other DNA
agcgactccaattggagtcgctc

SEQ ID NO: 5126 - DNA, 23 bp, synthetic construct
  misc_feature 1..23: note = Description of Artificial Sequence: Syntheticoligonucleotide
  source 1..23: mol_type = other DNA
gacgactccaattggagtcgtcc

SEQ ID NO: 5127 - DNA, 23 bp, synthetic construct
  misc_feature 1..23: note = Description of Artificial Sequence: Syntheticoligonucleotide
  source 1..23: mol_type = other DNA
ggagactccaattggagtctccc

SEQ ID NO: 5128 - DNA, 23 bp, synthetic construct
  misc_feature 1..23: note = Description of Artificial Sequence: Syntheticoligonucleotide
  source 1..23: mol_type = other DNA
ggcgactccaattggagtcgcca

SEQ ID NO: 5129 - DNA, 23 bp, synthetic construct
  misc_feature 1..23: note = Description of Artificial Sequence: Syntheticoligonucleotide
  source 1..23: mol_type = other DNA
tgcgactccaattggagtcgcac

SEQ ID NO: 5130 - DNA, 23 bp, synthetic construct
  misc_feature 1..23: note = Description of Artificial Sequence: Syntheticoligonucleotide
  source 1..23: mol_type = other DNA
ggtgactccaattggagtcaccc

SEQ ID NO: 5131 - DNA, 23 bp, synthetic construct
  misc_feature 1..23: note = Description of Artificial Sequence: Syntheticoligonucleotide
  source 1..23: mol_type = other DNA
cgggactccaattggagtcccgt

SEQ ID NO: 5132 - DNA, 23 bp, synthetic construct
  misc_feature 1..23: note = Description of Artificial Sequence: Syntheticoligonucleotide
  source 1..23: mol_type = other DNA
agggactccaattggagtccctg

SEQ ID NO: 5133 - DNA, 23 bp, synthetic construct
  misc_feature 1..23: note = Description of Artificial Sequence: Syntheticoligonucleotide
  source 1..23: mol_type = other DNA
caggactccaattggagtcctgg

SEQ ID NO: 5134 - DNA, 23 bp, synthetic construct
  misc_feature 1..23: note = Description of Artificial Sequence: Syntheticoligonucleotide
  source 1..23: mol_type = other DNA
cgagactccaattggagtctcgg

SEQ ID NO: 5135 - DNA, 23 bp, synthetic construct
  misc_feature 1..23: note = Description of Artificial Sequence: Syntheticoligonucleotide
  source 1..23: mol_type = other DNA
cgggactccaattggagtcccga

SEQ ID NO: 5136 - DNA, 23 bp, synthetic construct
  misc_feature 1..23: note = Description of Artificial Sequence: Syntheticoligonucleotide
  source 1..23: mol_type = other DNA
tgggactccaattggagtcccag

SEQ ID NO: 5137 - DNA, 23 bp, synthetic construct
  misc_feature 1..23: note = Description of Artificial Sequence: Syntheticoligonucleotide
  source 1..23: mol_type = other DNA
ctggactccaattggagtccagg

SEQ ID NO: 5138 - DNA, 23 bp, synthetic construct
  misc_feature 1..23: note = Description of Artificial Sequence: Syntheticoligonucleotide
  source 1..23: mol_type = other DNA
cgtgactccaattggagtcacgg

SEQ ID NO: 5139 - DNA, 23 bp, synthetic construct
  misc_feature 1..23: note = Description of Artificial Sequence: Syntheticoligonucleotide
  source 1..23: mol_type = other DNA
ggcgactccaattggagtcgccg

SEQ ID NO: 5140 - DNA, 23 bp, synthetic construct
  misc_feature 1..23: note = Description of Artificial Sequence: Syntheticoligonucleotide
  source 1..23: mol_type = other DNA
agcgactccaattggagtcgctg

SEQ ID NO: 5141 - DNA, 23 bp, synthetic construct
  misc_feature 1..23: note = Description of Artificial Sequence: Syntheticoligonucleotide
  source 1..23: mol_type = other DNA
gacgactccaattggagtcgtcg

SEQ ID NO: 5142 - DNA, 23 bp, synthetic construct
  misc_feature 1..23: note = Description of Artificial Sequence: Syntheticoligonucleotide
  source 1..23: mol_type = other DNA
ggagactccaattggagtctccg

SEQ ID NO: 5143 - DNA, 23 bp, synthetic construct
  misc_feature 1..23: note = Description of Artificial Sequence: Syntheticoligonucleotide
  source 1..23: mol_type = other DNA
tgcgactccaattggagtcgcag

SEQ ID NO: 5144 - DNA, 23 bp, synthetic construct
  misc_feature 1..23: note = Description of Artificial Sequence: Syntheticoligonucleotide
  source 1..23: mol_type = other DNA
ggtgactccaattggagtcaccg

SEQ ID NO: 5145 - DNA, 23 bp, synthetic construct
  misc_feature 1..23: note = Description of Artificial Sequence: Syntheticoligonucleotide
  source 1..23: mol_type = other DNA
acggactccaattggagtccgtg

SEQ ID NO: 5146 - DNA, 23 bp, synthetic construct
  misc_feature 1..23: note = Description of Artificial Sequence: Syntheticoligonucleotide
  source 1..23: mol_type = other DNA
ccagactccaattggagtctggg

SEQ ID NO: 5147 - DNA, 23 bp, synthetic construct
  misc_feature 1..23: note = Description of Artificial Sequence: Syntheticoligonucleotide
  source 1..23: mol_type = other DNA
tcggactccaattggagtccgag

SEQ ID NO: 5148 - DNA, 23 bp, synthetic construct
  misc_feature 1..23: note = Description of Artificial Sequence: Syntheticoligonucleotide
  source 1..23: mol_type = other DNA
cctgactccaattggagtcaggg

SEQ ID NO: 5149 - DNA, 23 bp, synthetic construct
  misc_feature 1..23: note = Description of Artificial Sequence: Syntheticoligonucleotide
  source 1..23: mol_type = other DNA
cacgactccaattggagtcgtgg

SEQ ID NO: 5150 - DNA, 23 bp, synthetic construct
  misc_feature 1..23: note = Description of Artificial Sequence: Syntheticoligonucleotide
  source 1..23: mol_type = other DNA
gccgactccaattggagtcggct

SEQ ID NO: 5151 - DNA, 23 bp, synthetic construct
  misc_feature 1..23: note = Description of Artificial Sequence: Syntheticoligonucleotide
  source 1..23: mol_type = other DNA
gccgactccaattggagtcggca

SEQ ID NO: 5152 - DNA, 23 bp, synthetic construct
  misc_feature 1..23: note = Description of Artificial Sequence: Syntheticoligonucleotide
  source 1..23: mol_type = other DNA
cgagactccaattggagtctcgc

SEQ ID NO: 5153 - DNA, 23 bp, synthetic construct
  misc_feature 1..23: note = Description of Artificial Sequence: Syntheticoligonucleotide
  source 1..23: mol_type = other DNA
cgtgactccaattggagtcacgc

SEQ ID NO: 5154 - DNA, 23 bp, synthetic construct
  misc_feature 1..23: note = Description of Artificial Sequence: Syntheticoligonucleotide
  source 1..23: mol_type = other DNA
caggactccaattggagtcctgc

SEQ ID NO: 5155 - DNA, 23 bp, synthetic construct
  misc_feature 1..23: note = Description of Artificial Sequence: Syntheticoligonucleotide
  source 1..23: mol_type = other DNA
ctggactccaattggagtccagc

SEQ ID NO: 5156 - DNA, 23 bp, synthetic construct
  misc_feature 1..23: note = Description of Artificial Sequence: Syntheticoligonucleotide
  source 1..23: mol_type = other DNA
gaggactccaattggagtcctcg

SEQ ID NO: 5157 - DNA, 23 bp, synthetic construct
  misc_feature 1..23: note = Description of Artificial Sequence: Syntheticoligonucleotide
  source 1..23: mol_type = other DNA
gtggactccaattggagtccacg

SEQ ID NO: 5158 - DNA, 23 bp, synthetic construct
  misc_feature 1..23: note = Description of Artificial Sequence: Syntheticoligonucleotide
  source 1..23: mol_type = other DNA
accgactccaattggagtcggtg

SEQ ID NO: 5159 - DNA, 23 bp, synthetic construct
  misc_feature 1..23: note = Description of Artificial Sequence: Syntheticoligonucleotide
  source 1..23: mol_type = other DNA
tccgactccaattggagtcggag

SEQ ID NO: 5160 - DNA, 23 bp, synthetic construct
  misc_feature 1..23: note = Description of Artificial Sequence: Syntheticoligonucleotide
  source 1..23: mol_type = other DNA
cgggactccaattggagtcccgc

SEQ ID NO: 5161 - DNA, 23 bp, synthetic construct
  misc_feature 1..23: note = Description of Artificial Sequence: Syntheticoligonucleotide
  source 1..23: mol_type = other DNA
agggactccaattggagtccctc

SEQ ID NO: 5162 - DNA, 23 bp, synthetic construct
  misc_feature 1..23: note = Description of Artificial Sequence: Syntheticoligonucleotide
  source 1..23: mol_type = other DNA
tgggactccaattggagtcccac

SEQ ID NO: 5163 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactccatatggagtcnnnn

SEQ ID NO: 5164 - DNA, 23 bp, synthetic construct
  misc_feature 1..23: note = Description of Artificial Sequence: Syntheticoligonucleotide
  source 1..23: mol_type = other DNA
gcggactccatatggagtccgcc

SEQ ID NO: 5165 - DNA, 23 bp, synthetic construct
  misc_feature 1..23: note = Description of Artificial Sequence: Syntheticoligonucleotide
  source 1..23: mol_type = other DNA
gcggactccatatggagtccgct

SEQ ID NO: 5166 - DNA, 23 bp, synthetic construct
  misc_feature 1..23: note = Description of Artificial Sequence: Syntheticoligonucleotide
  source 1..23: mol_type = other DNA
acggactccatatggagtccgtc

SEQ ID NO: 5167 - DNA, 23 bp, synthetic construct
  misc_feature 1..23: note = Description of Artificial Sequence: Syntheticoligonucleotide
  source 1..23: mol_type = other DNA
gaggactccatatggagtcctcc

SEQ ID NO: 5168 - DNA, 23 bp, synthetic construct
  misc_feature 1..23: note = Description of Artificial Sequence: Syntheticoligonucleotide
  source 1..23: mol_type = other DNA
gcagactccatatggagtctgcc

SEQ ID NO: 5169 - DNA, 23 bp, synthetic construct
  misc_feature 1..23: note = Description of Artificial Sequence: Syntheticoligonucleotide
  source 1..23: mol_type = other DNA
gcggactccatatggagtccgca

SEQ ID NO: 5170 - DNA, 23 bp, synthetic construct
  misc_feature 1..23: note = Description of Artificial Sequence: Syntheticoligonucleotide
  source 1..23: mol_type = other DNA
tcggactccatatggagtccgac

SEQ ID NO: 5171 - DNA, 23 bp, synthetic construct
  misc_feature 1..23: note = Description of Artificial Sequence: Syntheticoligonucleotide
  source 1..23: mol_type = other DNA
gtggactccatatggagtccacc

SEQ ID NO: 5172 - DNA, 23 bp, synthetic construct
  misc_feature 1..23: note = Description of Artificial Sequence: Syntheticoligonucleotide
  source 1..23: mol_type = other DNA
gctgactccatatggagtcagcc

SEQ ID NO: 5173 - DNA, 23 bp, synthetic construct
  misc_feature 1..23: note = Description of Artificial Sequence: Syntheticoligonucleotide
  source 1..23: mol_type = other DNA
cccgactccatatggagtcgggc

SEQ ID NO: 5174 - DNA, 23 bp, synthetic construct
  misc_feature 1..23: note = Description of Artificial Sequence: Syntheticoligonucleotide
  source 1..23: mol_type = other DNA
cccgactccatatggagtcgggt

SEQ ID NO: 5175 - DNA, 23 bp, synthetic construct
  misc_feature 1..23: note = Description of Artificial Sequence: Syntheticoligonucleotide
  source 1..23: mol_type = other DNA
accgactccatatggagtcggtc

SEQ ID NO: 5176 - DNA, 23 bp, synthetic construct
  misc_feature 1..23: note = Description of Artificial Sequence: Syntheticoligonucleotide
  source 1..23: mol_type = other DNA
cacgactccatatggagtcgtgc

SEQ ID NO: 5177 - DNA, 23 bp, synthetic construct
  misc_feature 1..23: note = Description of Artificial Sequence: Syntheticoligonucleotide
  source 1..23: mol_type = other DNA
ccagactccatatggagtctggc

SEQ ID NO: 5178 - DNA, 23 bp, synthetic construct
  misc_feature 1..23: note = Description of Artificial Sequence: Syntheticoligonucleotide
  source 1..23: mol_type = other DNA
cccgactccatatggagtcggga

SEQ ID NO: 5179 - DNA, 23 bp, synthetic construct
  misc_feature 1..23: note = Description of Artificial Sequence: Syntheticoligonucleotide
  source 1..23: mol_type = other DNA
tccgactccatatggagtcggac

SEQ ID NO: 5180 - DNA, 23 bp, synthetic construct
  misc_feature 1..23: note = Description of Artificial Sequence: Syntheticoligonucleotide
  source 1..23: mol_type = other DNA
cctgactccatatggagtcaggc

SEQ ID NO: 5181 - DNA, 23 bp, synthetic construct
  misc_feature 1..23: note = Description of Artificial Sequence: Syntheticoligonucleotide
  source 1..23: mol_type = other DNA
ggcgactccatatggagtcgccc

SEQ ID NO: 5182 - DNA, 23 bp, synthetic construct
  misc_feature 1..23: note = Description of Artificial Sequence: Syntheticoligonucleotide
  source 1..23: mol_type = other DNA
ggcgactccatatggagtcgcct

SEQ ID NO: 5183 - DNA, 23 bp, synthetic construct
  misc_feature 1..23: note = Description of Artificial Sequence: Syntheticoligonucleotide
  source 1..23: mol_type = other DNA
agcgactccatatggagtcgctc

SEQ ID NO: 5184 - DNA, 23 bp, synthetic construct
  misc_feature 1..23: note = Description of Artificial Sequence: Syntheticoligonucleotide
  source 1..23: mol_type = other DNA
gacgactccatatggagtcgtcc

SEQ ID NO: 5185 - DNA, 23 bp, synthetic construct
  misc_feature 1..23: note = Description of Artificial Sequence: Syntheticoligonucleotide
  source 1..23: mol_type = other DNA
ggagactccatatggagtctccc

SEQ ID NO: 5186 - DNA, 23 bp, synthetic construct
  misc_feature 1..23: note = Description of Artificial Sequence: Syntheticoligonucleotide
  source 1..23: mol_type = other DNA
ggcgactccatatggagtcgcca

SEQ ID NO: 5187 - DNA, 23 bp, synthetic construct
  misc_feature 1..23: note = Description of Artificial Sequence: Syntheticoligonucleotide
  source 1..23: mol_type = other DNA
tgcgactccatatggagtcgcac

SEQ ID NO: 5188 - DNA, 23 bp, synthetic construct
  misc_feature 1..23: note = Description of Artificial Sequence: Syntheticoligonucleotide
  source 1..23: mol_type = other DNA
ggtgactccatatggagtcaccc

SEQ ID NO: 5189 - DNA, 23 bp, synthetic construct
  misc_feature 1..23: note = Description of Artificial Sequence: Syntheticoligonucleotide
  source 1..23: mol_type = other DNA
cgggactccatatggagtcccgt

SEQ ID NO: 5190 - DNA, 23 bp, synthetic construct
  misc_feature 1..23: note = Description of Artificial Sequence: Syntheticoligonucleotide
  source 1..23: mol_type = other DNA
agggactccatatggagtccctg

SEQ ID NO: 5191 - DNA, 23 bp, synthetic construct
  misc_feature 1..23: note = Description of Artificial Sequence: Syntheticoligonucleotide
  source 1..23: mol_type = other DNA
caggactccatatggagtcctgg

SEQ ID NO: 5192 - DNA, 23 bp, synthetic construct
  misc_feature 1..23: note = Description of Artificial Sequence: Syntheticoligonucleotide
  source 1..23: mol_type = other DNA
cgagactccatatggagtctcgg

SEQ ID NO: 5193 - DNA, 23 bp, synthetic construct
  misc_feature 1..23: note = Description of Artificial Sequence: Syntheticoligonucleotide
  source 1..23: mol_type = other DNA
cgggactccatatggagtcccga

SEQ ID NO: 5194 - DNA, 23 bp, synthetic construct
  misc_feature 1..23: note = Description of Artificial Sequence: Syntheticoligonucleotide
  source 1..23: mol_type = other DNA
tgggactccatatggagtcccag

SEQ ID NO: 5195 - DNA, 23 bp, synthetic construct
  misc_feature 1..23: note = Description of Artificial Sequence: Syntheticoligonucleotide
  source 1..23: mol_type = other DNA
ctggactccatatggagtccagg

SEQ ID NO: 5196 - DNA, 23 bp, synthetic construct
  misc_feature 1..23: note = Description of Artificial Sequence: Syntheticoligonucleotide
  source 1..23: mol_type = other DNA
cgtgactccatatggagtcacgg

SEQ ID NO: 5197 - DNA, 23 bp, synthetic construct
  misc_feature 1..23: note = Description of Artificial Sequence: Syntheticoligonucleotide
  source 1..23: mol_type = other DNA
ggcgactccatatggagtcgccg

SEQ ID NO: 5198 - DNA, 23 bp, synthetic construct
  misc_feature 1..23: note = Description of Artificial Sequence: Syntheticoligonucleotide
  source 1..23: mol_type = other DNA
agcgactccatatggagtcgctg

SEQ ID NO: 5199 - DNA, 23 bp, synthetic construct
  misc_feature 1..23: note = Description of Artificial Sequence: Syntheticoligonucleotide
  source 1..23: mol_type = other DNA
gacgactccatatggagtcgtcg

SEQ ID NO: 5200 - DNA, 23 bp, synthetic construct
  misc_feature 1..23: note = Description of Artificial Sequence: Syntheticoligonucleotide
  source 1..23: mol_type = other DNA
ggagactccatatggagtctccg

SEQ ID NO: 5201 - DNA, 23 bp, synthetic construct
  misc_feature 1..23: note = Description of Artificial Sequence: Syntheticoligonucleotide
  source 1..23: mol_type = other DNA
tgcgactccatatggagtcgcag

SEQ ID NO: 5202 - DNA, 23 bp, synthetic construct
  misc_feature 1..23: note = Description of Artificial Sequence: Syntheticoligonucleotide
  source 1..23: mol_type = other DNA
ggtgactccatatggagtcaccg

SEQ ID NO: 5203 - DNA, 23 bp, synthetic construct
  misc_feature 1..23: note = Description of Artificial Sequence: Syntheticoligonucleotide
  source 1..23: mol_type = other DNA
acggactccatatggagtccgtg

SEQ ID NO: 5204 - DNA, 23 bp, synthetic construct
  misc_feature 1..23: note = Description of Artificial Sequence: Syntheticoligonucleotide
  source 1..23: mol_type = other DNA
ccagactccatatggagtctggg

SEQ ID NO: 5205 - DNA, 23 bp, synthetic construct
  misc_feature 1..23: note = Description of Artificial Sequence: Syntheticoligonucleotide
  source 1..23: mol_type = other DNA
tcggactccatatggagtccgag

SEQ ID NO: 5206 - DNA, 23 bp, synthetic construct
  misc_feature 1..23: note = Description of Artificial Sequence: Syntheticoligonucleotide
  source 1..23: mol_type = other DNA
cctgactccatatggagtcaggg

SEQ ID NO: 5207 - DNA, 23 bp, synthetic construct
  misc_feature 1..23: note = Description of Artificial Sequence: Syntheticoligonucleotide
  source 1..23: mol_type = other DNA
cacgactccatatggagtcgtgg

SEQ ID NO: 5208 - DNA, 23 bp, synthetic construct
  misc_feature 1..23: note = Description of Artificial Sequence: Syntheticoligonucleotide
  source 1..23: mol_type = other DNA
gccgactccatatggagtcggct

SEQ ID NO: 5209 - DNA, 23 bp, synthetic construct
  misc_feature 1..23: note = Description of Artificial Sequence: Syntheticoligonucleotide
  source 1..23: mol_type = other DNA
gccgactccatatggagtcggca

SEQ ID NO: 5210 - DNA, 23 bp, synthetic construct
  misc_feature 1..23: note = Description of Artificial Sequence: Syntheticoligonucleotide
  source 1..23: mol_type = other DNA
cgagactccatatggagtctcgc

SEQ ID NO: 5211 - DNA, 23 bp, synthetic construct
  misc_feature 1..23: note = Description of Artificial Sequence: Syntheticoligonucleotide
  source 1..23: mol_type = other DNA
cgtgactccatatggagtcacgc

SEQ ID NO: 5212 - DNA, 23 bp, synthetic construct
  misc_feature 1..23: note = Description of Artificial Sequence: Syntheticoligonucleotide
  source 1..23: mol_type = other DNA
caggactccatatggagtcctgc

SEQ ID NO: 5213 - DNA, 23 bp, synthetic construct
  misc_feature 1..23: note = Description of Artificial Sequence: Syntheticoligonucleotide
  source 1..23: mol_type = other DNA
ctggactccatatggagtccagc

SEQ ID NO: 5214 - DNA, 23 bp, synthetic construct
  misc_feature 1..23: note = Description of Artificial Sequence: Syntheticoligonucleotide
  source 1..23: mol_type = other DNA
gaggactccatatggagtcctcg

SEQ ID NO: 5215 - DNA, 23 bp, synthetic construct
  misc_feature 1..23: note = Description of Artificial Sequence: Syntheticoligonucleotide
  source 1..23: mol_type = other DNA
gtggactccatatggagtccacg

SEQ ID NO: 5216 - DNA, 23 bp, synthetic construct
  misc_feature 1..23: note = Description of Artificial Sequence: Syntheticoligonucleotide
  source 1..23: mol_type = other DNA
accgactccatatggagtcggtg

SEQ ID NO: 5217 - DNA, 23 bp, synthetic construct
  misc_feature 1..23: note = Description of Artificial Sequence: Syntheticoligonucleotide
  source 1..23: mol_type = other DNA
tccgactccatatggagtcggag

SEQ ID NO: 5218 - DNA, 23 bp, synthetic construct
  misc_feature 1..23: note = Description of Artificial Sequence: Syntheticoligonucleotide
  source 1..23: mol_type = other DNA
cgggactccatatggagtcccgc

SEQ ID NO: 5219 - DNA, 23 bp, synthetic construct
  misc_feature 1..23: note = Description of Artificial Sequence: Syntheticoligonucleotide
  source 1..23: mol_type = other DNA
agggactccatatggagtccctc

SEQ ID NO: 5220 - DNA, 23 bp, synthetic construct
  misc_feature 1..23: note = Description of Artificial Sequence: Syntheticoligonucleotide
  source 1..23: mol_type = other DNA
tgggactccatatggagtcccac

SEQ ID NO: 5221 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactccagctggagtcnnnn

SEQ ID NO: 5222 - DNA, 23 bp, synthetic construct
  misc_feature 1..23: note = Description of Artificial Sequence: Syntheticoligonucleotide
  source 1..23: mol_type = other DNA
gcggactccagctggagtccgcc

SEQ ID NO: 5223 - DNA, 23 bp, synthetic construct
  misc_feature 1..23: note = Description of Artificial Sequence: Syntheticoligonucleotide
  source 1..23: mol_type = other DNA
gcggactccagctggagtccgct

SEQ ID NO: 5224 - DNA, 23 bp, synthetic construct
  misc_feature 1..23: note = Description of Artificial Sequence: Syntheticoligonucleotide
  source 1..23: mol_type = other DNA
acggactccagctggagtccgtc

SEQ ID NO: 5225 - DNA, 23 bp, synthetic construct
  misc_feature 1..23: note = Description of Artificial Sequence: Syntheticoligonucleotide
  source 1..23: mol_type = other DNA
gaggactccagctggagtcctcc

SEQ ID NO: 5226 - DNA, 23 bp, synthetic construct
  misc_feature 1..23: note = Description of Artificial Sequence: Syntheticoligonucleotide
  source 1..23: mol_type = other DNA
gcagactccagctggagtctgcc

SEQ ID NO: 5227 - DNA, 23 bp, synthetic construct
  misc_feature 1..23: note = Description of Artificial Sequence: Syntheticoligonucleotide
  source 1..23: mol_type = other DNA
gcggactccagctggagtccgca

SEQ ID NO: 5228 - DNA, 23 bp, synthetic construct
  misc_feature 1..23: note = Description of Artificial Sequence: Syntheticoligonucleotide
  source 1..23: mol_type = other DNA
tcggactccagctggagtccgac

SEQ ID NO: 5229 - DNA, 23 bp, synthetic construct
  misc_feature 1..23: note = Description of Artificial Sequence: Syntheticoligonucleotide
  source 1..23: mol_type = other DNA
gtggactccagctggagtccacc

SEQ ID NO: 5230 - DNA, 23 bp, synthetic construct
  misc_feature 1..23: note = Description of Artificial Sequence: Syntheticoligonucleotide
  source 1..23: mol_type = other DNA
gctgactccagctggagtcagcc

SEQ ID NO: 5231 - DNA, 23 bp, synthetic construct
  misc_feature 1..23: note = Description of Artificial Sequence: Syntheticoligonucleotide
  source 1..23: mol_type = other DNA
cccgactccagctggagtcgggc

SEQ ID NO: 5232 - DNA, 23 bp, synthetic construct
  misc_feature 1..23: note = Description of Artificial Sequence: Syntheticoligonucleotide
  source 1..23: mol_type = other DNA
cccgactccagctggagtcgggt

SEQ ID NO: 5233 - DNA, 23 bp, synthetic construct
  misc_feature 1..23: note = Description of Artificial Sequence: Syntheticoligonucleotide
  source 1..23: mol_type = other DNA
accgactccagctggagtcggtc

SEQ ID NO: 5234 - DNA, 23 bp, synthetic construct
  misc_feature 1..23: note = Description of Artificial Sequence: Syntheticoligonucleotide
  source 1..23: mol_type = other DNA
cacgactccagctggagtcgtgc

SEQ ID NO: 5235 - DNA, 23 bp, synthetic construct
  misc_feature 1..23: note = Description of Artificial Sequence: Syntheticoligonucleotide
  source 1..23: mol_type = other DNA
ccagactccagctggagtctggc

SEQ ID NO: 5236 - DNA, 23 bp, synthetic construct
  misc_feature 1..23: note = Description of Artificial Sequence: Syntheticoligonucleotide
  source 1..23: mol_type = other DNA
cccgactccagctggagtcggga

SEQ ID NO: 5237 - DNA, 23 bp, synthetic construct
  misc_feature 1..23: note = Description of Artificial Sequence: Syntheticoligonucleotide
  source 1..23: mol_type = other DNA
tccgactccagctggagtcggac

SEQ ID NO: 5238 - DNA, 23 bp, synthetic construct
  misc_feature 1..23: note = Description of Artificial Sequence: Syntheticoligonucleotide
  source 1..23: mol_type = other DNA
cctgactccagctggagtcaggc

SEQ ID NO: 5239 - DNA, 23 bp, synthetic construct
  misc_feature 1..23: note = Description of Artificial Sequence: Syntheticoligonucleotide
  source 1..23: mol_type = other DNA
ggcgactccagctggagtcgccc

SEQ ID NO: 5240 - DNA, 23 bp, synthetic construct
  misc_feature 1..23: note = Description of Artificial Sequence: Syntheticoligonucleotide
  source 1..23: mol_type = other DNA
ggcgactccagctggagtcgcct

SEQ ID NO: 5241 - DNA, 23 bp, synthetic construct
  misc_feature 1..23: note = Description of Artificial Sequence: Syntheticoligonucleotide
  source 1..23: mol_type = other DNA
agcgactccagctggagtcgctc

SEQ ID NO: 5242 - DNA, 23 bp, synthetic construct
  misc_feature 1..23: note = Description of Artificial Sequence: Syntheticoligonucleotide
  source 1..23: mol_type = other DNA
gacgactccagctggagtcgtcc

SEQ ID NO: 5243 - DNA, 23 bp, synthetic construct
  misc_feature 1..23: note = Description of Artificial Sequence: Syntheticoligonucleotide
  source 1..23: mol_type = other DNA
ggagactccagctggagtctccc

SEQ ID NO: 5244 - DNA, 23 bp, synthetic construct
  misc_feature 1..23: note = Description of Artificial Sequence: Syntheticoligonucleotide
  source 1..23: mol_type = other DNA
ggcgactccagctggagtcgcca

SEQ ID NO: 5245 - DNA, 23 bp, synthetic construct
  misc_feature 1..23: note = Description of Artificial Sequence: Syntheticoligonucleotide
  source 1..23: mol_type = other DNA
tgcgactccagctggagtcgcac

SEQ ID NO: 5246 - DNA, 23 bp, synthetic construct
  misc_feature 1..23: note = Description of Artificial Sequence: Syntheticoligonucleotide
  source 1..23: mol_type = other DNA
ggtgactccagctggagtcaccc

SEQ ID NO: 5247 - DNA, 23 bp, synthetic construct
  misc_feature 1..23: note = Description of Artificial Sequence: Syntheticoligonucleotide
  source 1..23: mol_type = other DNA
cgggactccagctggagtcccgt

SEQ ID NO: 5248 - DNA, 23 bp, synthetic construct
  misc_feature 1..23: note = Description of Artificial Sequence: Syntheticoligonucleotide
  source 1..23: mol_type = other DNA
agggactccagctggagtccctg

SEQ ID NO: 5249 - DNA, 23 bp, synthetic construct
  misc_feature 1..23: note = Description of Artificial Sequence: Syntheticoligonucleotide
  source 1..23: mol_type = other DNA
caggactccagctggagtcctgg

SEQ ID NO: 5250 - DNA, 23 bp, synthetic construct
  misc_feature 1..23: note = Description of Artificial Sequence: Syntheticoligonucleotide
  source 1..23: mol_type = other DNA
cgagactccagctggagtctcgg

SEQ ID NO: 5251 - DNA, 23 bp, synthetic construct
  misc_feature 1..23: note = Description of Artificial Sequence: Syntheticoligonucleotide
  source 1..23: mol_type = other DNA
cgggactccagctggagtcccga

SEQ ID NO: 5252 - DNA, 23 bp, synthetic construct
  misc_feature 1..23: note = Description of Artificial Sequence: Syntheticoligonucleotide
  source 1..23: mol_type = other DNA
tgggactccagctggagtcccag

SEQ ID NO: 5253 - DNA, 23 bp, synthetic construct
  misc_feature 1..23: note = Description of Artificial Sequence: Syntheticoligonucleotide
  source 1..23: mol_type = other DNA
ctggactccagctggagtccagg

SEQ ID NO: 5254 - DNA, 23 bp, synthetic construct
  misc_feature 1..23: note = Description of Artificial Sequence: Syntheticoligonucleotide
  source 1..23: mol_type = other DNA
cgtgactccagctggagtcacgg

SEQ ID NO: 5255 - DNA, 23 bp, synthetic construct
  misc_feature 1..23: note = Description of Artificial Sequence: Syntheticoligonucleotide
  source 1..23: mol_type = other DNA
ggcgactccagctggagtcgccg

SEQ ID NO: 5256 - DNA, 23 bp, synthetic construct
  misc_feature 1..23: note = Description of Artificial Sequence: Syntheticoligonucleotide
  source 1..23: mol_type = other DNA
agcgactccagctggagtcgctg

SEQ ID NO: 5257 - DNA, 23 bp, synthetic construct
  misc_feature 1..23: note = Description of Artificial Sequence: Syntheticoligonucleotide
  source 1..23: mol_type = other DNA
gacgactccagctggagtcgtcg

SEQ ID NO: 5258 - DNA, 23 bp, synthetic construct
  misc_feature 1..23: note = Description of Artificial Sequence: Syntheticoligonucleotide
  source 1..23: mol_type = other DNA
ggagactccagctggagtctccg

SEQ ID NO: 5259 - DNA, 23 bp, synthetic construct
  misc_feature 1..23: note = Description of Artificial Sequence: Syntheticoligonucleotide
  source 1..23: mol_type = other DNA
tgcgactccagctggagtcgcag

SEQ ID NO: 5260 - DNA, 23 bp, synthetic construct
  misc_feature 1..23: note = Description of Artificial Sequence: Syntheticoligonucleotide
  source 1..23: mol_type = other DNA
ggtgactccagctggagtcaccg

SEQ ID NO: 5261 - DNA, 23 bp, synthetic construct
  misc_feature 1..23: note = Description of Artificial Sequence: Syntheticoligonucleotide
  source 1..23: mol_type = other DNA
acggactccagctggagtccgtg

SEQ ID NO: 5262 - DNA, 23 bp, synthetic construct
  misc_feature 1..23: note = Description of Artificial Sequence: Syntheticoligonucleotide
  source 1..23: mol_type = other DNA
ccagactccagctggagtctggg

SEQ ID NO: 5263 - DNA, 23 bp, synthetic construct
  misc_feature 1..23: note = Description of Artificial Sequence: Syntheticoligonucleotide
  source 1..23: mol_type = other DNA
tcggactccagctggagtccgag

SEQ ID NO: 5264 - DNA, 23 bp, synthetic construct
  misc_feature 1..23: note = Description of Artificial Sequence: Syntheticoligonucleotide
  source 1..23: mol_type = other DNA
cctgactccagctggagtcaggg

SEQ ID NO: 5265 - DNA, 23 bp, synthetic construct
  misc_feature 1..23: note = Description of Artificial Sequence: Syntheticoligonucleotide
  source 1..23: mol_type = other DNA
cacgactccagctggagtcgtgg

SEQ ID NO: 5266 - DNA, 23 bp, synthetic construct
  misc_feature 1..23: note = Description of Artificial Sequence: Syntheticoligonucleotide
  source 1..23: mol_type = other DNA
gccgactccagctggagtcggct

SEQ ID NO: 5267 - DNA, 23 bp, synthetic construct
  misc_feature 1..23: note = Description of Artificial Sequence: Syntheticoligonucleotide
  source 1..23: mol_type = other DNA
gccgactccagctggagtcggca

SEQ ID NO: 5268 - DNA, 23 bp, synthetic construct
  misc_feature 1..23: note = Description of Artificial Sequence: Syntheticoligonucleotide
  source 1..23: mol_type = other DNA
cgagactccagctggagtctcgc

SEQ ID NO: 5269 - DNA, 23 bp, synthetic construct
  misc_feature 1..23: note = Description of Artificial Sequence: Syntheticoligonucleotide
  source 1..23: mol_type = other DNA
cgtgactccagctggagtcacgc

SEQ ID NO: 5270 - DNA, 23 bp, synthetic construct
  misc_feature 1..23: note = Description of Artificial Sequence: Syntheticoligonucleotide
  source 1..23: mol_type = other DNA
caggactccagctggagtcctgc

SEQ ID NO: 5271 - DNA, 23 bp, synthetic construct
  misc_feature 1..23: note = Description of Artificial Sequence: Syntheticoligonucleotide
  source 1..23: mol_type = other DNA
ctggactccagctggagtccagc

SEQ ID NO: 5272 - DNA, 23 bp, synthetic construct
  misc_feature 1..23: note = Description of Artificial Sequence: Syntheticoligonucleotide
  source 1..23: mol_type = other DNA
gaggactccagctggagtcctcg

SEQ ID NO: 5273 - DNA, 23 bp, synthetic construct
  misc_feature 1..23: note = Description of Artificial Sequence: Syntheticoligonucleotide
  source 1..23: mol_type = other DNA
gtggactccagctggagtccacg

SEQ ID NO: 5274 - DNA, 23 bp, synthetic construct
  misc_feature 1..23: note = Description of Artificial Sequence: Syntheticoligonucleotide
  source 1..23: mol_type = other DNA
accgactccagctggagtcggtg

SEQ ID NO: 5275 - DNA, 23 bp, synthetic construct
  misc_feature 1..23: note = Description of Artificial Sequence: Syntheticoligonucleotide
  source 1..23: mol_type = other DNA
tccgactccagctggagtcggag

SEQ ID NO: 5276 - DNA, 23 bp, synthetic construct
  misc_feature 1..23: note = Description of Artificial Sequence: Syntheticoligonucleotide
  source 1..23: mol_type = other DNA
cgggactccagctggagtcccgc

SEQ ID NO: 5277 - DNA, 23 bp, synthetic construct
  misc_feature 1..23: note = Description of Artificial Sequence: Syntheticoligonucleotide
  source 1..23: mol_type = other DNA
agggactccagctggagtccctc

SEQ ID NO: 5278 - DNA, 23 bp, synthetic construct
  misc_feature 1..23: note = Description of Artificial Sequence: Syntheticoligonucleotide
  source 1..23: mol_type = other DNA
tgggactccagctggagtcccac

SEQ ID NO: 5279 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactccacgtggagtcnnnn

SEQ ID NO: 5280 - DNA, 23 bp, synthetic construct
  misc_feature 1..23: note = Description of Artificial Sequence: Syntheticoligonucleotide
  source 1..23: mol_type = other DNA
gcggactccacgtggagtccgcc

SEQ ID NO: 5281 - DNA, 23 bp, synthetic construct
  misc_feature 1..23: note = Description of Artificial Sequence: Syntheticoligonucleotide
  source 1..23: mol_type = other DNA
gcggactccacgtggagtccgct

SEQ ID NO: 5282 - DNA, 23 bp, synthetic construct
  misc_feature 1..23: note = Description of Artificial Sequence: Syntheticoligonucleotide
  source 1..23: mol_type = other DNA
acggactccacgtggagtccgtc

SEQ ID NO: 5283 - DNA, 23 bp, synthetic construct
  misc_feature 1..23: note = Description of Artificial Sequence: Syntheticoligonucleotide
  source 1..23: mol_type = other DNA
gaggactccacgtggagtcctcc

SEQ ID NO: 5284 - DNA, 23 bp, synthetic construct
  misc_feature 1..23: note = Description of Artificial Sequence: Syntheticoligonucleotide
  source 1..23: mol_type = other DNA
gcagactccacgtggagtctgcc

SEQ ID NO: 5285 - DNA, 23 bp, synthetic construct
  misc_feature 1..23: note = Description of Artificial Sequence: Syntheticoligonucleotide
  source 1..23: mol_type = other DNA
gcggactccacgtggagtccgca

SEQ ID NO: 5286 - DNA, 23 bp, synthetic construct
  misc_feature 1..23: note = Description of Artificial Sequence: Syntheticoligonucleotide
  source 1..23: mol_type = other DNA
tcggactccacgtggagtccgac

SEQ ID NO: 5287 - DNA, 23 bp, synthetic construct
  misc_feature 1..23: note = Description of Artificial Sequence: Syntheticoligonucleotide
  source 1..23: mol_type = other DNA
gtggactccacgtggagtccacc

SEQ ID NO: 5288 - DNA, 23 bp, synthetic construct
  misc_feature 1..23: note = Description of Artificial Sequence: Syntheticoligonucleotide
  source 1..23: mol_type = other DNA
gctgactccacgtggagtcagcc

SEQ ID NO: 5289 - DNA, 23 bp, synthetic construct
  misc_feature 1..23: note = Description of Artificial Sequence: Syntheticoligonucleotide
  source 1..23: mol_type = other DNA
cccgactccacgtggagtcgggc

SEQ ID NO: 5290 - DNA, 23 bp, synthetic construct
  misc_feature 1..23: note = Description of Artificial Sequence: Syntheticoligonucleotide
  source 1..23: mol_type = other DNA
cccgactccacgtggagtcgggt

SEQ ID NO: 5291 - DNA, 23 bp, synthetic construct
  misc_feature 1..23: note = Description of Artificial Sequence: Syntheticoligonucleotide
  source 1..23: mol_type = other DNA
accgactccacgtggagtcggtc

SEQ ID NO: 5292 - DNA, 23 bp, synthetic construct
  misc_feature 1..23: note = Description of Artificial Sequence: Syntheticoligonucleotide
  source 1..23: mol_type = other DNA
cacgactccacgtggagtcgtgc

SEQ ID NO: 5293 - DNA, 23 bp, synthetic construct
  misc_feature 1..23: note = Description of Artificial Sequence: Syntheticoligonucleotide
  source 1..23: mol_type = other DNA
ccagactccacgtggagtctggc

SEQ ID NO: 5294 - DNA, 23 bp, synthetic construct
  misc_feature 1..23: note = Description of Artificial Sequence: Syntheticoligonucleotide
  source 1..23: mol_type = other DNA
cccgactccacgtggagtcggga

SEQ ID NO: 5295 - DNA, 23 bp, synthetic construct
  misc_feature 1..23: note = Description of Artificial Sequence: Syntheticoligonucleotide
  source 1..23: mol_type = other DNA
tccgactccacgtggagtcggac

SEQ ID NO: 5296 - DNA, 23 bp, synthetic construct
  misc_feature 1..23: note = Description of Artificial Sequence: Syntheticoligonucleotide
  source 1..23: mol_type = other DNA
cctgactccacgtggagtcaggc

SEQ ID NO: 5297 - DNA, 23 bp, synthetic construct
  misc_feature 1..23: note = Description of Artificial Sequence: Syntheticoligonucleotide
  source 1..23: mol_type = other DNA
ggcgactccacgtggagtcgccc

SEQ ID NO: 5298 - DNA, 23 bp, synthetic construct
  misc_feature 1..23: note = Description of Artificial Sequence: Syntheticoligonucleotide
  source 1..23: mol_type = other DNA
ggcgactccacgtggagtcgcct

SEQ ID NO: 5299 - DNA, 23 bp, synthetic construct
  misc_feature 1..23: note = Description of Artificial Sequence: Syntheticoligonucleotide
  source 1..23: mol_type = other DNA
agcgactccacgtggagtcgctc

SEQ ID NO: 5300 - DNA, 23 bp, synthetic construct
  misc_feature 1..23: note = Description of Artificial Sequence: Syntheticoligonucleotide
  source 1..23: mol_type = other DNA
gacgactccacgtggagtcgtcc

SEQ ID NO: 5301 - DNA, 23 bp, synthetic construct
  misc_feature 1..23: note = Description of Artificial Sequence: Syntheticoligonucleotide
  source 1..23: mol_type = other DNA
ggagactccacgtggagtctccc

SEQ ID NO: 5302 - DNA, 23 bp, synthetic construct
  misc_feature 1..23: note = Description of Artificial Sequence: Syntheticoligonucleotide
  source 1..23: mol_type = other DNA
ggcgactccacgtggagtcgcca

SEQ ID NO: 5303 - DNA, 23 bp, synthetic construct
  misc_feature 1..23: note = Description of Artificial Sequence: Syntheticoligonucleotide
  source 1..23: mol_type = other DNA
tgcgactccacgtggagtcgcac

SEQ ID NO: 5304 - DNA, 23 bp, synthetic construct
  misc_feature 1..23: note = Description of Artificial Sequence: Syntheticoligonucleotide
  source 1..23: mol_type = other DNA
ggtgactccacgtggagtcaccc

SEQ ID NO: 5305 - DNA, 23 bp, synthetic construct
  misc_feature 1..23: note = Description of Artificial Sequence: Syntheticoligonucleotide
  source 1..23: mol_type = other DNA
cgggactccacgtggagtcccgt

SEQ ID NO: 5306 - DNA, 23 bp, synthetic construct
  misc_feature 1..23: note = Description of Artificial Sequence: Syntheticoligonucleotide
  source 1..23: mol_type = other DNA
agggactccacgtggagtccctg

SEQ ID NO: 5307 - DNA, 23 bp, synthetic construct
  misc_feature 1..23: note = Description of Artificial Sequence: Syntheticoligonucleotide
  source 1..23: mol_type = other DNA
caggactccacgtggagtcctgg

SEQ ID NO: 5308 - DNA, 23 bp, synthetic construct
  misc_feature 1..23: note = Description of Artificial Sequence: Syntheticoligonucleotide
  source 1..23: mol_type = other DNA
cgagactccacgtggagtctcgg

SEQ ID NO: 5309 - DNA, 23 bp, synthetic construct
  misc_feature 1..23: note = Description of Artificial Sequence: Syntheticoligonucleotide
  source 1..23: mol_type = other DNA
cgggactccacgtggagtcccga

SEQ ID NO: 5310 - DNA, 23 bp, synthetic construct
  misc_feature 1..23: note = Description of Artificial Sequence: Syntheticoligonucleotide
  source 1..23: mol_type = other DNA
tgggactccacgtggagtcccag

SEQ ID NO: 5311 - DNA, 23 bp, synthetic construct
  misc_feature 1..23: note = Description of Artificial Sequence: Syntheticoligonucleotide
  source 1..23: mol_type = other DNA
ctggactccacgtggagtccagg

SEQ ID NO: 5312 - DNA, 23 bp, synthetic construct
  misc_feature 1..23: note = Description of Artificial Sequence: Syntheticoligonucleotide
  source 1..23: mol_type = other DNA
cgtgactccacgtggagtcacgg

SEQ ID NO: 5313 - DNA, 23 bp, synthetic construct
  misc_feature 1..23: note = Description of Artificial Sequence: Syntheticoligonucleotide
  source 1..23: mol_type = other DNA
ggcgactccacgtggagtcgccg

SEQ ID NO: 5314 - DNA, 23 bp, synthetic construct
  misc_feature 1..23: note = Description of Artificial Sequence: Syntheticoligonucleotide
  source 1..23: mol_type = other DNA
agcgactccacgtggagtcgctg

SEQ ID NO: 5315 - DNA, 23 bp, synthetic construct
  misc_feature 1..23: note = Description of Artificial Sequence: Syntheticoligonucleotide
  source 1..23: mol_type = other DNA
gacgactccacgtggagtcgtcg

SEQ ID NO: 5316 - DNA, 23 bp, synthetic construct
  misc_feature 1..23: note = Description of Artificial Sequence: Syntheticoligonucleotide
  source 1..23: mol_type = other DNA
ggagactccacgtggagtctccg

SEQ ID NO: 5317 - DNA, 23 bp, synthetic construct
  misc_feature 1..23: note = Description of Artificial Sequence: Syntheticoligonucleotide
  source 1..23: mol_type = other DNA
tgcgactccacgtggagtcgcag

SEQ ID NO: 5318 - DNA, 23 bp, synthetic construct
  misc_feature 1..23: note = Description of Artificial Sequence: Syntheticoligonucleotide
  source 1..23: mol_type = other DNA
ggtgactccacgtggagtcaccg

SEQ ID NO: 5319 - DNA, 23 bp, synthetic construct
  misc_feature 1..23: note = Description of Artificial Sequence: Syntheticoligonucleotide
  source 1..23: mol_type = other DNA
acggactccacgtggagtccgtg

SEQ ID NO: 5320 - DNA, 23 bp, synthetic construct
  misc_feature 1..23: note = Description of Artificial Sequence: Syntheticoligonucleotide
  source 1..23: mol_type = other DNA
ccagactccacgtggagtctggg

SEQ ID NO: 5321 - DNA, 23 bp, synthetic construct
  misc_feature 1..23: note = Description of Artificial Sequence: Syntheticoligonucleotide
  source 1..23: mol_type = other DNA
tcggactccacgtggagtccgag

SEQ ID NO: 5322 - DNA, 23 bp, synthetic construct
  misc_feature 1..23: note = Description of Artificial Sequence: Syntheticoligonucleotide
  source 1..23: mol_type = other DNA
cctgactccacgtggagtcaggg

SEQ ID NO: 5323 - DNA, 23 bp, synthetic construct
  misc_feature 1..23: note = Description of Artificial Sequence: Syntheticoligonucleotide
  source 1..23: mol_type = other DNA
cacgactccacgtggagtcgtgg

SEQ ID NO: 5324 - DNA, 23 bp, synthetic construct
  misc_feature 1..23: note = Description of Artificial Sequence: Syntheticoligonucleotide
  source 1..23: mol_type = other DNA
gccgactccacgtggagtcggct

SEQ ID NO: 5325 - DNA, 23 bp, synthetic construct
  misc_feature 1..23: note = Description of Artificial Sequence: Syntheticoligonucleotide
  source 1..23: mol_type = other DNA
gccgactccacgtggagtcggca

SEQ ID NO: 5326 - DNA, 23 bp, synthetic construct
  misc_feature 1..23: note = Description of Artificial Sequence: Syntheticoligonucleotide
  source 1..23: mol_type = other DNA
cgagactccacgtggagtctcgc

SEQ ID NO: 5327 - DNA, 23 bp, synthetic construct
  misc_feature 1..23: note = Description of Artificial Sequence: Syntheticoligonucleotide
  source 1..23: mol_type = other DNA
cgtgactccacgtggagtcacgc

SEQ ID NO: 5328 - DNA, 23 bp, synthetic construct
  misc_feature 1..23: note = Description of Artificial Sequence: Syntheticoligonucleotide
  source 1..23: mol_type = other DNA
caggactccacgtggagtcctgc

SEQ ID NO: 5329 - DNA, 23 bp, synthetic construct
  misc_feature 1..23: note = Description of Artificial Sequence: Syntheticoligonucleotide
  source 1..23: mol_type = other DNA
ctggactccacgtggagtccagc

SEQ ID NO: 5330 - DNA, 23 bp, synthetic construct
  misc_feature 1..23: note = Description of Artificial Sequence: Syntheticoligonucleotide
  source 1..23: mol_type = other DNA
gaggactccacgtggagtcctcg

SEQ ID NO: 5331 - DNA, 23 bp, synthetic construct
  misc_feature 1..23: note = Description of Artificial Sequence: Syntheticoligonucleotide
  source 1..23: mol_type = other DNA
gtggactccacgtggagtccacg

SEQ ID NO: 5332 - DNA, 23 bp, synthetic construct
  misc_feature 1..23: note = Description of Artificial Sequence: Syntheticoligonucleotide
  source 1..23: mol_type = other DNA
accgactccacgtggagtcggtg

SEQ ID NO: 5333 - DNA, 23 bp, synthetic construct
  misc_feature 1..23: note = Description of Artificial Sequence: Syntheticoligonucleotide
  source 1..23: mol_type = other DNA
tccgactccacgtggagtcggag

SEQ ID NO: 5334 - DNA, 23 bp, synthetic construct
  misc_feature 1..23: note = Description of Artificial Sequence: Syntheticoligonucleotide
  source 1..23: mol_type = other DNA
cgggactccacgtggagtcccgc

SEQ ID NO: 5335 - DNA, 23 bp, synthetic construct
  misc_feature 1..23: note = Description of Artificial Sequence: Syntheticoligonucleotide
  source 1..23: mol_type = other DNA
agggactccacgtggagtccctc

SEQ ID NO: 5336 - DNA, 23 bp, synthetic construct
  misc_feature 1..23: note = Description of Artificial Sequence: Syntheticoligonucleotide
  source 1..23: mol_type = other DNA
tgggactccacgtggagtcccac

SEQ ID NO: 5337 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactctcatgagagtcnnnn

SEQ ID NO: 5338 - DNA, 23 bp, synthetic construct
  misc_feature 1..23: note = Description of Artificial Sequence: Syntheticoligonucleotide
  source 1..23: mol_type = other DNA
gcggactctcatgagagtccgcc

SEQ ID NO: 5339 - DNA, 23 bp, synthetic construct
  misc_feature 1..23: note = Description of Artificial Sequence: Syntheticoligonucleotide
  source 1..23: mol_type = other DNA
gcggactctcatgagagtccgct

SEQ ID NO: 5340 - DNA, 23 bp, synthetic construct
  misc_feature 1..23: note = Description of Artificial Sequence: Syntheticoligonucleotide
  source 1..23: mol_type = other DNA
acggactctcatgagagtccgtc

SEQ ID NO: 5341 - DNA, 23 bp, synthetic construct
  misc_feature 1..23: note = Description of Artificial Sequence: Syntheticoligonucleotide
  source 1..23: mol_type = other DNA
gaggactctcatgagagtcctcc

SEQ ID NO: 5342 - DNA, 23 bp, synthetic construct
  misc_feature 1..23: note = Description of Artificial Sequence: Syntheticoligonucleotide
  source 1..23: mol_type = other DNA
gcagactctcatgagagtctgcc

SEQ ID NO: 5343 - DNA, 23 bp, synthetic construct
  misc_feature 1..23: note = Description of Artificial Sequence: Syntheticoligonucleotide
  source 1..23: mol_type = other DNA
gcggactctcatgagagtccgca

SEQ ID NO: 5344 - DNA, 23 bp, synthetic construct
  misc_feature 1..23: note = Description of Artificial Sequence: Syntheticoligonucleotide
  source 1..23: mol_type = other DNA
tcggactctcatgagagtccgac

SEQ ID NO: 5345 - DNA, 23 bp, synthetic construct
  misc_feature 1..23: note = Description of Artificial Sequence: Syntheticoligonucleotide
  source 1..23: mol_type = other DNA
gtggactctcatgagagtccacc

SEQ ID NO: 5346 - DNA, 23 bp, synthetic construct
  misc_feature 1..23: note = Description of Artificial Sequence: Syntheticoligonucleotide
  source 1..23: mol_type = other DNA
gctgactctcatgagagtcagcc

SEQ ID NO: 5347 - DNA, 23 bp, synthetic construct
  misc_feature 1..23: note = Description of Artificial Sequence: Syntheticoligonucleotide
  source 1..23: mol_type = other DNA
cccgactctcatgagagtcgggc

SEQ ID NO: 5348 - DNA, 23 bp, synthetic construct
  misc_feature 1..23: note = Description of Artificial Sequence: Syntheticoligonucleotide
  source 1..23: mol_type = other DNA
cccgactctcatgagagtcgggt

SEQ ID NO: 5349 - DNA, 23 bp, synthetic construct
  misc_feature 1..23: note = Description of Artificial Sequence: Syntheticoligonucleotide
  source 1..23: mol_type = other DNA
accgactctcatgagagtcggtc

SEQ ID NO: 5350 - DNA, 23 bp, synthetic construct
  misc_feature 1..23: note = Description of Artificial Sequence: Syntheticoligonucleotide
  source 1..23: mol_type = other DNA
cacgactctcatgagagtcgtgc

SEQ ID NO: 5351 - DNA, 23 bp, synthetic construct
  misc_feature 1..23: note = Description of Artificial Sequence: Syntheticoligonucleotide
  source 1..23: mol_type = other DNA
ccagactctcatgagagtctggc

SEQ ID NO: 5352 - DNA, 23 bp, synthetic construct
  misc_feature 1..23: note = Description of Artificial Sequence: Syntheticoligonucleotide
  source 1..23: mol_type = other DNA
cccgactctcatgagagtcggga

SEQ ID NO: 5353 - DNA, 23 bp, synthetic construct
  misc_feature 1..23: note = Description of Artificial Sequence: Syntheticoligonucleotide
  source 1..23: mol_type = other DNA
tccgactctcatgagagtcggac

SEQ ID NO: 5354 - DNA, 23 bp, synthetic construct
  misc_feature 1..23: note = Description of Artificial Sequence: Syntheticoligonucleotide
  source 1..23: mol_type = other DNA
cctgactctcatgagagtcaggc

SEQ ID NO: 5355 - DNA, 23 bp, synthetic construct
  misc_feature 1..23: note = Description of Artificial Sequence: Syntheticoligonucleotide
  source 1..23: mol_type = other DNA
ggcgactctcatgagagtcgccc

SEQ ID NO: 5356 - DNA, 23 bp, synthetic construct
  misc_feature 1..23: note = Description of Artificial Sequence: Syntheticoligonucleotide
  source 1..23: mol_type = other DNA
ggcgactctcatgagagtcgcct

SEQ ID NO: 5357 - DNA, 23 bp, synthetic construct
  misc_feature 1..23: note = Description of Artificial Sequence: Syntheticoligonucleotide
  source 1..23: mol_type = other DNA
agcgactctcatgagagtcgctc

SEQ ID NO: 5358 - DNA, 23 bp, synthetic construct
  misc_feature 1..23: note = Description of Artificial Sequence: Syntheticoligonucleotide
  source 1..23: mol_type = other DNA
gacgactctcatgagagtcgtcc

SEQ ID NO: 5359 - DNA, 23 bp, synthetic construct
  misc_feature 1..23: note = Description of Artificial Sequence: Syntheticoligonucleotide
  source 1..23: mol_type = other DNA
ggagactctcatgagagtctccc

SEQ ID NO: 5360 - DNA, 23 bp, synthetic construct
  misc_feature 1..23: note = Description of Artificial Sequence: Syntheticoligonucleotide
  source 1..23: mol_type = other DNA
ggcgactctcatgagagtcgcca

SEQ ID NO: 5361 - DNA, 23 bp, synthetic construct
  misc_feature 1..23: note = Description of Artificial Sequence: Syntheticoligonucleotide
  source 1..23: mol_type = other DNA
tgcgactctcatgagagtcgcac

SEQ ID NO: 5362 - DNA, 23 bp, synthetic construct
  misc_feature 1..23: note = Description of Artificial Sequence: Syntheticoligonucleotide
  source 1..23: mol_type = other DNA
ggtgactctcatgagagtcaccc

SEQ ID NO: 5363 - DNA, 23 bp, synthetic construct
  misc_feature 1..23: note = Description of Artificial Sequence: Syntheticoligonucleotide
  source 1..23: mol_type = other DNA
cgggactctcatgagagtcccgt

SEQ ID NO: 5364 - DNA, 23 bp, synthetic construct
  misc_feature 1..23: note = Description of Artificial Sequence: Syntheticoligonucleotide
  source 1..23: mol_type = other DNA
agggactctcatgagagtccctg

SEQ ID NO: 5365 - DNA, 23 bp, synthetic construct
  misc_feature 1..23: note = Description of Artificial Sequence: Syntheticoligonucleotide
  source 1..23: mol_type = other DNA
caggactctcatgagagtcctgg

SEQ ID NO: 5366 - DNA, 23 bp, synthetic construct
  misc_feature 1..23: note = Description of Artificial Sequence: Syntheticoligonucleotide
  source 1..23: mol_type = other DNA
cgagactctcatgagagtctcgg

SEQ ID NO: 5367 - DNA, 23 bp, synthetic construct
  misc_feature 1..23: note = Description of Artificial Sequence: Syntheticoligonucleotide
  source 1..23: mol_type = other DNA
cgggactctcatgagagtcccga

SEQ ID NO: 5368 - DNA, 23 bp, synthetic construct
  misc_feature 1..23: note = Description of Artificial Sequence: Syntheticoligonucleotide
  source 1..23: mol_type = other DNA
tgggactctcatgagagtcccag

SEQ ID NO: 5369 - DNA, 23 bp, synthetic construct
  misc_feature 1..23: note = Description of Artificial Sequence: Syntheticoligonucleotide
  source 1..23: mol_type = other DNA
ctggactctcatgagagtccagg

SEQ ID NO: 5370 - DNA, 23 bp, synthetic construct
  misc_feature 1..23: note = Description of Artificial Sequence: Syntheticoligonucleotide
  source 1..23: mol_type = other DNA
cgtgactctcatgagagtcacgg

SEQ ID NO: 5371 - DNA, 23 bp, synthetic construct
  misc_feature 1..23: note = Description of Artificial Sequence: Syntheticoligonucleotide
  source 1..23: mol_type = other DNA
ggcgactctcatgagagtcgccg

SEQ ID NO: 5372 - DNA, 23 bp, synthetic construct
  misc_feature 1..23: note = Description of Artificial Sequence: Syntheticoligonucleotide
  source 1..23: mol_type = other DNA
agcgactctcatgagagtcgctg

SEQ ID NO: 5373 - DNA, 23 bp, synthetic construct
  misc_feature 1..23: note = Description of Artificial Sequence: Syntheticoligonucleotide
  source 1..23: mol_type = other DNA
gacgactctcatgagagtcgtcg

SEQ ID NO: 5374 - DNA, 23 bp, synthetic construct
  misc_feature 1..23: note = Description of Artificial Sequence: Syntheticoligonucleotide
  source 1..23: mol_type = other DNA
ggagactctcatgagagtctccg

SEQ ID NO: 5375 - DNA, 23 bp, synthetic construct
  misc_feature 1..23: note = Description of Artificial Sequence: Syntheticoligonucleotide
  source 1..23: mol_type = other DNA
tgcgactctcatgagagtcgcag

SEQ ID NO: 5376 - DNA, 23 bp, synthetic construct
  misc_feature 1..23: note = Description of Artificial Sequence: Syntheticoligonucleotide
  source 1..23: mol_type = other DNA
ggtgactctcatgagagtcaccg

SEQ ID NO: 5377 - DNA, 23 bp, synthetic construct
  misc_feature 1..23: note = Description of Artificial Sequence: Syntheticoligonucleotide
  source 1..23: mol_type = other DNA
acggactctcatgagagtccgtg

SEQ ID NO: 5378 - DNA, 23 bp, synthetic construct
  misc_feature 1..23: note = Description of Artificial Sequence: Syntheticoligonucleotide
  source 1..23: mol_type = other DNA
ccagactctcatgagagtctggg

SEQ ID NO: 5379 - DNA, 23 bp, synthetic construct
  misc_feature 1..23: note = Description of Artificial Sequence: Syntheticoligonucleotide
  source 1..23: mol_type = other DNA
tcggactctcatgagagtccgag

SEQ ID NO: 5380 - DNA, 23 bp, synthetic construct
  misc_feature 1..23: note = Description of Artificial Sequence: Syntheticoligonucleotide
  source 1..23: mol_type = other DNA
cctgactctcatgagagtcaggg

SEQ ID NO: 5381 - DNA, 23 bp, synthetic construct
  misc_feature 1..23: note = Description of Artificial Sequence: Syntheticoligonucleotide
  source 1..23: mol_type = other DNA
cacgactctcatgagagtcgtgg

SEQ ID NO: 5382 - DNA, 23 bp, synthetic construct
  misc_feature 1..23: note = Description of Artificial Sequence: Syntheticoligonucleotide
  source 1..23: mol_type = other DNA
gccgactctcatgagagtcggct

SEQ ID NO: 5383 - DNA, 23 bp, synthetic construct
  misc_feature 1..23: note = Description of Artificial Sequence: Syntheticoligonucleotide
  source 1..23: mol_type = other DNA
gccgactctcatgagagtcggca

SEQ ID NO: 5384 - DNA, 23 bp, synthetic construct
  misc_feature 1..23: note = Description of Artificial Sequence: Syntheticoligonucleotide
  source 1..23: mol_type = other DNA
cgagactctcatgagagtctcgc

SEQ ID NO: 5385 - DNA, 23 bp, synthetic construct
  misc_feature 1..23: note = Description of Artificial Sequence: Syntheticoligonucleotide
  source 1..23: mol_type = other DNA
cgtgactctcatgagagtcacgc

SEQ ID NO: 5386 - DNA, 23 bp, synthetic construct
  misc_feature 1..23: note = Description of Artificial Sequence: Syntheticoligonucleotide
  source 1..23: mol_type = other DNA
caggactctcatgagagtcctgc

SEQ ID NO: 5387 - DNA, 23 bp, synthetic construct
  misc_feature 1..23: note = Description of Artificial Sequence: Syntheticoligonucleotide
  source 1..23: mol_type = other DNA
ctggactctcatgagagtccagc

SEQ ID NO: 5388 - DNA, 23 bp, synthetic construct
  misc_feature 1..23: note = Description of Artificial Sequence: Syntheticoligonucleotide
  source 1..23: mol_type = other DNA
gaggactctcatgagagtcctcg

SEQ ID NO: 5389 - DNA, 23 bp, synthetic construct
  misc_feature 1..23: note = Description of Artificial Sequence: Syntheticoligonucleotide
  source 1..23: mol_type = other DNA
gtggactctcatgagagtccacg

SEQ ID NO: 5390 - DNA, 23 bp, synthetic construct
  misc_feature 1..23: note = Description of Artificial Sequence: Syntheticoligonucleotide
  source 1..23: mol_type = other DNA
accgactctcatgagagtcggtg

SEQ ID NO: 5391 - DNA, 23 bp, synthetic construct
  misc_feature 1..23: note = Description of Artificial Sequence: Syntheticoligonucleotide
  source 1..23: mol_type = other DNA
tccgactctcatgagagtcggag

SEQ ID NO: 5392 - DNA, 23 bp, synthetic construct
  misc_feature 1..23: note = Description of Artificial Sequence: Syntheticoligonucleotide
  source 1..23: mol_type = other DNA
cgggactctcatgagagtcccgc

SEQ ID NO: 5393 - DNA, 23 bp, synthetic construct
  misc_feature 1..23: note = Description of Artificial Sequence: Syntheticoligonucleotide
  source 1..23: mol_type = other DNA
agggactctcatgagagtccctc

SEQ ID NO: 5394 - DNA, 23 bp, synthetic construct
  misc_feature 1..23: note = Description of Artificial Sequence: Syntheticoligonucleotide
  source 1..23: mol_type = other DNA
tgggactctcatgagagtcccac

SEQ ID NO: 5395 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactctctagagagtcnnnn

SEQ ID NO: 5396 - DNA, 23 bp, synthetic construct
  misc_feature 1..23: note = Description of Artificial Sequence: Syntheticoligonucleotide
  source 1..23: mol_type = other DNA
gcggactctctagagagtccgcc

SEQ ID NO: 5397 - DNA, 23 bp, synthetic construct
  misc_feature 1..23: note = Description of Artificial Sequence: Syntheticoligonucleotide
  source 1..23: mol_type = other DNA
gcggactctctagagagtccgct

SEQ ID NO: 5398 - DNA, 23 bp, synthetic construct
  misc_feature 1..23: note = Description of Artificial Sequence: Syntheticoligonucleotide
  source 1..23: mol_type = other DNA
acggactctctagagagtccgtc

SEQ ID NO: 5399 - DNA, 23 bp, synthetic construct
  misc_feature 1..23: note = Description of Artificial Sequence: Syntheticoligonucleotide
  source 1..23: mol_type = other DNA
gaggactctctagagagtcctcc

SEQ ID NO: 5400 - DNA, 23 bp, synthetic construct
  misc_feature 1..23: note = Description of Artificial Sequence: Syntheticoligonucleotide
  source 1..23: mol_type = other DNA
gcagactctctagagagtctgcc

SEQ ID NO: 5401 - DNA, 23 bp, synthetic construct
  misc_feature 1..23: note = Description of Artificial Sequence: Syntheticoligonucleotide
  source 1..23: mol_type = other DNA
gcggactctctagagagtccgca

SEQ ID NO: 5402 - DNA, 23 bp, synthetic construct
  misc_feature 1..23: note = Description of Artificial Sequence: Syntheticoligonucleotide
  source 1..23: mol_type = other DNA
tcggactctctagagagtccgac

SEQ ID NO: 5403 - DNA, 23 bp, synthetic construct
  misc_feature 1..23: note = Description of Artificial Sequence: Syntheticoligonucleotide
  source 1..23: mol_type = other DNA
gtggactctctagagagtccacc

SEQ ID NO: 5404 - DNA, 23 bp, synthetic construct
  misc_feature 1..23: note = Description of Artificial Sequence: Syntheticoligonucleotide
  source 1..23: mol_type = other DNA
gctgactctctagagagtcagcc

SEQ ID NO: 5405 - DNA, 23 bp, synthetic construct
  misc_feature 1..23: note = Description of Artificial Sequence: Syntheticoligonucleotide
  source 1..23: mol_type = other DNA
cccgactctctagagagtcgggc

SEQ ID NO: 5406 - DNA, 23 bp, synthetic construct
  misc_feature 1..23: note = Description of Artificial Sequence: Syntheticoligonucleotide
  source 1..23: mol_type = other DNA
cccgactctctagagagtcgggt

SEQ ID NO: 5407 - DNA, 23 bp, synthetic construct
  misc_feature 1..23: note = Description of Artificial Sequence: Syntheticoligonucleotide
  source 1..23: mol_type = other DNA
accgactctctagagagtcggtc

SEQ ID NO: 5408 - DNA, 23 bp, synthetic construct
  misc_feature 1..23: note = Description of Artificial Sequence: Syntheticoligonucleotide
  source 1..23: mol_type = other DNA
cacgactctctagagagtcgtgc

SEQ ID NO: 5409 - DNA, 23 bp, synthetic construct
  misc_feature 1..23: note = Description of Artificial Sequence: Syntheticoligonucleotide
  source 1..23: mol_type = other DNA
ccagactctctagagagtctggc

SEQ ID NO: 5410 - DNA, 23 bp, synthetic construct
  misc_feature 1..23: note = Description of Artificial Sequence: Syntheticoligonucleotide
  source 1..23: mol_type = other DNA
cccgactctctagagagtcggga

SEQ ID NO: 5411 - DNA, 23 bp, synthetic construct
  misc_feature 1..23: note = Description of Artificial Sequence: Syntheticoligonucleotide
  source 1..23: mol_type = other DNA
tccgactctctagagagtcggac

SEQ ID NO: 5412 - DNA, 23 bp, synthetic construct
  misc_feature 1..23: note = Description of Artificial Sequence: Syntheticoligonucleotide
  source 1..23: mol_type = other DNA
cctgactctctagagagtcaggc

SEQ ID NO: 5413 - DNA, 23 bp, synthetic construct
  misc_feature 1..23: note = Description of Artificial Sequence: Syntheticoligonucleotide
  source 1..23: mol_type = other DNA
ggcgactctctagagagtcgccc

SEQ ID NO: 5414 - DNA, 23 bp, synthetic construct
  misc_feature 1..23: note = Description of Artificial Sequence: Syntheticoligonucleotide
  source 1..23: mol_type = other DNA
ggcgactctctagagagtcgcct

SEQ ID NO: 5415 - DNA, 23 bp, synthetic construct
  misc_feature 1..23: note = Description of Artificial Sequence: Syntheticoligonucleotide
  source 1..23: mol_type = other DNA
agcgactctctagagagtcgctc

SEQ ID NO: 5416 - DNA, 23 bp, synthetic construct
  misc_feature 1..23: note = Description of Artificial Sequence: Syntheticoligonucleotide
  source 1..23: mol_type = other DNA
gacgactctctagagagtcgtcc

SEQ ID NO: 5417 - DNA, 23 bp, synthetic construct
  misc_feature 1..23: note = Description of Artificial Sequence: Syntheticoligonucleotide
  source 1..23: mol_type = other DNA
ggagactctctagagagtctccc

SEQ ID NO: 5418 - DNA, 23 bp, synthetic construct
  misc_feature 1..23: note = Description of Artificial Sequence: Syntheticoligonucleotide
  source 1..23: mol_type = other DNA
ggcgactctctagagagtcgcca

SEQ ID NO: 5419 - DNA, 23 bp, synthetic construct
  misc_feature 1..23: note = Description of Artificial Sequence: Syntheticoligonucleotide
  source 1..23: mol_type = other DNA
tgcgactctctagagagtcgcac

SEQ ID NO: 5420 - DNA, 23 bp, synthetic construct
  misc_feature 1..23: note = Description of Artificial Sequence: Syntheticoligonucleotide
  source 1..23: mol_type = other DNA
ggtgactctctagagagtcaccc

SEQ ID NO: 5421 - DNA, 23 bp, synthetic construct
  misc_feature 1..23: note = Description of Artificial Sequence: Syntheticoligonucleotide
  source 1..23: mol_type = other DNA
cgggactctctagagagtcccgt

SEQ ID NO: 5422 - DNA, 23 bp, synthetic construct
  misc_feature 1..23: note = Description of Artificial Sequence: Syntheticoligonucleotide
  source 1..23: mol_type = other DNA
agggactctctagagagtccctg

SEQ ID NO: 5423 - DNA, 23 bp, synthetic construct
  misc_feature 1..23: note = Description of Artificial Sequence: Syntheticoligonucleotide
  source 1..23: mol_type = other DNA
caggactctctagagagtcctgg

SEQ ID NO: 5424 - DNA, 23 bp, synthetic construct
  misc_feature 1..23: note = Description of Artificial Sequence: Syntheticoligonucleotide
  source 1..23: mol_type = other DNA
cgagactctctagagagtctcgg

SEQ ID NO: 5425 - DNA, 23 bp, synthetic construct
  misc_feature 1..23: note = Description of Artificial Sequence: Syntheticoligonucleotide
  source 1..23: mol_type = other DNA
cgggactctctagagagtcccga

SEQ ID NO: 5426 - DNA, 23 bp, synthetic construct
  misc_feature 1..23: note = Description of Artificial Sequence: Syntheticoligonucleotide
  source 1..23: mol_type = other DNA
tgggactctctagagagtcccag

SEQ ID NO: 5427 - DNA, 23 bp, synthetic construct
  misc_feature 1..23: note = Description of Artificial Sequence: Syntheticoligonucleotide
  source 1..23: mol_type = other DNA
ctggactctctagagagtccagg

SEQ ID NO: 5428 - DNA, 23 bp, synthetic construct
  misc_feature 1..23: note = Description of Artificial Sequence: Syntheticoligonucleotide
  source 1..23: mol_type = other DNA
cgtgactctctagagagtcacgg

SEQ ID NO: 5429 - DNA, 23 bp, synthetic construct
  misc_feature 1..23: note = Description of Artificial Sequence: Syntheticoligonucleotide
  source 1..23: mol_type = other DNA
ggcgactctctagagagtcgccg

SEQ ID NO: 5430 - DNA, 23 bp, synthetic construct
  misc_feature 1..23: note = Description of Artificial Sequence: Syntheticoligonucleotide
  source 1..23: mol_type = other DNA
agcgactctctagagagtcgctg

SEQ ID NO: 5431 - DNA, 23 bp, synthetic construct
  misc_feature 1..23: note = Description of Artificial Sequence: Syntheticoligonucleotide
  source 1..23: mol_type = other DNA
gacgactctctagagagtcgtcg

SEQ ID NO: 5432 - DNA, 23 bp, synthetic construct
  misc_feature 1..23: note = Description of Artificial Sequence: Syntheticoligonucleotide
  source 1..23: mol_type = other DNA
ggagactctctagagagtctccg

SEQ ID NO: 5433 - DNA, 23 bp, synthetic construct
  misc_feature 1..23: note = Description of Artificial Sequence: Syntheticoligonucleotide
  source 1..23: mol_type = other DNA
tgcgactctctagagagtcgcag

SEQ ID NO: 5434 - DNA, 23 bp, synthetic construct
  misc_feature 1..23: note = Description of Artificial Sequence: Syntheticoligonucleotide
  source 1..23: mol_type = other DNA
ggtgactctctagagagtcaccg

SEQ ID NO: 5435 - DNA, 23 bp, synthetic construct
  misc_feature 1..23: note = Description of Artificial Sequence: Syntheticoligonucleotide
  source 1..23: mol_type = other DNA
acggactctctagagagtccgtg

SEQ ID NO: 5436 - DNA, 23 bp, synthetic construct
  misc_feature 1..23: note = Description of Artificial Sequence: Syntheticoligonucleotide
  source 1..23: mol_type = other DNA
ccagactctctagagagtctggg

SEQ ID NO: 5437 - DNA, 23 bp, synthetic construct
  misc_feature 1..23: note = Description of Artificial Sequence: Syntheticoligonucleotide
  source 1..23: mol_type = other DNA
tcggactctctagagagtccgag

SEQ ID NO: 5438 - DNA, 23 bp, synthetic construct
  misc_feature 1..23: note = Description of Artificial Sequence: Syntheticoligonucleotide
  source 1..23: mol_type = other DNA
cctgactctctagagagtcaggg

SEQ ID NO: 5439 - DNA, 23 bp, synthetic construct
  misc_feature 1..23: note = Description of Artificial Sequence: Syntheticoligonucleotide
  source 1..23: mol_type = other DNA
cacgactctctagagagtcgtgg

SEQ ID NO: 5440 - DNA, 23 bp, synthetic construct
  misc_feature 1..23: note = Description of Artificial Sequence: Syntheticoligonucleotide
  source 1..23: mol_type = other DNA
gccgactctctagagagtcggct

SEQ ID NO: 5441 - DNA, 23 bp, synthetic construct
  misc_feature 1..23: note = Description of Artificial Sequence: Syntheticoligonucleotide
  source 1..23: mol_type = other DNA
gccgactctctagagagtcggca

SEQ ID NO: 5442 - DNA, 23 bp, synthetic construct
  misc_feature 1..23: note = Description of Artificial Sequence: Syntheticoligonucleotide
  source 1..23: mol_type = other DNA
cgagactctctagagagtctcgc

SEQ ID NO: 5443 - DNA, 23 bp, synthetic construct
  misc_feature 1..23: note = Description of Artificial Sequence: Syntheticoligonucleotide
  source 1..23: mol_type = other DNA
cgtgactctctagagagtcacgc

SEQ ID NO: 5444 - DNA, 23 bp, synthetic construct
  misc_feature 1..23: note = Description of Artificial Sequence: Syntheticoligonucleotide
  source 1..23: mol_type = other DNA
caggactctctagagagtcctgc

SEQ ID NO: 5445 - DNA, 23 bp, synthetic construct
  misc_feature 1..23: note = Description of Artificial Sequence: Syntheticoligonucleotide
  source 1..23: mol_type = other DNA
ctggactctctagagagtccagc

SEQ ID NO: 5446 - DNA, 23 bp, synthetic construct
  misc_feature 1..23: note = Description of Artificial Sequence: Syntheticoligonucleotide
  source 1..23: mol_type = other DNA
gaggactctctagagagtcctcg

SEQ ID NO: 5447 - DNA, 23 bp, synthetic construct
  misc_feature 1..23: note = Description of Artificial Sequence: Syntheticoligonucleotide
  source 1..23: mol_type = other DNA
gtggactctctagagagtccacg

SEQ ID NO: 5448 - DNA, 23 bp, synthetic construct
  misc_feature 1..23: note = Description of Artificial Sequence: Syntheticoligonucleotide
  source 1..23: mol_type = other DNA
accgactctctagagagtcggtg

SEQ ID NO: 5449 - DNA, 23 bp, synthetic construct
  misc_feature 1..23: note = Description of Artificial Sequence: Syntheticoligonucleotide
  source 1..23: mol_type = other DNA
tccgactctctagagagtcggag

SEQ ID NO: 5450 - DNA, 23 bp, synthetic construct
  misc_feature 1..23: note = Description of Artificial Sequence: Syntheticoligonucleotide
  source 1..23: mol_type = other DNA
cgggactctctagagagtcccgc

SEQ ID NO: 5451 - DNA, 23 bp, synthetic construct
  misc_feature 1..23: note = Description of Artificial Sequence: Syntheticoligonucleotide
  source 1..23: mol_type = other DNA
agggactctctagagagtccctc

SEQ ID NO: 5452 - DNA, 23 bp, synthetic construct
  misc_feature 1..23: note = Description of Artificial Sequence: Syntheticoligonucleotide
  source 1..23: mol_type = other DNA
tgggactctctagagagtcccac

SEQ ID NO: 5453 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactctcgcgagagtcnnnn

SEQ ID NO: 5454 - DNA, 23 bp, synthetic construct
  misc_feature 1..23: note = Description of Artificial Sequence: Syntheticoligonucleotide
  source 1..23: mol_type = other DNA
gcggactctcgcgagagtccgcc

SEQ ID NO: 5455 - DNA, 23 bp, synthetic construct
  misc_feature 1..23: note = Description of Artificial Sequence: Syntheticoligonucleotide
  source 1..23: mol_type = other DNA
gcggactctcgcgagagtccgct

SEQ ID NO: 5456 - DNA, 23 bp, synthetic construct
  misc_feature 1..23: note = Description of Artificial Sequence: Syntheticoligonucleotide
  source 1..23: mol_type = other DNA
acggactctcgcgagagtccgtc

SEQ ID NO: 5457 - DNA, 23 bp, synthetic construct
  misc_feature 1..23: note = Description of Artificial Sequence: Syntheticoligonucleotide
  source 1..23: mol_type = other DNA
gaggactctcgcgagagtcctcc

SEQ ID NO: 5458 - DNA, 23 bp, synthetic construct
  misc_feature 1..23: note = Description of Artificial Sequence: Syntheticoligonucleotide
  source 1..23: mol_type = other DNA
gcagactctcgcgagagtctgcc

SEQ ID NO: 5459 - DNA, 23 bp, synthetic construct
  misc_feature 1..23: note = Description of Artificial Sequence: Syntheticoligonucleotide
  source 1..23: mol_type = other DNA
gcggactctcgcgagagtccgca

SEQ ID NO: 5460 - DNA, 23 bp, synthetic construct
  misc_feature 1..23: note = Description of Artificial Sequence: Syntheticoligonucleotide
  source 1..23: mol_type = other DNA
tcggactctcgcgagagtccgac

SEQ ID NO: 5461 - DNA, 23 bp, synthetic construct
  misc_feature 1..23: note = Description of Artificial Sequence: Syntheticoligonucleotide
  source 1..23: mol_type = other DNA
gtggactctcgcgagagtccacc

SEQ ID NO: 5462 - DNA, 23 bp, synthetic construct
  misc_feature 1..23: note = Description of Artificial Sequence: Syntheticoligonucleotide
  source 1..23: mol_type = other DNA
gctgactctcgcgagagtcagcc

SEQ ID NO: 5463 - DNA, 23 bp, synthetic construct
  misc_feature 1..23: note = Description of Artificial Sequence: Syntheticoligonucleotide
  source 1..23: mol_type = other DNA
cccgactctcgcgagagtcgggc

SEQ ID NO: 5464 - DNA, 23 bp, synthetic construct
  misc_feature 1..23: note = Description of Artificial Sequence: Syntheticoligonucleotide
  source 1..23: mol_type = other DNA
cccgactctcgcgagagtcgggt

SEQ ID NO: 5465 - DNA, 23 bp, synthetic construct
  misc_feature 1..23: note = Description of Artificial Sequence: Syntheticoligonucleotide
  source 1..23: mol_type = other DNA
accgactctcgcgagagtcggtc

SEQ ID NO: 5466 - DNA, 23 bp, synthetic construct
  misc_feature 1..23: note = Description of Artificial Sequence: Syntheticoligonucleotide
  source 1..23: mol_type = other DNA
cacgactctcgcgagagtcgtgc

SEQ ID NO: 5467 - DNA, 23 bp, synthetic construct
  misc_feature 1..23: note = Description of Artificial Sequence: Syntheticoligonucleotide
  source 1..23: mol_type = other DNA
ccagactctcgcgagagtctggc

SEQ ID NO: 5468 - DNA, 23 bp, synthetic construct
  misc_feature 1..23: note = Description of Artificial Sequence: Syntheticoligonucleotide
  source 1..23: mol_type = other DNA
cccgactctcgcgagagtcggga

SEQ ID NO: 5469 - DNA, 23 bp, synthetic construct
  misc_feature 1..23: note = Description of Artificial Sequence: Syntheticoligonucleotide
  source 1..23: mol_type = other DNA
tccgactctcgcgagagtcggac

SEQ ID NO: 5470 - DNA, 23 bp, synthetic construct
  misc_feature 1..23: note = Description of Artificial Sequence: Syntheticoligonucleotide
  source 1..23: mol_type = other DNA
cctgactctcgcgagagtcaggc

SEQ ID NO: 5471 - DNA, 23 bp, synthetic construct
  misc_feature 1..23: note = Description of Artificial Sequence: Syntheticoligonucleotide
  source 1..23: mol_type = other DNA
ggcgactctcgcgagagtcgccc

SEQ ID NO: 5472 - DNA, 23 bp, synthetic construct
  misc_feature 1..23: note = Description of Artificial Sequence: Syntheticoligonucleotide
  source 1..23: mol_type = other DNA
ggcgactctcgcgagagtcgcct

SEQ ID NO: 5473 - DNA, 23 bp, synthetic construct
  misc_feature 1..23: note = Description of Artificial Sequence: Syntheticoligonucleotide
  source 1..23: mol_type = other DNA
agcgactctcgcgagagtcgctc

SEQ ID NO: 5474 - DNA, 23 bp, synthetic construct
  misc_feature 1..23: note = Description of Artificial Sequence: Syntheticoligonucleotide
  source 1..23: mol_type = other DNA
gacgactctcgcgagagtcgtcc

SEQ ID NO: 5475 - DNA, 23 bp, synthetic construct
  misc_feature 1..23: note = Description of Artificial Sequence: Syntheticoligonucleotide
  source 1..23: mol_type = other DNA
ggagactctcgcgagagtctccc

SEQ ID NO: 5476 - DNA, 23 bp, synthetic construct
  misc_feature 1..23: note = Description of Artificial Sequence: Syntheticoligonucleotide
  source 1..23: mol_type = other DNA
ggcgactctcgcgagagtcgcca

SEQ ID NO: 5477 - DNA, 23 bp, synthetic construct
  misc_feature 1..23: note = Description of Artificial Sequence: Syntheticoligonucleotide
  source 1..23: mol_type = other DNA
tgcgactctcgcgagagtcgcac

SEQ ID NO: 5478 - DNA, 23 bp, synthetic construct
  misc_feature 1..23: note = Description of Artificial Sequence: Syntheticoligonucleotide
  source 1..23: mol_type = other DNA
ggtgactctcgcgagagtcaccc

SEQ ID NO: 5479 - DNA, 23 bp, synthetic construct
  misc_feature 1..23: note = Description of Artificial Sequence: Syntheticoligonucleotide
  source 1..23: mol_type = other DNA
cgggactctcgcgagagtcccgt

SEQ ID NO: 5480 - DNA, 23 bp, synthetic construct
  misc_feature 1..23: note = Description of Artificial Sequence: Syntheticoligonucleotide
  source 1..23: mol_type = other DNA
agggactctcgcgagagtccctg

SEQ ID NO: 5481 - DNA, 23 bp, synthetic construct
  misc_feature 1..23: note = Description of Artificial Sequence: Syntheticoligonucleotide
  source 1..23: mol_type = other DNA
caggactctcgcgagagtcctgg

SEQ ID NO: 5482 - DNA, 23 bp, synthetic construct
  misc_feature 1..23: note = Description of Artificial Sequence: Syntheticoligonucleotide
  source 1..23: mol_type = other DNA
cgagactctcgcgagagtctcgg

SEQ ID NO: 5483 - DNA, 23 bp, synthetic construct
  misc_feature 1..23: note = Description of Artificial Sequence: Syntheticoligonucleotide
  source 1..23: mol_type = other DNA
cgggactctcgcgagagtcccga

SEQ ID NO: 5484 - DNA, 23 bp, synthetic construct
  misc_feature 1..23: note = Description of Artificial Sequence: Syntheticoligonucleotide
  source 1..23: mol_type = other DNA
tgggactctcgcgagagtcccag

SEQ ID NO: 5485 - DNA, 23 bp, synthetic construct
  misc_feature 1..23: note = Description of Artificial Sequence: Syntheticoligonucleotide
  source 1..23: mol_type = other DNA
ctggactctcgcgagagtccagg

SEQ ID NO: 5486 - DNA, 23 bp, synthetic construct
  misc_feature 1..23: note = Description of Artificial Sequence: Syntheticoligonucleotide
  source 1..23: mol_type = other DNA
cgtgactctcgcgagagtcacgg

SEQ ID NO: 5487 - DNA, 23 bp, synthetic construct
  misc_feature 1..23: note = Description of Artificial Sequence: Syntheticoligonucleotide
  source 1..23: mol_type = other DNA
ggcgactctcgcgagagtcgccg

SEQ ID NO: 5488 - DNA, 23 bp, synthetic construct
  misc_feature 1..23: note = Description of Artificial Sequence: Syntheticoligonucleotide
  source 1..23: mol_type = other DNA
agcgactctcgcgagagtcgctg

SEQ ID NO: 5489 - DNA, 23 bp, synthetic construct
  misc_feature 1..23: note = Description of Artificial Sequence: Syntheticoligonucleotide
  source 1..23: mol_type = other DNA
gacgactctcgcgagagtcgtcg

SEQ ID NO: 5490 - DNA, 23 bp, synthetic construct
  misc_feature 1..23: note = Description of Artificial Sequence: Syntheticoligonucleotide
  source 1..23: mol_type = other DNA
ggagactctcgcgagagtctccg

SEQ ID NO: 5491 - DNA, 23 bp, synthetic construct
  misc_feature 1..23: note = Description of Artificial Sequence: Syntheticoligonucleotide
  source 1..23: mol_type = other DNA
tgcgactctcgcgagagtcgcag

SEQ ID NO: 5492 - DNA, 23 bp, synthetic construct
  misc_feature 1..23: note = Description of Artificial Sequence: Syntheticoligonucleotide
  source 1..23: mol_type = other DNA
ggtgactctcgcgagagtcaccg

SEQ ID NO: 5493 - DNA, 23 bp, synthetic construct
  misc_feature 1..23: note = Description of Artificial Sequence: Syntheticoligonucleotide
  source 1..23: mol_type = other DNA
acggactctcgcgagagtccgtg

SEQ ID NO: 5494 - DNA, 23 bp, synthetic construct
  misc_feature 1..23: note = Description of Artificial Sequence: Syntheticoligonucleotide
  source 1..23: mol_type = other DNA
ccagactctcgcgagagtctggg

SEQ ID NO: 5495 - DNA, 23 bp, synthetic construct
  misc_feature 1..23: note = Description of Artificial Sequence: Syntheticoligonucleotide
  source 1..23: mol_type = other DNA
tcggactctcgcgagagtccgag

SEQ ID NO: 5496 - DNA, 23 bp, synthetic construct
  misc_feature 1..23: note = Description of Artificial Sequence: Syntheticoligonucleotide
  source 1..23: mol_type = other DNA
cctgactctcgcgagagtcaggg

SEQ ID NO: 5497 - DNA, 23 bp, synthetic construct
  misc_feature 1..23: note = Description of Artificial Sequence: Syntheticoligonucleotide
  source 1..23: mol_type = other DNA
cacgactctcgcgagagtcgtgg

SEQ ID NO: 5498 - DNA, 23 bp, synthetic construct
  misc_feature 1..23: note = Description of Artificial Sequence: Syntheticoligonucleotide
  source 1..23: mol_type = other DNA
gccgactctcgcgagagtcggct

SEQ ID NO: 5499 - DNA, 23 bp, synthetic construct
  misc_feature 1..23: note = Description of Artificial Sequence: Syntheticoligonucleotide
  source 1..23: mol_type = other DNA
gccgactctcgcgagagtcggca

SEQ ID NO: 5500 - DNA, 23 bp, synthetic construct
  misc_feature 1..23: note = Description of Artificial Sequence: Syntheticoligonucleotide
  source 1..23: mol_type = other DNA
cgagactctcgcgagagtctcgc

SEQ ID NO: 5501 - DNA, 23 bp, synthetic construct
  misc_feature 1..23: note = Description of Artificial Sequence: Syntheticoligonucleotide
  source 1..23: mol_type = other DNA
cgtgactctcgcgagagtcacgc

SEQ ID NO: 5502 - DNA, 23 bp, synthetic construct
  misc_feature 1..23: note = Description of Artificial Sequence: Syntheticoligonucleotide
  source 1..23: mol_type = other DNA
caggactctcgcgagagtcctgc

SEQ ID NO: 5503 - DNA, 23 bp, synthetic construct
  misc_feature 1..23: note = Description of Artificial Sequence: Syntheticoligonucleotide
  source 1..23: mol_type = other DNA
ctggactctcgcgagagtccagc

SEQ ID NO: 5504 - DNA, 23 bp, synthetic construct
  misc_feature 1..23: note = Description of Artificial Sequence: Syntheticoligonucleotide
  source 1..23: mol_type = other DNA
gaggactctcgcgagagtcctcg

SEQ ID NO: 5505 - DNA, 23 bp, synthetic construct
  misc_feature 1..23: note = Description of Artificial Sequence: Syntheticoligonucleotide
  source 1..23: mol_type = other DNA
gtggactctcgcgagagtccacg

SEQ ID NO: 5506 - DNA, 23 bp, synthetic construct
  misc_feature 1..23: note = Description of Artificial Sequence: Syntheticoligonucleotide
  source 1..23: mol_type = other DNA
accgactctcgcgagagtcggtg

SEQ ID NO: 5507 - DNA, 23 bp, synthetic construct
  misc_feature 1..23: note = Description of Artificial Sequence: Syntheticoligonucleotide
  source 1..23: mol_type = other DNA
tccgactctcgcgagagtcggag

SEQ ID NO: 5508 - DNA, 23 bp, synthetic construct
  misc_feature 1..23: note = Description of Artificial Sequence: Syntheticoligonucleotide
  source 1..23: mol_type = other DNA
cgggactctcgcgagagtcccgc

SEQ ID NO: 5509 - DNA, 23 bp, synthetic construct
  misc_feature 1..23: note = Description of Artificial Sequence: Syntheticoligonucleotide
  source 1..23: mol_type = other DNA
agggactctcgcgagagtccctc

SEQ ID NO: 5510 - DNA, 23 bp, synthetic construct
  misc_feature 1..23: note = Description of Artificial Sequence: Syntheticoligonucleotide
  source 1..23: mol_type = other DNA
tgggactctcgcgagagtcccac

SEQ ID NO: 5511 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactctccggagagtcnnnn

SEQ ID NO: 5512 - DNA, 23 bp, synthetic construct
  misc_feature 1..23: note = Description of Artificial Sequence: Syntheticoligonucleotide
  source 1..23: mol_type = other DNA
gcggactctccggagagtccgcc

SEQ ID NO: 5513 - DNA, 23 bp, synthetic construct
  misc_feature 1..23: note = Description of Artificial Sequence: Syntheticoligonucleotide
  source 1..23: mol_type = other DNA
gcggactctccggagagtccgct

SEQ ID NO: 5514 - DNA, 23 bp, synthetic construct
  misc_feature 1..23: note = Description of Artificial Sequence: Syntheticoligonucleotide
  source 1..23: mol_type = other DNA
acggactctccggagagtccgtc

SEQ ID NO: 5515 - DNA, 23 bp, synthetic construct
  misc_feature 1..23: note = Description of Artificial Sequence: Syntheticoligonucleotide
  source 1..23: mol_type = other DNA
gaggactctccggagagtcctcc

SEQ ID NO: 5516 - DNA, 23 bp, synthetic construct
  misc_feature 1..23: note = Description of Artificial Sequence: Syntheticoligonucleotide
  source 1..23: mol_type = other DNA
gcagactctccggagagtctgcc

SEQ ID NO: 5517 - DNA, 23 bp, synthetic construct
  misc_feature 1..23: note = Description of Artificial Sequence: Syntheticoligonucleotide
  source 1..23: mol_type = other DNA
gcggactctccggagagtccgca

SEQ ID NO: 5518 - DNA, 23 bp, synthetic construct
  misc_feature 1..23: note = Description of Artificial Sequence: Syntheticoligonucleotide
  source 1..23: mol_type = other DNA
tcggactctccggagagtccgac

SEQ ID NO: 5519 - DNA, 23 bp, synthetic construct
  misc_feature 1..23: note = Description of Artificial Sequence: Syntheticoligonucleotide
  source 1..23: mol_type = other DNA
gtggactctccggagagtccacc

SEQ ID NO: 5520 - DNA, 23 bp, synthetic construct
  misc_feature 1..23: note = Description of Artificial Sequence: Syntheticoligonucleotide
  source 1..23: mol_type = other DNA
gctgactctccggagagtcagcc

SEQ ID NO: 5521 - DNA, 23 bp, synthetic construct
  misc_feature 1..23: note = Description of Artificial Sequence: Syntheticoligonucleotide
  source 1..23: mol_type = other DNA
cccgactctccggagagtcgggc

SEQ ID NO: 5522 - DNA, 23 bp, synthetic construct
  misc_feature 1..23: note = Description of Artificial Sequence: Syntheticoligonucleotide
  source 1..23: mol_type = other DNA
cccgactctccggagagtcgggt

SEQ ID NO: 5523 - DNA, 23 bp, synthetic construct
  misc_feature 1..23: note = Description of Artificial Sequence: Syntheticoligonucleotide
  source 1..23: mol_type = other DNA
accgactctccggagagtcggtc

SEQ ID NO: 5524 - DNA, 23 bp, synthetic construct
  misc_feature 1..23: note = Description of Artificial Sequence: Syntheticoligonucleotide
  source 1..23: mol_type = other DNA
cacgactctccggagagtcgtgc

SEQ ID NO: 5525 - DNA, 23 bp, synthetic construct
  misc_feature 1..23: note = Description of Artificial Sequence: Syntheticoligonucleotide
  source 1..23: mol_type = other DNA
ccagactctccggagagtctggc

SEQ ID NO: 5526 - DNA, 23 bp, synthetic construct
  misc_feature 1..23: note = Description of Artificial Sequence: Syntheticoligonucleotide
  source 1..23: mol_type = other DNA
cccgactctccggagagtcggga

SEQ ID NO: 5527 - DNA, 23 bp, synthetic construct
  misc_feature 1..23: note = Description of Artificial Sequence: Syntheticoligonucleotide
  source 1..23: mol_type = other DNA
tccgactctccggagagtcggac

SEQ ID NO: 5528 - DNA, 23 bp, synthetic construct
  misc_feature 1..23: note = Description of Artificial Sequence: Syntheticoligonucleotide
  source 1..23: mol_type = other DNA
cctgactctccggagagtcaggc

SEQ ID NO: 5529 - DNA, 23 bp, synthetic construct
  misc_feature 1..23: note = Description of Artificial Sequence: Syntheticoligonucleotide
  source 1..23: mol_type = other DNA
ggcgactctccggagagtcgccc

SEQ ID NO: 5530 - DNA, 23 bp, synthetic construct
  misc_feature 1..23: note = Description of Artificial Sequence: Syntheticoligonucleotide
  source 1..23: mol_type = other DNA
ggcgactctccggagagtcgcct

SEQ ID NO: 5531 - DNA, 23 bp, synthetic construct
  misc_feature 1..23: note = Description of Artificial Sequence: Syntheticoligonucleotide
  source 1..23: mol_type = other DNA
agcgactctccggagagtcgctc

SEQ ID NO: 5532 - DNA, 23 bp, synthetic construct
  misc_feature 1..23: note = Description of Artificial Sequence: Syntheticoligonucleotide
  source 1..23: mol_type = other DNA
gacgactctccggagagtcgtcc

SEQ ID NO: 5533 - DNA, 23 bp, synthetic construct
  misc_feature 1..23: note = Description of Artificial Sequence: Syntheticoligonucleotide
  source 1..23: mol_type = other DNA
ggagactctccggagagtctccc

SEQ ID NO: 5534 - DNA, 23 bp, synthetic construct
  misc_feature 1..23: note = Description of Artificial Sequence: Syntheticoligonucleotide
  source 1..23: mol_type = other DNA
ggcgactctccggagagtcgcca

SEQ ID NO: 5535 - DNA, 23 bp, synthetic construct
  misc_feature 1..23: note = Description of Artificial Sequence: Syntheticoligonucleotide
  source 1..23: mol_type = other DNA
tgcgactctccggagagtcgcac

SEQ ID NO: 5536 - DNA, 23 bp, synthetic construct
  misc_feature 1..23: note = Description of Artificial Sequence: Syntheticoligonucleotide
  source 1..23: mol_type = other DNA
ggtgactctccggagagtcaccc

SEQ ID NO: 5537 - DNA, 23 bp, synthetic construct
  misc_feature 1..23: note = Description of Artificial Sequence: Syntheticoligonucleotide
  source 1..23: mol_type = other DNA
cgggactctccggagagtcccgt

SEQ ID NO: 5538 - DNA, 23 bp, synthetic construct
  misc_feature 1..23: note = Description of Artificial Sequence: Syntheticoligonucleotide
  source 1..23: mol_type = other DNA
agggactctccggagagtccctg

SEQ ID NO: 5539 - DNA, 23 bp, synthetic construct
  misc_feature 1..23: note = Description of Artificial Sequence: Syntheticoligonucleotide
  source 1..23: mol_type = other DNA
caggactctccggagagtcctgg

SEQ ID NO: 5540 - DNA, 23 bp, synthetic construct
  misc_feature 1..23: note = Description of Artificial Sequence: Syntheticoligonucleotide
  source 1..23: mol_type = other DNA
cgagactctccggagagtctcgg

SEQ ID NO: 5541 - DNA, 23 bp, synthetic construct
  misc_feature 1..23: note = Description of Artificial Sequence: Syntheticoligonucleotide
  source 1..23: mol_type = other DNA
cgggactctccggagagtcccga

SEQ ID NO: 5542 - DNA, 23 bp, synthetic construct
  misc_feature 1..23: note = Description of Artificial Sequence: Syntheticoligonucleotide
  source 1..23: mol_type = other DNA
tgggactctccggagagtcccag

SEQ ID NO: 5543 - DNA, 23 bp, synthetic construct
  misc_feature 1..23: note = Description of Artificial Sequence: Syntheticoligonucleotide
  source 1..23: mol_type = other DNA
ctggactctccggagagtccagg

SEQ ID NO: 5544 - DNA, 23 bp, synthetic construct
  misc_feature 1..23: note = Description of Artificial Sequence: Syntheticoligonucleotide
  source 1..23: mol_type = other DNA
cgtgactctccggagagtcacgg

SEQ ID NO: 5545 - DNA, 23 bp, synthetic construct
  misc_feature 1..23: note = Description of Artificial Sequence: Syntheticoligonucleotide
  source 1..23: mol_type = other DNA
ggcgactctccggagagtcgccg

SEQ ID NO: 5546 - DNA, 23 bp, synthetic construct
  misc_feature 1..23: note = Description of Artificial Sequence: Syntheticoligonucleotide
  source 1..23: mol_type = other DNA
agcgactctccggagagtcgctg

SEQ ID NO: 5547 - DNA, 23 bp, synthetic construct
  misc_feature 1..23: note = Description of Artificial Sequence: Syntheticoligonucleotide
  source 1..23: mol_type = other DNA
gacgactctccggagagtcgtcg

SEQ ID NO: 5548 - DNA, 23 bp, synthetic construct
  misc_feature 1..23: note = Description of Artificial Sequence: Syntheticoligonucleotide
  source 1..23: mol_type = other DNA
ggagactctccggagagtctccg

SEQ ID NO: 5549 - DNA, 23 bp, synthetic construct
  misc_feature 1..23: note = Description of Artificial Sequence: Syntheticoligonucleotide
  source 1..23: mol_type = other DNA
tgcgactctccggagagtcgcag

SEQ ID NO: 5550 - DNA, 23 bp, synthetic construct
  misc_feature 1..23: note = Description of Artificial Sequence: Syntheticoligonucleotide
  source 1..23: mol_type = other DNA
ggtgactctccggagagtcaccg

SEQ ID NO: 5551 - DNA, 23 bp, synthetic construct
  misc_feature 1..23: note = Description of Artificial Sequence: Syntheticoligonucleotide
  source 1..23: mol_type = other DNA
acggactctccggagagtccgtg

SEQ ID NO: 5552 - DNA, 23 bp, synthetic construct
  misc_feature 1..23: note = Description of Artificial Sequence: Syntheticoligonucleotide
  source 1..23: mol_type = other DNA
ccagactctccggagagtctggg

SEQ ID NO: 5553 - DNA, 23 bp, synthetic construct
  misc_feature 1..23: note = Description of Artificial Sequence: Syntheticoligonucleotide
  source 1..23: mol_type = other DNA
tcggactctccggagagtccgag

SEQ ID NO: 5554 - DNA, 23 bp, synthetic construct
  misc_feature 1..23: note = Description of Artificial Sequence: Syntheticoligonucleotide
  source 1..23: mol_type = other DNA
cctgactctccggagagtcaggg

SEQ ID NO: 5555 - DNA, 23 bp, synthetic construct
  misc_feature 1..23: note = Description of Artificial Sequence: Syntheticoligonucleotide
  source 1..23: mol_type = other DNA
cacgactctccggagagtcgtgg

SEQ ID NO: 5556 - DNA, 23 bp, synthetic construct
  misc_feature 1..23: note = Description of Artificial Sequence: Syntheticoligonucleotide
  source 1..23: mol_type = other DNA
gccgactctccggagagtcggct

SEQ ID NO: 5557 - DNA, 23 bp, synthetic construct
  misc_feature 1..23: note = Description of Artificial Sequence: Syntheticoligonucleotide
  source 1..23: mol_type = other DNA
gccgactctccggagagtcggca

SEQ ID NO: 5558 - DNA, 23 bp, synthetic construct
  misc_feature 1..23: note = Description of Artificial Sequence: Syntheticoligonucleotide
  source 1..23: mol_type = other DNA
cgagactctccggagagtctcgc

SEQ ID NO: 5559 - DNA, 23 bp, synthetic construct
  misc_feature 1..23: note = Description of Artificial Sequence: Syntheticoligonucleotide
  source 1..23: mol_type = other DNA
cgtgactctccggagagtcacgc

SEQ ID NO: 5560 - DNA, 23 bp, synthetic construct
  misc_feature 1..23: note = Description of Artificial Sequence: Syntheticoligonucleotide
  source 1..23: mol_type = other DNA
caggactctccggagagtcctgc

SEQ ID NO: 5561 - DNA, 23 bp, synthetic construct
  misc_feature 1..23: note = Description of Artificial Sequence: Syntheticoligonucleotide
  source 1..23: mol_type = other DNA
ctggactctccggagagtccagc

SEQ ID NO: 5562 - DNA, 23 bp, synthetic construct
  misc_feature 1..23: note = Description of Artificial Sequence: Syntheticoligonucleotide
  source 1..23: mol_type = other DNA
gaggactctccggagagtcctcg

SEQ ID NO: 5563 - DNA, 23 bp, synthetic construct
  misc_feature 1..23: note = Description of Artificial Sequence: Syntheticoligonucleotide
  source 1..23: mol_type = other DNA
gtggactctccggagagtccacg

SEQ ID NO: 5564 - DNA, 23 bp, synthetic construct
  misc_feature 1..23: note = Description of Artificial Sequence: Syntheticoligonucleotide
  source 1..23: mol_type = other DNA
accgactctccggagagtcggtg

SEQ ID NO: 5565 - DNA, 23 bp, synthetic construct
  misc_feature 1..23: note = Description of Artificial Sequence: Syntheticoligonucleotide
  source 1..23: mol_type = other DNA
tccgactctccggagagtcggag

SEQ ID NO: 5566 - DNA, 23 bp, synthetic construct
  misc_feature 1..23: note = Description of Artificial Sequence: Syntheticoligonucleotide
  source 1..23: mol_type = other DNA
cgggactctccggagagtcccgc

SEQ ID NO: 5567 - DNA, 23 bp, synthetic construct
  misc_feature 1..23: note = Description of Artificial Sequence: Syntheticoligonucleotide
  source 1..23: mol_type = other DNA
agggactctccggagagtccctc

SEQ ID NO: 5568 - DNA, 23 bp, synthetic construct
  misc_feature 1..23: note = Description of Artificial Sequence: Syntheticoligonucleotide
  source 1..23: mol_type = other DNA
tgggactctccggagagtcccac

SEQ ID NO: 5569 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcagatctgagtcnnnn

SEQ ID NO: 5570 - DNA, 23 bp, synthetic construct
  misc_feature 1..23: note = Description of Artificial Sequence: Syntheticoligonucleotide
  source 1..23: mol_type = other DNA
gcggactcagatctgagtccgcc

SEQ ID NO: 5571 - DNA, 23 bp, synthetic construct
  misc_feature 1..23: note = Description of Artificial Sequence: Syntheticoligonucleotide
  source 1..23: mol_type = other DNA
gcggactcagatctgagtccgct

SEQ ID NO: 5572 - DNA, 23 bp, synthetic construct
  misc_feature 1..23: note = Description of Artificial Sequence: Syntheticoligonucleotide
  source 1..23: mol_type = other DNA
acggactcagatctgagtccgtc

SEQ ID NO: 5573 - DNA, 23 bp, synthetic construct
  misc_feature 1..23: note = Description of Artificial Sequence: Syntheticoligonucleotide
  source 1..23: mol_type = other DNA
gaggactcagatctgagtcctcc

SEQ ID NO: 5574 - DNA, 23 bp, synthetic construct
  misc_feature 1..23: note = Description of Artificial Sequence: Syntheticoligonucleotide
  source 1..23: mol_type = other DNA
gcagactcagatctgagtctgcc

SEQ ID NO: 5575 - DNA, 23 bp, synthetic construct
  misc_feature 1..23: note = Description of Artificial Sequence: Syntheticoligonucleotide
  source 1..23: mol_type = other DNA
gcggactcagatctgagtccgca

SEQ ID NO: 5576 - DNA, 23 bp, synthetic construct
  misc_feature 1..23: note = Description of Artificial Sequence: Syntheticoligonucleotide
  source 1..23: mol_type = other DNA
tcggactcagatctgagtccgac

SEQ ID NO: 5577 - DNA, 23 bp, synthetic construct
  misc_feature 1..23: note = Description of Artificial Sequence: Syntheticoligonucleotide
  source 1..23: mol_type = other DNA
gtggactcagatctgagtccacc

SEQ ID NO: 5578 - DNA, 23 bp, synthetic construct
  misc_feature 1..23: note = Description of Artificial Sequence: Syntheticoligonucleotide
  source 1..23: mol_type = other DNA
gctgactcagatctgagtcagcc

SEQ ID NO: 5579 - DNA, 23 bp, synthetic construct
  misc_feature 1..23: note = Description of Artificial Sequence: Syntheticoligonucleotide
  source 1..23: mol_type = other DNA
cccgactcagatctgagtcgggc

SEQ ID NO: 5580 - DNA, 23 bp, synthetic construct
  misc_feature 1..23: note = Description of Artificial Sequence: Syntheticoligonucleotide
  source 1..23: mol_type = other DNA
cccgactcagatctgagtcgggt

SEQ ID NO: 5581 - DNA, 23 bp, synthetic construct
  misc_feature 1..23: note = Description of Artificial Sequence: Syntheticoligonucleotide
  source 1..23: mol_type = other DNA
accgactcagatctgagtcggtc

SEQ ID NO: 5582 - DNA, 23 bp, synthetic construct
  misc_feature 1..23: note = Description of Artificial Sequence: Syntheticoligonucleotide
  source 1..23: mol_type = other DNA
cacgactcagatctgagtcgtgc

SEQ ID NO: 5583 - DNA, 23 bp, synthetic construct
  misc_feature 1..23: note = Description of Artificial Sequence: Syntheticoligonucleotide
  source 1..23: mol_type = other DNA
ccagactcagatctgagtctggc

SEQ ID NO: 5584 - DNA, 23 bp, synthetic construct
  misc_feature 1..23: note = Description of Artificial Sequence: Syntheticoligonucleotide
  source 1..23: mol_type = other DNA
cccgactcagatctgagtcggga

SEQ ID NO: 5585 - DNA, 23 bp, synthetic construct
  misc_feature 1..23: note = Description of Artificial Sequence: Syntheticoligonucleotide
  source 1..23: mol_type = other DNA
tccgactcagatctgagtcggac

SEQ ID NO: 5586 - DNA, 23 bp, synthetic construct
  misc_feature 1..23: note = Description of Artificial Sequence: Syntheticoligonucleotide
  source 1..23: mol_type = other DNA
cctgactcagatctgagtcaggc

SEQ ID NO: 5587 - DNA, 23 bp, synthetic construct
  misc_feature 1..23: note = Description of Artificial Sequence: Syntheticoligonucleotide
  source 1..23: mol_type = other DNA
ggcgactcagatctgagtcgccc

SEQ ID NO: 5588 - DNA, 23 bp, synthetic construct
  misc_feature 1..23: note = Description of Artificial Sequence: Syntheticoligonucleotide
  source 1..23: mol_type = other DNA
ggcgactcagatctgagtcgcct

SEQ ID NO: 5589 - DNA, 23 bp, synthetic construct
  misc_feature 1..23: note = Description of Artificial Sequence: Syntheticoligonucleotide
  source 1..23: mol_type = other DNA
agcgactcagatctgagtcgctc

SEQ ID NO: 5590 - DNA, 23 bp, synthetic construct
  misc_feature 1..23: note = Description of Artificial Sequence: Syntheticoligonucleotide
  source 1..23: mol_type = other DNA
gacgactcagatctgagtcgtcc

SEQ ID NO: 5591 - DNA, 23 bp, synthetic construct
  misc_feature 1..23: note = Description of Artificial Sequence: Syntheticoligonucleotide
  source 1..23: mol_type = other DNA
ggagactcagatctgagtctccc

SEQ ID NO: 5592 - DNA, 23 bp, synthetic construct
  misc_feature 1..23: note = Description of Artificial Sequence: Syntheticoligonucleotide
  source 1..23: mol_type = other DNA
ggcgactcagatctgagtcgcca

SEQ ID NO: 5593 - DNA, 23 bp, synthetic construct
  misc_feature 1..23: note = Description of Artificial Sequence: Syntheticoligonucleotide
  source 1..23: mol_type = other DNA
tgcgactcagatctgagtcgcac

SEQ ID NO: 5594 - DNA, 23 bp, synthetic construct
  misc_feature 1..23: note = Description of Artificial Sequence: Syntheticoligonucleotide
  source 1..23: mol_type = other DNA
ggtgactcagatctgagtcaccc

SEQ ID NO: 5595 - DNA, 23 bp, synthetic construct
  misc_feature 1..23: note = Description of Artificial Sequence: Syntheticoligonucleotide
  source 1..23: mol_type = other DNA
cgggactcagatctgagtcccgt

SEQ ID NO: 5596 - DNA, 23 bp, synthetic construct
  misc_feature 1..23: note = Description of Artificial Sequence: Syntheticoligonucleotide
  source 1..23: mol_type = other DNA
agggactcagatctgagtccctg

SEQ ID NO: 5597 - DNA, 23 bp, synthetic construct
  misc_feature 1..23: note = Description of Artificial Sequence: Syntheticoligonucleotide
  source 1..23: mol_type = other DNA
caggactcagatctgagtcctgg

SEQ ID NO: 5598 - DNA, 23 bp, synthetic construct
  misc_feature 1..23: note = Description of Artificial Sequence: Syntheticoligonucleotide
  source 1..23: mol_type = other DNA
cgagactcagatctgagtctcgg

SEQ ID NO: 5599 - DNA, 23 bp, synthetic construct
  misc_feature 1..23: note = Description of Artificial Sequence: Syntheticoligonucleotide
  source 1..23: mol_type = other DNA
cgggactcagatctgagtcccga

SEQ ID NO: 5600 - DNA, 23 bp, synthetic construct
  misc_feature 1..23: note = Description of Artificial Sequence: Syntheticoligonucleotide
  source 1..23: mol_type = other DNA
tgggactcagatctgagtcccag

SEQ ID NO: 5601 - DNA, 23 bp, synthetic construct
  misc_feature 1..23: note = Description of Artificial Sequence: Syntheticoligonucleotide
  source 1..23: mol_type = other DNA
ctggactcagatctgagtccagg

SEQ ID NO: 5602 - DNA, 23 bp, synthetic construct
  misc_feature 1..23: note = Description of Artificial Sequence: Syntheticoligonucleotide
  source 1..23: mol_type = other DNA
cgtgactcagatctgagtcacgg

SEQ ID NO: 5603 - DNA, 23 bp, synthetic construct
  misc_feature 1..23: note = Description of Artificial Sequence: Syntheticoligonucleotide
  source 1..23: mol_type = other DNA
ggcgactcagatctgagtcgccg

SEQ ID NO: 5604 - DNA, 23 bp, synthetic construct
  misc_feature 1..23: note = Description of Artificial Sequence: Syntheticoligonucleotide
  source 1..23: mol_type = other DNA
agcgactcagatctgagtcgctg

SEQ ID NO: 5605 - DNA, 23 bp, synthetic construct
  misc_feature 1..23: note = Description of Artificial Sequence: Syntheticoligonucleotide
  source 1..23: mol_type = other DNA
gacgactcagatctgagtcgtcg

SEQ ID NO: 5606 - DNA, 23 bp, synthetic construct
  misc_feature 1..23: note = Description of Artificial Sequence: Syntheticoligonucleotide
  source 1..23: mol_type = other DNA
ggagactcagatctgagtctccg

SEQ ID NO: 5607 - DNA, 23 bp, synthetic construct
  misc_feature 1..23: note = Description of Artificial Sequence: Syntheticoligonucleotide
  source 1..23: mol_type = other DNA
tgcgactcagatctgagtcgcag

SEQ ID NO: 5608 - DNA, 23 bp, synthetic construct
  misc_feature 1..23: note = Description of Artificial Sequence: Syntheticoligonucleotide
  source 1..23: mol_type = other DNA
ggtgactcagatctgagtcaccg

SEQ ID NO: 5609 - DNA, 23 bp, synthetic construct
  misc_feature 1..23: note = Description of Artificial Sequence: Syntheticoligonucleotide
  source 1..23: mol_type = other DNA
acggactcagatctgagtccgtg

SEQ ID NO: 5610 - DNA, 23 bp, synthetic construct
  misc_feature 1..23: note = Description of Artificial Sequence: Syntheticoligonucleotide
  source 1..23: mol_type = other DNA
ccagactcagatctgagtctggg

SEQ ID NO: 5611 - DNA, 23 bp, synthetic construct
  misc_feature 1..23: note = Description of Artificial Sequence: Syntheticoligonucleotide
  source 1..23: mol_type = other DNA
tcggactcagatctgagtccgag

SEQ ID NO: 5612 - DNA, 23 bp, synthetic construct
  misc_feature 1..23: note = Description of Artificial Sequence: Syntheticoligonucleotide
  source 1..23: mol_type = other DNA
cctgactcagatctgagtcaggg

SEQ ID NO: 5613 - DNA, 23 bp, synthetic construct
  misc_feature 1..23: note = Description of Artificial Sequence: Syntheticoligonucleotide
  source 1..23: mol_type = other DNA
cacgactcagatctgagtcgtgg

SEQ ID NO: 5614 - DNA, 23 bp, synthetic construct
  misc_feature 1..23: note = Description of Artificial Sequence: Syntheticoligonucleotide
  source 1..23: mol_type = other DNA
gccgactcagatctgagtcggct

SEQ ID NO: 5615 - DNA, 23 bp, synthetic construct
  misc_feature 1..23: note = Description of Artificial Sequence: Syntheticoligonucleotide
  source 1..23: mol_type = other DNA
gccgactcagatctgagtcggca

SEQ ID NO: 5616 - DNA, 23 bp, synthetic construct
  misc_feature 1..23: note = Description of Artificial Sequence: Syntheticoligonucleotide
  source 1..23: mol_type = other DNA
cgagactcagatctgagtctcgc

SEQ ID NO: 5617 - DNA, 23 bp, synthetic construct
  misc_feature 1..23: note = Description of Artificial Sequence: Syntheticoligonucleotide
  source 1..23: mol_type = other DNA
cgtgactcagatctgagtcacgc

SEQ ID NO: 5618 - DNA, 23 bp, synthetic construct
  misc_feature 1..23: note = Description of Artificial Sequence: Syntheticoligonucleotide
  source 1..23: mol_type = other DNA
caggactcagatctgagtcctgc

SEQ ID NO: 5619 - DNA, 23 bp, synthetic construct
  misc_feature 1..23: note = Description of Artificial Sequence: Syntheticoligonucleotide
  source 1..23: mol_type = other DNA
ctggactcagatctgagtccagc

SEQ ID NO: 5620 - DNA, 23 bp, synthetic construct
  misc_feature 1..23: note = Description of Artificial Sequence: Syntheticoligonucleotide
  source 1..23: mol_type = other DNA
gaggactcagatctgagtcctcg

SEQ ID NO: 5621 - DNA, 23 bp, synthetic construct
  misc_feature 1..23: note = Description of Artificial Sequence: Syntheticoligonucleotide
  source 1..23: mol_type = other DNA
gtggactcagatctgagtccacg

SEQ ID NO: 5622 - DNA, 23 bp, synthetic construct
  misc_feature 1..23: note = Description of Artificial Sequence: Syntheticoligonucleotide
  source 1..23: mol_type = other DNA
accgactcagatctgagtcggtg

SEQ ID NO: 5623 - DNA, 23 bp, synthetic construct
  misc_feature 1..23: note = Description of Artificial Sequence: Syntheticoligonucleotide
  source 1..23: mol_type = other DNA
tccgactcagatctgagtcggag

SEQ ID NO: 5624 - DNA, 23 bp, synthetic construct
  misc_feature 1..23: note = Description of Artificial Sequence: Syntheticoligonucleotide
  source 1..23: mol_type = other DNA
cgggactcagatctgagtcccgc

SEQ ID NO: 5625 - DNA, 23 bp, synthetic construct
  misc_feature 1..23: note = Description of Artificial Sequence: Syntheticoligonucleotide
  source 1..23: mol_type = other DNA
agggactcagatctgagtccctc

SEQ ID NO: 5626 - DNA, 23 bp, synthetic construct
  misc_feature 1..23: note = Description of Artificial Sequence: Syntheticoligonucleotide
  source 1..23: mol_type = other DNA
tgggactcagatctgagtcccac

SEQ ID NO: 5627 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcagtactgagtcnnnn

SEQ ID NO: 5628 - DNA, 23 bp, synthetic construct
  misc_feature 1..23: note = Description of Artificial Sequence: Syntheticoligonucleotide
  source 1..23: mol_type = other DNA
gcggactcagtactgagtccgcc

SEQ ID NO: 5629 - DNA, 23 bp, synthetic construct
  misc_feature 1..23: note = Description of Artificial Sequence: Syntheticoligonucleotide
  source 1..23: mol_type = other DNA
gcggactcagtactgagtccgct

SEQ ID NO: 5630 - DNA, 23 bp, synthetic construct
  misc_feature 1..23: note = Description of Artificial Sequence: Syntheticoligonucleotide
  source 1..23: mol_type = other DNA
acggactcagtactgagtccgtc

SEQ ID NO: 5631 - DNA, 23 bp, synthetic construct
  misc_feature 1..23: note = Description of Artificial Sequence: Syntheticoligonucleotide
  source 1..23: mol_type = other DNA
gaggactcagtactgagtcctcc

SEQ ID NO: 5632 - DNA, 23 bp, synthetic construct
  misc_feature 1..23: note = Description of Artificial Sequence: Syntheticoligonucleotide
  source 1..23: mol_type = other DNA
gcagactcagtactgagtctgcc

SEQ ID NO: 5633 - DNA, 23 bp, synthetic construct
  misc_feature 1..23: note = Description of Artificial Sequence: Syntheticoligonucleotide
  source 1..23: mol_type = other DNA
gcggactcagtactgagtccgca

SEQ ID NO: 5634 - DNA, 23 bp, synthetic construct
  misc_feature 1..23: note = Description of Artificial Sequence: Syntheticoligonucleotide
  source 1..23: mol_type = other DNA
tcggactcagtactgagtccgac

SEQ ID NO: 5635 - DNA, 23 bp, synthetic construct
  misc_feature 1..23: note = Description of Artificial Sequence: Syntheticoligonucleotide
  source 1..23: mol_type = other DNA
gtggactcagtactgagtccacc

SEQ ID NO: 5636 - DNA, 23 bp, synthetic construct
  misc_feature 1..23: note = Description of Artificial Sequence: Syntheticoligonucleotide
  source 1..23: mol_type = other DNA
gctgactcagtactgagtcagcc

SEQ ID NO: 5637 - DNA, 23 bp, synthetic construct
  misc_feature 1..23: note = Description of Artificial Sequence: Syntheticoligonucleotide
  source 1..23: mol_type = other DNA
cccgactcagtactgagtcgggc

SEQ ID NO: 5638 - DNA, 23 bp, synthetic construct
  misc_feature 1..23: note = Description of Artificial Sequence: Syntheticoligonucleotide
  source 1..23: mol_type = other DNA
cccgactcagtactgagtcgggt

SEQ ID NO: 5639 - DNA, 23 bp, synthetic construct
  misc_feature 1..23: note = Description of Artificial Sequence: Syntheticoligonucleotide
  source 1..23: mol_type = other DNA
accgactcagtactgagtcggtc

SEQ ID NO: 5640 - DNA, 23 bp, synthetic construct
  misc_feature 1..23: note = Description of Artificial Sequence: Syntheticoligonucleotide
  source 1..23: mol_type = other DNA
cacgactcagtactgagtcgtgc

SEQ ID NO: 5641 - DNA, 23 bp, synthetic construct
  misc_feature 1..23: note = Description of Artificial Sequence: Syntheticoligonucleotide
  source 1..23: mol_type = other DNA
ccagactcagtactgagtctggc

SEQ ID NO: 5642 - DNA, 23 bp, synthetic construct
  misc_feature 1..23: note = Description of Artificial Sequence: Syntheticoligonucleotide
  source 1..23: mol_type = other DNA
cccgactcagtactgagtcggga

SEQ ID NO: 5643 - DNA, 23 bp, synthetic construct
  misc_feature 1..23: note = Description of Artificial Sequence: Syntheticoligonucleotide
  source 1..23: mol_type = other DNA
tccgactcagtactgagtcggac

SEQ ID NO: 5644 - DNA, 23 bp, synthetic construct
  misc_feature 1..23: note = Description of Artificial Sequence: Syntheticoligonucleotide
  source 1..23: mol_type = other DNA
cctgactcagtactgagtcaggc

SEQ ID NO: 5645 - DNA, 23 bp, synthetic construct
  misc_feature 1..23: note = Description of Artificial Sequence: Syntheticoligonucleotide
  source 1..23: mol_type = other DNA
ggcgactcagtactgagtcgccc

SEQ ID NO: 5646 - DNA, 23 bp, synthetic construct
  misc_feature 1..23: note = Description of Artificial Sequence: Syntheticoligonucleotide
  source 1..23: mol_type = other DNA
ggcgactcagtactgagtcgcct

SEQ ID NO: 5647 - DNA, 23 bp, synthetic construct
  misc_feature 1..23: note = Description of Artificial Sequence: Syntheticoligonucleotide
  source 1..23: mol_type = other DNA
agcgactcagtactgagtcgctc

SEQ ID NO: 5648 - DNA, 23 bp, synthetic construct
  misc_feature 1..23: note = Description of Artificial Sequence: Syntheticoligonucleotide
  source 1..23: mol_type = other DNA
gacgactcagtactgagtcgtcc

SEQ ID NO: 5649 - DNA, 23 bp, synthetic construct
  misc_feature 1..23: note = Description of Artificial Sequence: Syntheticoligonucleotide
  source 1..23: mol_type = other DNA
ggagactcagtactgagtctccc

SEQ ID NO: 5650 - DNA, 23 bp, synthetic construct
  misc_feature 1..23: note = Description of Artificial Sequence: Syntheticoligonucleotide
  source 1..23: mol_type = other DNA
ggcgactcagtactgagtcgcca

SEQ ID NO: 5651 - DNA, 23 bp, synthetic construct
  misc_feature 1..23: note = Description of Artificial Sequence: Syntheticoligonucleotide
  source 1..23: mol_type = other DNA
tgcgactcagtactgagtcgcac

SEQ ID NO: 5652 - DNA, 23 bp, synthetic construct
  misc_feature 1..23: note = Description of Artificial Sequence: Syntheticoligonucleotide
  source 1..23: mol_type = other DNA
ggtgactcagtactgagtcaccc

SEQ ID NO: 5653 - DNA, 23 bp, synthetic construct
  misc_feature 1..23: note = Description of Artificial Sequence: Syntheticoligonucleotide
  source 1..23: mol_type = other DNA
cgggactcagtactgagtcccgt

SEQ ID NO: 5654 - DNA, 23 bp, synthetic construct
  misc_feature 1..23: note = Description of Artificial Sequence: Syntheticoligonucleotide
  source 1..23: mol_type = other DNA
agggactcagtactgagtccctg

SEQ ID NO: 5655 - DNA, 23 bp, synthetic construct
  misc_feature 1..23: note = Description of Artificial Sequence: Syntheticoligonucleotide
  source 1..23: mol_type = other DNA
caggactcagtactgagtcctgg

SEQ ID NO: 5656 - DNA, 23 bp, synthetic construct
  misc_feature 1..23: note = Description of Artificial Sequence: Syntheticoligonucleotide
  source 1..23: mol_type = other DNA
cgagactcagtactgagtctcgg

SEQ ID NO: 5657 - DNA, 23 bp, synthetic construct
  misc_feature 1..23: note = Description of Artificial Sequence: Syntheticoligonucleotide
  source 1..23: mol_type = other DNA
cgggactcagtactgagtcccga

SEQ ID NO: 5658 - DNA, 23 bp, synthetic construct
  misc_feature 1..23: note = Description of Artificial Sequence: Syntheticoligonucleotide
  source 1..23: mol_type = other DNA
tgggactcagtactgagtcccag

SEQ ID NO: 5659 - DNA, 23 bp, synthetic construct
  misc_feature 1..23: note = Description of Artificial Sequence: Syntheticoligonucleotide
  source 1..23: mol_type = other DNA
ctggactcagtactgagtccagg

SEQ ID NO: 5660 - DNA, 23 bp, synthetic construct
  misc_feature 1..23: note = Description of Artificial Sequence: Syntheticoligonucleotide
  source 1..23: mol_type = other DNA
cgtgactcagtactgagtcacgg

SEQ ID NO: 5661 - DNA, 23 bp, synthetic construct
  misc_feature 1..23: note = Description of Artificial Sequence: Syntheticoligonucleotide
  source 1..23: mol_type = other DNA
ggcgactcagtactgagtcgccg

SEQ ID NO: 5662 - DNA, 23 bp, synthetic construct
  misc_feature 1..23: note = Description of Artificial Sequence: Syntheticoligonucleotide
  source 1..23: mol_type = other DNA
agcgactcagtactgagtcgctg

SEQ ID NO: 5663 - DNA, 23 bp, synthetic construct
  misc_feature 1..23: note = Description of Artificial Sequence: Syntheticoligonucleotide
  source 1..23: mol_type = other DNA
gacgactcagtactgagtcgtcg

SEQ ID NO: 5664 - DNA, 23 bp, synthetic construct
  misc_feature 1..23: note = Description of Artificial Sequence: Syntheticoligonucleotide
  source 1..23: mol_type = other DNA
ggagactcagtactgagtctccg

SEQ ID NO: 5665 - DNA, 23 bp, synthetic construct
  misc_feature 1..23: note = Description of Artificial Sequence: Syntheticoligonucleotide
  source 1..23: mol_type = other DNA
tgcgactcagtactgagtcgcag

SEQ ID NO: 5666 - DNA, 23 bp, synthetic construct
  misc_feature 1..23: note = Description of Artificial Sequence: Syntheticoligonucleotide
  source 1..23: mol_type = other DNA
ggtgactcagtactgagtcaccg

SEQ ID NO: 5667 - DNA, 23 bp, synthetic construct
  misc_feature 1..23: note = Description of Artificial Sequence: Syntheticoligonucleotide
  source 1..23: mol_type = other DNA
acggactcagtactgagtccgtg

SEQ ID NO: 5668 - DNA, 23 bp, synthetic construct
  misc_feature 1..23: note = Description of Artificial Sequence: Syntheticoligonucleotide
  source 1..23: mol_type = other DNA
ccagactcagtactgagtctggg

SEQ ID NO: 5669 - DNA, 23 bp, synthetic construct
  misc_feature 1..23: note = Description of Artificial Sequence: Syntheticoligonucleotide
  source 1..23: mol_type = other DNA
tcggactcagtactgagtccgag

SEQ ID NO: 5670 - DNA, 23 bp, synthetic construct
  misc_feature 1..23: note = Description of Artificial Sequence: Syntheticoligonucleotide
  source 1..23: mol_type = other DNA
cctgactcagtactgagtcaggg

SEQ ID NO: 5671 - DNA, 23 bp, synthetic construct
  misc_feature 1..23: note = Description of Artificial Sequence: Syntheticoligonucleotide
  source 1..23: mol_type = other DNA
cacgactcagtactgagtcgtgg

SEQ ID NO: 5672 - DNA, 23 bp, synthetic construct
  misc_feature 1..23: note = Description of Artificial Sequence: Syntheticoligonucleotide
  source 1..23: mol_type = other DNA
gccgactcagtactgagtcggct

SEQ ID NO: 5673 - DNA, 23 bp, synthetic construct
  misc_feature 1..23: note = Description of Artificial Sequence: Syntheticoligonucleotide
  source 1..23: mol_type = other DNA
gccgactcagtactgagtcggca

SEQ ID NO: 5674 - DNA, 23 bp, synthetic construct
  misc_feature 1..23: note = Description of Artificial Sequence: Syntheticoligonucleotide
  source 1..23: mol_type = other DNA
cgagactcagtactgagtctcgc

SEQ ID NO: 5675 - DNA, 23 bp, synthetic construct
  misc_feature 1..23: note = Description of Artificial Sequence: Syntheticoligonucleotide
  source 1..23: mol_type = other DNA
cgtgactcagtactgagtcacgc

SEQ ID NO: 5676 - DNA, 23 bp, synthetic construct
  misc_feature 1..23: note = Description of Artificial Sequence: Syntheticoligonucleotide
  source 1..23: mol_type = other DNA
caggactcagtactgagtcctgc

SEQ ID NO: 5677 - DNA, 23 bp, synthetic construct
  misc_feature 1..23: note = Description of Artificial Sequence: Syntheticoligonucleotide
  source 1..23: mol_type = other DNA
ctggactcagtactgagtccagc

SEQ ID NO: 5678 - DNA, 23 bp, synthetic construct
  misc_feature 1..23: note = Description of Artificial Sequence: Syntheticoligonucleotide
  source 1..23: mol_type = other DNA
gaggactcagtactgagtcctcg

SEQ ID NO: 5679 - DNA, 23 bp, synthetic construct
  misc_feature 1..23: note = Description of Artificial Sequence: Syntheticoligonucleotide
  source 1..23: mol_type = other DNA
gtggactcagtactgagtccacg

SEQ ID NO: 5680 - DNA, 23 bp, synthetic construct
  misc_feature 1..23: note = Description of Artificial Sequence: Syntheticoligonucleotide
  source 1..23: mol_type = other DNA
accgactcagtactgagtcggtg

SEQ ID NO: 5681 - DNA, 23 bp, synthetic construct
  misc_feature 1..23: note = Description of Artificial Sequence: Syntheticoligonucleotide
  source 1..23: mol_type = other DNA
tccgactcagtactgagtcggag

SEQ ID NO: 5682 - DNA, 23 bp, synthetic construct
  misc_feature 1..23: note = Description of Artificial Sequence: Syntheticoligonucleotide
  source 1..23: mol_type = other DNA
cgggactcagtactgagtcccgc

SEQ ID NO: 5683 - DNA, 23 bp, synthetic construct
  misc_feature 1..23: note = Description of Artificial Sequence: Syntheticoligonucleotide
  source 1..23: mol_type = other DNA
agggactcagtactgagtccctc

SEQ ID NO: 5684 - DNA, 23 bp, synthetic construct
  misc_feature 1..23: note = Description of Artificial Sequence: Syntheticoligonucleotide
  source 1..23: mol_type = other DNA
tgggactcagtactgagtcccac

SEQ ID NO: 5685 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcaggcctgagtcnnnn

SEQ ID NO: 5686 - DNA, 23 bp, synthetic construct
  misc_feature 1..23: note = Description of Artificial Sequence: Syntheticoligonucleotide
  source 1..23: mol_type = other DNA
gcggactcaggcctgagtccgcc

SEQ ID NO: 5687 - DNA, 23 bp, synthetic construct
  misc_feature 1..23: note = Description of Artificial Sequence: Syntheticoligonucleotide
  source 1..23: mol_type = other DNA
gcggactcaggcctgagtccgct

SEQ ID NO: 5688 - DNA, 23 bp, synthetic construct
  misc_feature 1..23: note = Description of Artificial Sequence: Syntheticoligonucleotide
  source 1..23: mol_type = other DNA
acggactcaggcctgagtccgtc

SEQ ID NO: 5689 - DNA, 23 bp, synthetic construct
  misc_feature 1..23: note = Description of Artificial Sequence: Syntheticoligonucleotide
  source 1..23: mol_type = other DNA
gaggactcaggcctgagtcctcc

SEQ ID NO: 5690 - DNA, 23 bp, synthetic construct
  misc_feature 1..23: note = Description of Artificial Sequence: Syntheticoligonucleotide
  source 1..23: mol_type = other DNA
gcagactcaggcctgagtctgcc

SEQ ID NO: 5691 - DNA, 23 bp, synthetic construct
  misc_feature 1..23: note = Description of Artificial Sequence: Syntheticoligonucleotide
  source 1..23: mol_type = other DNA
gcggactcaggcctgagtccgca

SEQ ID NO: 5692 - DNA, 23 bp, synthetic construct
  misc_feature 1..23: note = Description of Artificial Sequence: Syntheticoligonucleotide
  source 1..23: mol_type = other DNA
tcggactcaggcctgagtccgac

SEQ ID NO: 5693 - DNA, 23 bp, synthetic construct
  misc_feature 1..23: note = Description of Artificial Sequence: Syntheticoligonucleotide
  source 1..23: mol_type = other DNA
gtggactcaggcctgagtccacc

SEQ ID NO: 5694 - DNA, 23 bp, synthetic construct
  misc_feature 1..23: note = Description of Artificial Sequence: Syntheticoligonucleotide
  source 1..23: mol_type = other DNA
gctgactcaggcctgagtcagcc

SEQ ID NO: 5695 - DNA, 23 bp, synthetic construct
  misc_feature 1..23: note = Description of Artificial Sequence: Syntheticoligonucleotide
  source 1..23: mol_type = other DNA
cccgactcaggcctgagtcgggc

SEQ ID NO: 5696 - DNA, 23 bp, synthetic construct
  misc_feature 1..23: note = Description of Artificial Sequence: Syntheticoligonucleotide
  source 1..23: mol_type = other DNA
cccgactcaggcctgagtcgggt

SEQ ID NO: 5697 - DNA, 23 bp, synthetic construct
  misc_feature 1..23: note = Description of Artificial Sequence: Syntheticoligonucleotide
  source 1..23: mol_type = other DNA
accgactcaggcctgagtcggtc

SEQ ID NO: 5698 - DNA, 23 bp, synthetic construct
  misc_feature 1..23: note = Description of Artificial Sequence: Syntheticoligonucleotide
  source 1..23: mol_type = other DNA
cacgactcaggcctgagtcgtgc

SEQ ID NO: 5699 - DNA, 23 bp, synthetic construct
  misc_feature 1..23: note = Description of Artificial Sequence: Syntheticoligonucleotide
  source 1..23: mol_type = other DNA
ccagactcaggcctgagtctggc

SEQ ID NO: 5700 - DNA, 23 bp, synthetic construct
  misc_feature 1..23: note = Description of Artificial Sequence: Syntheticoligonucleotide
  source 1..23: mol_type = other DNA
cccgactcaggcctgagtcggga

SEQ ID NO: 5701 - DNA, 23 bp, synthetic construct
  misc_feature 1..23: note = Description of Artificial Sequence: Syntheticoligonucleotide
  source 1..23: mol_type = other DNA
tccgactcaggcctgagtcggac

SEQ ID NO: 5702 - DNA, 23 bp, synthetic construct
  misc_feature 1..23: note = Description of Artificial Sequence: Syntheticoligonucleotide
  source 1..23: mol_type = other DNA
cctgactcaggcctgagtcaggc

SEQ ID NO: 5703 - DNA, 23 bp, synthetic construct
  misc_feature 1..23: note = Description of Artificial Sequence: Syntheticoligonucleotide
  source 1..23: mol_type = other DNA
ggcgactcaggcctgagtcgccc

SEQ ID NO: 5704 - DNA, 23 bp, synthetic construct
  misc_feature 1..23: note = Description of Artificial Sequence: Syntheticoligonucleotide
  source 1..23: mol_type = other DNA
ggcgactcaggcctgagtcgcct

SEQ ID NO: 5705 - DNA, 23 bp, synthetic construct
  misc_feature 1..23: note = Description of Artificial Sequence: Syntheticoligonucleotide
  source 1..23: mol_type = other DNA
agcgactcaggcctgagtcgctc

SEQ ID NO: 5706 - DNA, 23 bp, synthetic construct
  misc_feature 1..23: note = Description of Artificial Sequence: Syntheticoligonucleotide
  source 1..23: mol_type = other DNA
gacgactcaggcctgagtcgtcc

SEQ ID NO: 5707 - DNA, 23 bp, synthetic construct
  misc_feature 1..23: note = Description of Artificial Sequence: Syntheticoligonucleotide
  source 1..23: mol_type = other DNA
ggagactcaggcctgagtctccc

SEQ ID NO: 5708 - DNA, 23 bp, synthetic construct
  misc_feature 1..23: note = Description of Artificial Sequence: Syntheticoligonucleotide
  source 1..23: mol_type = other DNA
ggcgactcaggcctgagtcgcca

SEQ ID NO: 5709 - DNA, 23 bp, synthetic construct
  misc_feature 1..23: note = Description of Artificial Sequence: Syntheticoligonucleotide
  source 1..23: mol_type = other DNA
tgcgactcaggcctgagtcgcac

SEQ ID NO: 5710 - DNA, 23 bp, synthetic construct
  misc_feature 1..23: note = Description of Artificial Sequence: Syntheticoligonucleotide
  source 1..23: mol_type = other DNA
ggtgactcaggcctgagtcaccc

SEQ ID NO: 5711 - DNA, 23 bp, synthetic construct
  misc_feature 1..23: note = Description of Artificial Sequence: Syntheticoligonucleotide
  source 1..23: mol_type = other DNA
cgggactcaggcctgagtcccgt

SEQ ID NO: 5712 - DNA, 23 bp, synthetic construct
  misc_feature 1..23: note = Description of Artificial Sequence: Syntheticoligonucleotide
  source 1..23: mol_type = other DNA
agggactcaggcctgagtccctg

SEQ ID NO: 5713 - DNA, 23 bp, synthetic construct
  misc_feature 1..23: note = Description of Artificial Sequence: Syntheticoligonucleotide
  source 1..23: mol_type = other DNA
caggactcaggcctgagtcctgg

SEQ ID NO: 5714 - DNA, 23 bp, synthetic construct
  misc_feature 1..23: note = Description of Artificial Sequence: Syntheticoligonucleotide
  source 1..23: mol_type = other DNA
cgagactcaggcctgagtctcgg

SEQ ID NO: 5715 - DNA, 23 bp, synthetic construct
  misc_feature 1..23: note = Description of Artificial Sequence: Syntheticoligonucleotide
  source 1..23: mol_type = other DNA
cgggactcaggcctgagtcccga

SEQ ID NO: 5716 - DNA, 23 bp, synthetic construct
  misc_feature 1..23: note = Description of Artificial Sequence: Syntheticoligonucleotide
  source 1..23: mol_type = other DNA
tgggactcaggcctgagtcccag

SEQ ID NO: 5717 - DNA, 23 bp, synthetic construct
  misc_feature 1..23: note = Description of Artificial Sequence: Syntheticoligonucleotide
  source 1..23: mol_type = other DNA
ctggactcaggcctgagtccagg

SEQ ID NO: 5718 - DNA, 23 bp, synthetic construct
  misc_feature 1..23: note = Description of Artificial Sequence: Syntheticoligonucleotide
  source 1..23: mol_type = other DNA
cgtgactcaggcctgagtcacgg

SEQ ID NO: 5719 - DNA, 23 bp, synthetic construct
  misc_feature 1..23: note = Description of Artificial Sequence: Syntheticoligonucleotide
  source 1..23: mol_type = other DNA
ggcgactcaggcctgagtcgccg

SEQ ID NO: 5720 - DNA, 23 bp, synthetic construct
  misc_feature 1..23: note = Description of Artificial Sequence: Syntheticoligonucleotide
  source 1..23: mol_type = other DNA
agcgactcaggcctgagtcgctg

SEQ ID NO: 5721 - DNA, 23 bp, synthetic construct
  misc_feature 1..23: note = Description of Artificial Sequence: Syntheticoligonucleotide
  source 1..23: mol_type = other DNA
gacgactcaggcctgagtcgtcg

SEQ ID NO: 5722 - DNA, 23 bp, synthetic construct
  misc_feature 1..23: note = Description of Artificial Sequence: Syntheticoligonucleotide
  source 1..23: mol_type = other DNA
ggagactcaggcctgagtctccg

SEQ ID NO: 5723 - DNA, 23 bp, synthetic construct
  misc_feature 1..23: note = Description of Artificial Sequence: Syntheticoligonucleotide
  source 1..23: mol_type = other DNA
tgcgactcaggcctgagtcgcag

SEQ ID NO: 5724 - DNA, 23 bp, synthetic construct
  misc_feature 1..23: note = Description of Artificial Sequence: Syntheticoligonucleotide
  source 1..23: mol_type = other DNA
ggtgactcaggcctgagtcaccg

SEQ ID NO: 5725 - DNA, 23 bp, synthetic construct
  misc_feature 1..23: note = Description of Artificial Sequence: Syntheticoligonucleotide
  source 1..23: mol_type = other DNA
acggactcaggcctgagtccgtg

SEQ ID NO: 5726 - DNA, 23 bp, synthetic construct
  misc_feature 1..23: note = Description of Artificial Sequence: Syntheticoligonucleotide
  source 1..23: mol_type = other DNA
ccagactcaggcctgagtctggg

SEQ ID NO: 5727 - DNA, 23 bp, synthetic construct
  misc_feature 1..23: note = Description of Artificial Sequence: Syntheticoligonucleotide
  source 1..23: mol_type = other DNA
tcggactcaggcctgagtccgag

SEQ ID NO: 5728 - DNA, 23 bp, synthetic construct
  misc_feature 1..23: note = Description of Artificial Sequence: Syntheticoligonucleotide
  source 1..23: mol_type = other DNA
cctgactcaggcctgagtcaggg

SEQ ID NO: 5729 - DNA, 23 bp, synthetic construct
  misc_feature 1..23: note = Description of Artificial Sequence: Syntheticoligonucleotide
  source 1..23: mol_type = other DNA
cacgactcaggcctgagtcgtgg

SEQ ID NO: 5730 - DNA, 23 bp, synthetic construct
  misc_feature 1..23: note = Description of Artificial Sequence: Syntheticoligonucleotide
  source 1..23: mol_type = other DNA
gccgactcaggcctgagtcggct

SEQ ID NO: 5731 - DNA, 23 bp, synthetic construct
  misc_feature 1..23: note = Description of Artificial Sequence: Syntheticoligonucleotide
  source 1..23: mol_type = other DNA
gccgactcaggcctgagtcggca

SEQ ID NO: 5732 - DNA, 23 bp, synthetic construct
  misc_feature 1..23: note = Description of Artificial Sequence: Syntheticoligonucleotide
  source 1..23: mol_type = other DNA
cgagactcaggcctgagtctcgc

SEQ ID NO: 5733 - DNA, 23 bp, synthetic construct
  misc_feature 1..23: note = Description of Artificial Sequence: Syntheticoligonucleotide
  source 1..23: mol_type = other DNA
cgtgactcaggcctgagtcacgc

SEQ ID NO: 5734 - DNA, 23 bp, synthetic construct
  misc_feature 1..23: note = Description of Artificial Sequence: Syntheticoligonucleotide
  source 1..23: mol_type = other DNA
caggactcaggcctgagtcctgc

SEQ ID NO: 5735 - DNA, 23 bp, synthetic construct
  misc_feature 1..23: note = Description of Artificial Sequence: Syntheticoligonucleotide
  source 1..23: mol_type = other DNA
ctggactcaggcctgagtccagc

SEQ ID NO: 5736 - DNA, 23 bp, synthetic construct
  misc_feature 1..23: note = Description of Artificial Sequence: Syntheticoligonucleotide
  source 1..23: mol_type = other DNA
gaggactcaggcctgagtcctcg

SEQ ID NO: 5737 - DNA, 23 bp, synthetic construct
  misc_feature 1..23: note = Description of Artificial Sequence: Syntheticoligonucleotide
  source 1..23: mol_type = other DNA
gtggactcaggcctgagtccacg

SEQ ID NO: 5738 - DNA, 23 bp, synthetic construct
  misc_feature 1..23: note = Description of Artificial Sequence: Syntheticoligonucleotide
  source 1..23: mol_type = other DNA
accgactcaggcctgagtcggtg

SEQ ID NO: 5739 - DNA, 23 bp, synthetic construct
  misc_feature 1..23: note = Description of Artificial Sequence: Syntheticoligonucleotide
  source 1..23: mol_type = other DNA
tccgactcaggcctgagtcggag

SEQ ID NO: 5740 - DNA, 23 bp, synthetic construct
  misc_feature 1..23: note = Description of Artificial Sequence: Syntheticoligonucleotide
  source 1..23: mol_type = other DNA
cgggactcaggcctgagtcccgc

SEQ ID NO: 5741 - DNA, 23 bp, synthetic construct
  misc_feature 1..23: note = Description of Artificial Sequence: Syntheticoligonucleotide
  source 1..23: mol_type = other DNA
agggactcaggcctgagtccctc

SEQ ID NO: 5742 - DNA, 23 bp, synthetic construct
  misc_feature 1..23: note = Description of Artificial Sequence: Syntheticoligonucleotide
  source 1..23: mol_type = other DNA
tgggactcaggcctgagtcccac

SEQ ID NO: 5743 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcagcgctgagtcnnnn

SEQ ID NO: 5744 - DNA, 23 bp, synthetic construct
  misc_feature 1..23: note = Description of Artificial Sequence: Syntheticoligonucleotide
  source 1..23: mol_type = other DNA
gcggactcagcgctgagtccgcc

SEQ ID NO: 5745 - DNA, 23 bp, synthetic construct
  misc_feature 1..23: note = Description of Artificial Sequence: Syntheticoligonucleotide
  source 1..23: mol_type = other DNA
gcggactcagcgctgagtccgct

SEQ ID NO: 5746 - DNA, 23 bp, synthetic construct
  misc_feature 1..23: note = Description of Artificial Sequence: Syntheticoligonucleotide
  source 1..23: mol_type = other DNA
acggactcagcgctgagtccgtc

SEQ ID NO: 5747 - DNA, 23 bp, synthetic construct
  misc_feature 1..23: note = Description of Artificial Sequence: Syntheticoligonucleotide
  source 1..23: mol_type = other DNA
gaggactcagcgctgagtcctcc

SEQ ID NO: 5748 - DNA, 23 bp, synthetic construct
  misc_feature 1..23: note = Description of Artificial Sequence: Syntheticoligonucleotide
  source 1..23: mol_type = other DNA
gcagactcagcgctgagtctgcc

SEQ ID NO: 5749 - DNA, 23 bp, synthetic construct
  misc_feature 1..23: note = Description of Artificial Sequence: Syntheticoligonucleotide
  source 1..23: mol_type = other DNA
gcggactcagcgctgagtccgca

SEQ ID NO: 5750 - DNA, 23 bp, synthetic construct
  misc_feature 1..23: note = Description of Artificial Sequence: Syntheticoligonucleotide
  source 1..23: mol_type = other DNA
tcggactcagcgctgagtccgac

SEQ ID NO: 5751 - DNA, 23 bp, synthetic construct
  misc_feature 1..23: note = Description of Artificial Sequence: Syntheticoligonucleotide
  source 1..23: mol_type = other DNA
gtggactcagcgctgagtccacc

SEQ ID NO: 5752 - DNA, 23 bp, synthetic construct
  misc_feature 1..23: note = Description of Artificial Sequence: Syntheticoligonucleotide
  source 1..23: mol_type = other DNA
gctgactcagcgctgagtcagcc

SEQ ID NO: 5753 - DNA, 23 bp, synthetic construct
  misc_feature 1..23: note = Description of Artificial Sequence: Syntheticoligonucleotide
  source 1..23: mol_type = other DNA
cccgactcagcgctgagtcgggc

SEQ ID NO: 5754 - DNA, 23 bp, synthetic construct
  misc_feature 1..23: note = Description of Artificial Sequence: Syntheticoligonucleotide
  source 1..23: mol_type = other DNA
cccgactcagcgctgagtcgggt

SEQ ID NO: 5755 - DNA, 23 bp, synthetic construct
  misc_feature 1..23: note = Description of Artificial Sequence: Syntheticoligonucleotide
  source 1..23: mol_type = other DNA
accgactcagcgctgagtcggtc

SEQ ID NO: 5756 - DNA, 23 bp, synthetic construct
  misc_feature 1..23: note = Description of Artificial Sequence: Syntheticoligonucleotide
  source 1..23: mol_type = other DNA
cacgactcagcgctgagtcgtgc

SEQ ID NO: 5757 - DNA, 23 bp, synthetic construct
  misc_feature 1..23: note = Description of Artificial Sequence: Syntheticoligonucleotide
  source 1..23: mol_type = other DNA
ccagactcagcgctgagtctggc

SEQ ID NO: 5758 - DNA, 23 bp, synthetic construct
  misc_feature 1..23: note = Description of Artificial Sequence: Syntheticoligonucleotide
  source 1..23: mol_type = other DNA
cccgactcagcgctgagtcggga

SEQ ID NO: 5759 - DNA, 23 bp, synthetic construct
  misc_feature 1..23: note = Description of Artificial Sequence: Syntheticoligonucleotide
  source 1..23: mol_type = other DNA
tccgactcagcgctgagtcggac

SEQ ID NO: 5760 - DNA, 23 bp, synthetic construct
  misc_feature 1..23: note = Description of Artificial Sequence: Syntheticoligonucleotide
  source 1..23: mol_type = other DNA
cctgactcagcgctgagtcaggc

SEQ ID NO: 5761 - DNA, 23 bp, synthetic construct
  misc_feature 1..23: note = Description of Artificial Sequence: Syntheticoligonucleotide
  source 1..23: mol_type = other DNA
ggcgactcagcgctgagtcgccc

SEQ ID NO: 5762 - DNA, 23 bp, synthetic construct
  misc_feature 1..23: note = Description of Artificial Sequence: Syntheticoligonucleotide
  source 1..23: mol_type = other DNA
ggcgactcagcgctgagtcgcct

SEQ ID NO: 5763 - DNA, 23 bp, synthetic construct
  misc_feature 1..23: note = Description of Artificial Sequence: Syntheticoligonucleotide
  source 1..23: mol_type = other DNA
agcgactcagcgctgagtcgctc

SEQ ID NO: 5764 - DNA, 23 bp, synthetic construct
  misc_feature 1..23: note = Description of Artificial Sequence: Syntheticoligonucleotide
  source 1..23: mol_type = other DNA
gacgactcagcgctgagtcgtcc

SEQ ID NO: 5765 - DNA, 23 bp, synthetic construct
  misc_feature 1..23: note = Description of Artificial Sequence: Syntheticoligonucleotide
  source 1..23: mol_type = other DNA
ggagactcagcgctgagtctccc

SEQ ID NO: 5766 - DNA, 23 bp, synthetic construct
  misc_feature 1..23: note = Description of Artificial Sequence: Syntheticoligonucleotide
  source 1..23: mol_type = other DNA
ggcgactcagcgctgagtcgcca

SEQ ID NO: 5767 - DNA, 23 bp, synthetic construct
  misc_feature 1..23: note = Description of Artificial Sequence: Syntheticoligonucleotide
  source 1..23: mol_type = other DNA
tgcgactcagcgctgagtcgcac

SEQ ID NO: 5768 - DNA, 23 bp, synthetic construct
  misc_feature 1..23: note = Description of Artificial Sequence: Syntheticoligonucleotide
  source 1..23: mol_type = other DNA
ggtgactcagcgctgagtcaccc

SEQ ID NO: 5769 - DNA, 23 bp, synthetic construct
  misc_feature 1..23: note = Description of Artificial Sequence: Syntheticoligonucleotide
  source 1..23: mol_type = other DNA
cgggactcagcgctgagtcccgt

SEQ ID NO: 5770 - DNA, 23 bp, synthetic construct
  misc_feature 1..23: note = Description of Artificial Sequence: Syntheticoligonucleotide
  source 1..23: mol_type = other DNA
agggactcagcgctgagtccctg

SEQ ID NO: 5771 - DNA, 23 bp, synthetic construct
  misc_feature 1..23: note = Description of Artificial Sequence: Syntheticoligonucleotide
  source 1..23: mol_type = other DNA
caggactcagcgctgagtcctgg

SEQ ID NO: 5772 - DNA, 23 bp, synthetic construct
  misc_feature 1..23: note = Description of Artificial Sequence: Syntheticoligonucleotide
  source 1..23: mol_type = other DNA
cgagactcagcgctgagtctcgg

SEQ ID NO: 5773 - DNA, 23 bp, synthetic construct
  misc_feature 1..23: note = Description of Artificial Sequence: Syntheticoligonucleotide
  source 1..23: mol_type = other DNA
cgggactcagcgctgagtcccga

SEQ ID NO: 5774 - DNA, 23 bp, synthetic construct
  misc_feature 1..23: note = Description of Artificial Sequence: Syntheticoligonucleotide
  source 1..23: mol_type = other DNA
tgggactcagcgctgagtcccag

SEQ ID NO: 5775 - DNA, 23 bp, synthetic construct
  misc_feature 1..23: note = Description of Artificial Sequence: Syntheticoligonucleotide
  source 1..23: mol_type = other DNA
ctggactcagcgctgagtccagg

SEQ ID NO: 5776 - DNA, 23 bp, synthetic construct
  misc_feature 1..23: note = Description of Artificial Sequence: Syntheticoligonucleotide
  source 1..23: mol_type = other DNA
cgtgactcagcgctgagtcacgg

SEQ ID NO: 5777 - DNA, 23 bp, synthetic construct
  misc_feature 1..23: note = Description of Artificial Sequence: Syntheticoligonucleotide
  source 1..23: mol_type = other DNA
ggcgactcagcgctgagtcgccg

SEQ ID NO: 5778 - DNA, 23 bp, synthetic construct
  misc_feature 1..23: note = Description of Artificial Sequence: Syntheticoligonucleotide
  source 1..23: mol_type = other DNA
agcgactcagcgctgagtcgctg

SEQ ID NO: 5779 - DNA, 23 bp, synthetic construct
  misc_feature 1..23: note = Description of Artificial Sequence: Syntheticoligonucleotide
  source 1..23: mol_type = other DNA
gacgactcagcgctgagtcgtcg

SEQ ID NO: 5780 - DNA, 23 bp, synthetic construct
  misc_feature 1..23: note = Description of Artificial Sequence: Syntheticoligonucleotide
  source 1..23: mol_type = other DNA
ggagactcagcgctgagtctccg

SEQ ID NO: 5781 - DNA, 23 bp, synthetic construct
  misc_feature 1..23: note = Description of Artificial Sequence: Syntheticoligonucleotide
  source 1..23: mol_type = other DNA
tgcgactcagcgctgagtcgcag

SEQ ID NO: 5782 - DNA, 23 bp, synthetic construct
  misc_feature 1..23: note = Description of Artificial Sequence: Syntheticoligonucleotide
  source 1..23: mol_type = other DNA
ggtgactcagcgctgagtcaccg

SEQ ID NO: 5783 - DNA, 23 bp, synthetic construct
  misc_feature 1..23: note = Description of Artificial Sequence: Syntheticoligonucleotide
  source 1..23: mol_type = other DNA
acggactcagcgctgagtccgtg

SEQ ID NO: 5784 - DNA, 23 bp, synthetic construct
  misc_feature 1..23: note = Description of Artificial Sequence: Syntheticoligonucleotide
  source 1..23: mol_type = other DNA
ccagactcagcgctgagtctggg

SEQ ID NO: 5785 - DNA, 23 bp, synthetic construct
  misc_feature 1..23: note = Description of Artificial Sequence: Syntheticoligonucleotide
  source 1..23: mol_type = other DNA
tcggactcagcgctgagtccgag

SEQ ID NO: 5786 - DNA, 23 bp, synthetic construct
  misc_feature 1..23: note = Description of Artificial Sequence: Syntheticoligonucleotide
  source 1..23: mol_type = other DNA
cctgactcagcgctgagtcaggg

SEQ ID NO: 5787 - DNA, 23 bp, synthetic construct
  misc_feature 1..23: note = Description of Artificial Sequence: Syntheticoligonucleotide
  source 1..23: mol_type = other DNA
cacgactcagcgctgagtcgtgg

SEQ ID NO: 5788 - DNA, 23 bp, synthetic construct
  misc_feature 1..23: note = Description of Artificial Sequence: Syntheticoligonucleotide
  source 1..23: mol_type = other DNA
gccgactcagcgctgagtcggct

SEQ ID NO: 5789 - DNA, 23 bp, synthetic construct
  misc_feature 1..23: note = Description of Artificial Sequence: Syntheticoligonucleotide
  source 1..23: mol_type = other DNA
gccgactcagcgctgagtcggca

SEQ ID NO: 5790 - DNA, 23 bp, synthetic construct
  misc_feature 1..23: note = Description of Artificial Sequence: Syntheticoligonucleotide
  source 1..23: mol_type = other DNA
cgagactcagcgctgagtctcgc

SEQ ID NO: 5791 - DNA, 23 bp, synthetic construct
  misc_feature 1..23: note = Description of Artificial Sequence: Syntheticoligonucleotide
  source 1..23: mol_type = other DNA
cgtgactcagcgctgagtcacgc

SEQ ID NO: 5792 - DNA, 23 bp, synthetic construct
  misc_feature 1..23: note = Description of Artificial Sequence: Syntheticoligonucleotide
  source 1..23: mol_type = other DNA
caggactcagcgctgagtcctgc

SEQ ID NO: 5793 - DNA, 23 bp, synthetic construct
  misc_feature 1..23: note = Description of Artificial Sequence: Syntheticoligonucleotide
  source 1..23: mol_type = other DNA
ctggactcagcgctgagtccagc

SEQ ID NO: 5794 - DNA, 23 bp, synthetic construct
  misc_feature 1..23: note = Description of Artificial Sequence: Syntheticoligonucleotide
  source 1..23: mol_type = other DNA
gaggactcagcgctgagtcctcg

SEQ ID NO: 5795 - DNA, 23 bp, synthetic construct
  misc_feature 1..23: note = Description of Artificial Sequence: Syntheticoligonucleotide
  source 1..23: mol_type = other DNA
gtggactcagcgctgagtccacg

SEQ ID NO: 5796 - DNA, 23 bp, synthetic construct
  misc_feature 1..23: note = Description of Artificial Sequence: Syntheticoligonucleotide
  source 1..23: mol_type = other DNA
accgactcagcgctgagtcggtg

SEQ ID NO: 5797 - DNA, 23 bp, synthetic construct
  misc_feature 1..23: note = Description of Artificial Sequence: Syntheticoligonucleotide
  source 1..23: mol_type = other DNA
tccgactcagcgctgagtcggag

SEQ ID NO: 5798 - DNA, 23 bp, synthetic construct
  misc_feature 1..23: note = Description of Artificial Sequence: Syntheticoligonucleotide
  source 1..23: mol_type = other DNA
cgggactcagcgctgagtcccgc

SEQ ID NO: 5799 - DNA, 23 bp, synthetic construct
  misc_feature 1..23: note = Description of Artificial Sequence: Syntheticoligonucleotide
  source 1..23: mol_type = other DNA
agggactcagcgctgagtccctc

SEQ ID NO: 5800 - DNA, 23 bp, synthetic construct
  misc_feature 1..23: note = Description of Artificial Sequence: Syntheticoligonucleotide
  source 1..23: mol_type = other DNA
tgggactcagcgctgagtcccac

SEQ ID NO: 5801 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcaaatttgagtcnnnn

SEQ ID NO: 5802 - DNA, 23 bp, synthetic construct
  misc_feature 1..23: note = Description of Artificial Sequence: Syntheticoligonucleotide
  source 1..23: mol_type = other DNA
gcggactcaaatttgagtccgcc

SEQ ID NO: 5803 - DNA, 23 bp, synthetic construct
  misc_feature 1..23: note = Description of Artificial Sequence: Syntheticoligonucleotide
  source 1..23: mol_type = other DNA
gcggactcaaatttgagtccgct

SEQ ID NO: 5804 - DNA, 23 bp, synthetic construct
  misc_feature 1..23: note = Description of Artificial Sequence: Syntheticoligonucleotide
  source 1..23: mol_type = other DNA
acggactcaaatttgagtccgtc

SEQ ID NO: 5805 - DNA, 23 bp, synthetic construct
  misc_feature 1..23: note = Description of Artificial Sequence: Syntheticoligonucleotide
  source 1..23: mol_type = other DNA
gaggactcaaatttgagtcctcc

SEQ ID NO: 5806 - DNA, 23 bp, synthetic construct
  misc_feature 1..23: note = Description of Artificial Sequence: Syntheticoligonucleotide
  source 1..23: mol_type = other DNA
gcagactcaaatttgagtctgcc

SEQ ID NO: 5807 - DNA, 23 bp, synthetic construct
  misc_feature 1..23: note = Description of Artificial Sequence: Syntheticoligonucleotide
  source 1..23: mol_type = other DNA
gcggactcaaatttgagtccgca

SEQ ID NO: 5808 - DNA, 23 bp, synthetic construct
  misc_feature 1..23: note = Description of Artificial Sequence: Syntheticoligonucleotide
  source 1..23: mol_type = other DNA
tcggactcaaatttgagtccgac

SEQ ID NO: 5809 - DNA, 23 bp, synthetic construct
  misc_feature 1..23: note = Description of Artificial Sequence: Syntheticoligonucleotide
  source 1..23: mol_type = other DNA
gtggactcaaatttgagtccacc

SEQ ID NO: 5810 - DNA, 23 bp, synthetic construct
  misc_feature 1..23: note = Description of Artificial Sequence: Syntheticoligonucleotide
  source 1..23: mol_type = other DNA
gctgactcaaatttgagtcagcc

SEQ ID NO: 5811 - DNA, 23 bp, synthetic construct
  misc_feature 1..23: note = Description of Artificial Sequence: Syntheticoligonucleotide
  source 1..23: mol_type = other DNA
cccgactcaaatttgagtcgggc

SEQ ID NO: 5812 - DNA, 23 bp, synthetic construct
  misc_feature 1..23: note = Description of Artificial Sequence: Syntheticoligonucleotide
  source 1..23: mol_type = other DNA
cccgactcaaatttgagtcgggt

SEQ ID NO: 5813 - DNA, 23 bp, synthetic construct
  misc_feature 1..23: note = Description of Artificial Sequence: Syntheticoligonucleotide
  source 1..23: mol_type = other DNA
accgactcaaatttgagtcggtc

SEQ ID NO: 5814 - DNA, 23 bp, synthetic construct
  misc_feature 1..23: note = Description of Artificial Sequence: Syntheticoligonucleotide
  source 1..23: mol_type = other DNA
cacgactcaaatttgagtcgtgc

SEQ ID NO: 5815 - DNA, 23 bp, synthetic construct
  misc_feature 1..23: note = Description of Artificial Sequence: Syntheticoligonucleotide
  source 1..23: mol_type = other DNA
ccagactcaaatttgagtctggc

SEQ ID NO: 5816 - DNA, 23 bp, synthetic construct
  misc_feature 1..23: note = Description of Artificial Sequence: Syntheticoligonucleotide
  source 1..23: mol_type = other DNA
cccgactcaaatttgagtcggga

SEQ ID NO: 5817 - DNA, 23 bp, synthetic construct
  misc_feature 1..23: note = Description of Artificial Sequence: Syntheticoligonucleotide
  source 1..23: mol_type = other DNA
tccgactcaaatttgagtcggac

SEQ ID NO: 5818 - DNA, 23 bp, synthetic construct
  misc_feature 1..23: note = Description of Artificial Sequence: Syntheticoligonucleotide
  source 1..23: mol_type = other DNA
cctgactcaaatttgagtcaggc

SEQ ID NO: 5819 - DNA, 23 bp, synthetic construct
  misc_feature 1..23: note = Description of Artificial Sequence: Syntheticoligonucleotide
  source 1..23: mol_type = other DNA
ggcgactcaaatttgagtcgccc

SEQ ID NO: 5820 - DNA, 23 bp, synthetic construct
  misc_feature 1..23: note = Description of Artificial Sequence: Syntheticoligonucleotide
  source 1..23: mol_type = other DNA
ggcgactcaaatttgagtcgcct

SEQ ID NO: 5821 - DNA, 23 bp, synthetic construct
  misc_feature 1..23: note = Description of Artificial Sequence: Syntheticoligonucleotide
  source 1..23: mol_type = other DNA
agcgactcaaatttgagtcgctc

SEQ ID NO: 5822 - DNA, 23 bp, synthetic construct
  misc_feature 1..23: note = Description of Artificial Sequence: Syntheticoligonucleotide
  source 1..23: mol_type = other DNA
gacgactcaaatttgagtcgtcc

SEQ ID NO: 5823 - DNA, 23 bp, synthetic construct
  misc_feature 1..23: note = Description of Artificial Sequence: Syntheticoligonucleotide
  source 1..23: mol_type = other DNA
ggagactcaaatttgagtctccc

SEQ ID NO: 5824 - DNA, 23 bp, synthetic construct
  misc_feature 1..23: note = Description of Artificial Sequence: Syntheticoligonucleotide
  source 1..23: mol_type = other DNA
ggcgactcaaatttgagtcgcca

SEQ ID NO: 5825 - DNA, 23 bp, synthetic construct
  misc_feature 1..23: note = Description of Artificial Sequence: Syntheticoligonucleotide
  source 1..23: mol_type = other DNA
tgcgactcaaatttgagtcgcac

SEQ ID NO: 5826 - DNA, 23 bp, synthetic construct
  misc_feature 1..23: note = Description of Artificial Sequence: Syntheticoligonucleotide
  source 1..23: mol_type = other DNA
ggtgactcaaatttgagtcaccc

SEQ ID NO: 5827 - DNA, 23 bp, synthetic construct
  misc_feature 1..23: note = Description of Artificial Sequence: Syntheticoligonucleotide
  source 1..23: mol_type = other DNA
cgggactcaaatttgagtcccgt

SEQ ID NO: 5828 - DNA, 23 bp, synthetic construct
  misc_feature 1..23: note = Description of Artificial Sequence: Syntheticoligonucleotide
  source 1..23: mol_type = other DNA
agggactcaaatttgagtccctg

SEQ ID NO: 5829 - DNA, 23 bp, synthetic construct
  misc_feature 1..23: note = Description of Artificial Sequence: Syntheticoligonucleotide
  source 1..23: mol_type = other DNA
caggactcaaatttgagtcctgg

SEQ ID NO: 5830 - DNA, 23 bp, synthetic construct
  misc_feature 1..23: note = Description of Artificial Sequence: Syntheticoligonucleotide
  source 1..23: mol_type = other DNA
cgagactcaaatttgagtctcgg

SEQ ID NO: 5831 - DNA, 23 bp, synthetic construct
  misc_feature 1..23: note = Description of Artificial Sequence: Syntheticoligonucleotide
  source 1..23: mol_type = other DNA
cgggactcaaatttgagtcccga

SEQ ID NO: 5832 - DNA, 23 bp, synthetic construct
  misc_feature 1..23: note = Description of Artificial Sequence: Syntheticoligonucleotide
  source 1..23: mol_type = other DNA
tgggactcaaatttgagtcccag

SEQ ID NO: 5833 - DNA, 23 bp, synthetic construct
  misc_feature 1..23: note = Description of Artificial Sequence: Syntheticoligonucleotide
  source 1..23: mol_type = other DNA
ctggactcaaatttgagtccagg

SEQ ID NO: 5834 - DNA, 23 bp, synthetic construct
  misc_feature 1..23: note = Description of Artificial Sequence: Syntheticoligonucleotide
  source 1..23: mol_type = other DNA
cgtgactcaaatttgagtcacgg

SEQ ID NO: 5835 - DNA, 23 bp, synthetic construct
  misc_feature 1..23: note = Description of Artificial Sequence: Syntheticoligonucleotide
  source 1..23: mol_type = other DNA
ggcgactcaaatttgagtcgccg

SEQ ID NO: 5836 - DNA, 23 bp, synthetic construct
  misc_feature 1..23: note = Description of Artificial Sequence: Syntheticoligonucleotide
  source 1..23: mol_type = other DNA
agcgactcaaatttgagtcgctg

SEQ ID NO: 5837 - DNA, 23 bp, synthetic construct
  misc_feature 1..23: note = Description of Artificial Sequence: Syntheticoligonucleotide
  source 1..23: mol_type = other DNA
gacgactcaaatttgagtcgtcg

SEQ ID NO: 5838 - DNA, 23 bp, synthetic construct
  misc_feature 1..23: note = Description of Artificial Sequence: Syntheticoligonucleotide
  source 1..23: mol_type = other DNA
ggagactcaaatttgagtctccg

SEQ ID NO: 5839 - DNA, 23 bp, synthetic construct
  misc_feature 1..23: note = Description of Artificial Sequence: Syntheticoligonucleotide
  source 1..23: mol_type = other DNA
tgcgactcaaatttgagtcgcag

SEQ ID NO: 5840 - DNA, 23 bp, synthetic construct
  misc_feature 1..23: note = Description of Artificial Sequence: Syntheticoligonucleotide
  source 1..23: mol_type = other DNA
ggtgactcaaatttgagtcaccg

SEQ ID NO: 5841 - DNA, 23 bp, synthetic construct
  misc_feature 1..23: note = Description of Artificial Sequence: Syntheticoligonucleotide
  source 1..23: mol_type = other DNA
acggactcaaatttgagtccgtg

SEQ ID NO: 5842 - DNA, 23 bp, synthetic construct
  misc_feature 1..23: note = Description of Artificial Sequence: Syntheticoligonucleotide
  source 1..23: mol_type = other DNA
ccagactcaaatttgagtctggg

SEQ ID NO: 5843 - DNA, 23 bp, synthetic construct
  misc_feature 1..23: note = Description of Artificial Sequence: Syntheticoligonucleotide
  source 1..23: mol_type = other DNA
tcggactcaaatttgagtccgag

SEQ ID NO: 5844 - DNA, 23 bp, synthetic construct
  misc_feature 1..23: note = Description of Artificial Sequence: Syntheticoligonucleotide
  source 1..23: mol_type = other DNA
cctgactcaaatttgagtcaggg

SEQ ID NO: 5845 - DNA, 23 bp, synthetic construct
  misc_feature 1..23: note = Description of Artificial Sequence: Syntheticoligonucleotide
  source 1..23: mol_type = other DNA
cacgactcaaatttgagtcgtgg

SEQ ID NO: 5846 - DNA, 23 bp, synthetic construct
  misc_feature 1..23: note = Description of Artificial Sequence: Syntheticoligonucleotide
  source 1..23: mol_type = other DNA
gccgactcaaatttgagtcggct

SEQ ID NO: 5847 - DNA, 23 bp, synthetic construct
  misc_feature 1..23: note = Description of Artificial Sequence: Syntheticoligonucleotide
  source 1..23: mol_type = other DNA
gccgactcaaatttgagtcggca

SEQ ID NO: 5848 - DNA, 23 bp, synthetic construct
  misc_feature 1..23: note = Description of Artificial Sequence: Syntheticoligonucleotide
  source 1..23: mol_type = other DNA
cgagactcaaatttgagtctcgc

SEQ ID NO: 5849 - DNA, 23 bp, synthetic construct
  misc_feature 1..23: note = Description of Artificial Sequence: Syntheticoligonucleotide
  source 1..23: mol_type = other DNA
cgtgactcaaatttgagtcacgc

SEQ ID NO: 5850 - DNA, 23 bp, synthetic construct
  misc_feature 1..23: note = Description of Artificial Sequence: Syntheticoligonucleotide
  source 1..23: mol_type = other DNA
caggactcaaatttgagtcctgc

SEQ ID NO: 5851 - DNA, 23 bp, synthetic construct
  misc_feature 1..23: note = Description of Artificial Sequence: Syntheticoligonucleotide
  source 1..23: mol_type = other DNA
ctggactcaaatttgagtccagc

SEQ ID NO: 5852 - DNA, 23 bp, synthetic construct
  misc_feature 1..23: note = Description of Artificial Sequence: Syntheticoligonucleotide
  source 1..23: mol_type = other DNA
gaggactcaaatttgagtcctcg

SEQ ID NO: 5853 - DNA, 23 bp, synthetic construct
  misc_feature 1..23: note = Description of Artificial Sequence: Syntheticoligonucleotide
  source 1..23: mol_type = other DNA
gtggactcaaatttgagtccacg

SEQ ID NO: 5854 - DNA, 23 bp, synthetic construct
  misc_feature 1..23: note = Description of Artificial Sequence: Syntheticoligonucleotide
  source 1..23: mol_type = other DNA
accgactcaaatttgagtcggtg

SEQ ID NO: 5855 - DNA, 23 bp, synthetic construct
  misc_feature 1..23: note = Description of Artificial Sequence: Syntheticoligonucleotide
  source 1..23: mol_type = other DNA
tccgactcaaatttgagtcggag

SEQ ID NO: 5856 - DNA, 23 bp, synthetic construct
  misc_feature 1..23: note = Description of Artificial Sequence: Syntheticoligonucleotide
  source 1..23: mol_type = other DNA
cgggactcaaatttgagtcccgc

SEQ ID NO: 5857 - DNA, 23 bp, synthetic construct
  misc_feature 1..23: note = Description of Artificial Sequence: Syntheticoligonucleotide
  source 1..23: mol_type = other DNA
agggactcaaatttgagtccctc

SEQ ID NO: 5858 - DNA, 23 bp, synthetic construct
  misc_feature 1..23: note = Description of Artificial Sequence: Syntheticoligonucleotide
  source 1..23: mol_type = other DNA
tgggactcaaatttgagtcccac

SEQ ID NO: 5859 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcaatattgagtcnnnn

SEQ ID NO: 5860 - DNA, 23 bp, synthetic construct
  misc_feature 1..23: note = Description of Artificial Sequence: Syntheticoligonucleotide
  source 1..23: mol_type = other DNA
gcggactcaatattgagtccgcc

SEQ ID NO: 5861 - DNA, 23 bp, synthetic construct
  misc_feature 1..23: note = Description of Artificial Sequence: Syntheticoligonucleotide
  source 1..23: mol_type = other DNA
gcggactcaatattgagtccgct

SEQ ID NO: 5862 - DNA, 23 bp, synthetic construct
  misc_feature 1..23: note = Description of Artificial Sequence: Syntheticoligonucleotide
  source 1..23: mol_type = other DNA
acggactcaatattgagtccgtc

SEQ ID NO: 5863 - DNA, 23 bp, synthetic construct
  misc_feature 1..23: note = Description of Artificial Sequence: Syntheticoligonucleotide
  source 1..23: mol_type = other DNA
gaggactcaatattgagtcctcc

SEQ ID NO: 5864 - DNA, 23 bp, synthetic construct
  misc_feature 1..23: note = Description of Artificial Sequence: Syntheticoligonucleotide
  source 1..23: mol_type = other DNA
gcagactcaatattgagtctgcc

SEQ ID NO: 5865 - DNA, 23 bp, synthetic construct
  misc_feature 1..23: note = Description of Artificial Sequence: Syntheticoligonucleotide
  source 1..23: mol_type = other DNA
gcggactcaatattgagtccgca

SEQ ID NO: 5866 - DNA, 23 bp, synthetic construct
  misc_feature 1..23: note = Description of Artificial Sequence: Syntheticoligonucleotide
  source 1..23: mol_type = other DNA
tcggactcaatattgagtccgac

SEQ ID NO: 5867 - DNA, 23 bp, synthetic construct
  misc_feature 1..23: note = Description of Artificial Sequence: Syntheticoligonucleotide
  source 1..23: mol_type = other DNA
gtggactcaatattgagtccacc

SEQ ID NO: 5868 - DNA, 23 bp, synthetic construct
  misc_feature 1..23: note = Description of Artificial Sequence: Syntheticoligonucleotide
  source 1..23: mol_type = other DNA
gctgactcaatattgagtcagcc

SEQ ID NO: 5869 - DNA, 23 bp, synthetic construct
  misc_feature 1..23: note = Description of Artificial Sequence: Syntheticoligonucleotide
  source 1..23: mol_type = other DNA
cccgactcaatattgagtcgggc

SEQ ID NO: 5870 - DNA, 23 bp, synthetic construct
  misc_feature 1..23: note = Description of Artificial Sequence: Syntheticoligonucleotide
  source 1..23: mol_type = other DNA
cccgactcaatattgagtcgggt

SEQ ID NO: 5871 - DNA, 23 bp, synthetic construct
  misc_feature 1..23: note = Description of Artificial Sequence: Syntheticoligonucleotide
  source 1..23: mol_type = other DNA
accgactcaatattgagtcggtc

SEQ ID NO: 5872 - DNA, 23 bp, synthetic construct
  misc_feature 1..23: note = Description of Artificial Sequence: Syntheticoligonucleotide
  source 1..23: mol_type = other DNA
cacgactcaatattgagtcgtgc

SEQ ID NO: 5873 - DNA, 23 bp, synthetic construct
  misc_feature 1..23: note = Description of Artificial Sequence: Syntheticoligonucleotide
  source 1..23: mol_type = other DNA
ccagactcaatattgagtctggc

SEQ ID NO: 5874 - DNA, 23 bp, synthetic construct
  misc_feature 1..23: note = Description of Artificial Sequence: Syntheticoligonucleotide
  source 1..23: mol_type = other DNA
cccgactcaatattgagtcggga

SEQ ID NO: 5875 - DNA, 23 bp, synthetic construct
  misc_feature 1..23: note = Description of Artificial Sequence: Syntheticoligonucleotide
  source 1..23: mol_type = other DNA
tccgactcaatattgagtcggac

SEQ ID NO: 5876 - DNA, 23 bp, synthetic construct
  misc_feature 1..23: note = Description of Artificial Sequence: Syntheticoligonucleotide
  source 1..23: mol_type = other DNA
cctgactcaatattgagtcaggc

SEQ ID NO: 5877 - DNA, 23 bp, synthetic construct
  misc_feature 1..23: note = Description of Artificial Sequence: Syntheticoligonucleotide
  source 1..23: mol_type = other DNA
ggcgactcaatattgagtcgccc

SEQ ID NO: 5878 - DNA, 23 bp, synthetic construct
  misc_feature 1..23: note = Description of Artificial Sequence: Syntheticoligonucleotide
  source 1..23: mol_type = other DNA
ggcgactcaatattgagtcgcct

SEQ ID NO: 5879 - DNA, 23 bp, synthetic construct
  misc_feature 1..23: note = Description of Artificial Sequence: Syntheticoligonucleotide
  source 1..23: mol_type = other DNA
agcgactcaatattgagtcgctc

SEQ ID NO: 5880 - DNA, 23 bp, synthetic construct
  misc_feature 1..23: note = Description of Artificial Sequence: Syntheticoligonucleotide
  source 1..23: mol_type = other DNA
gacgactcaatattgagtcgtcc

SEQ ID NO: 5881 - DNA, 23 bp, synthetic construct
  misc_feature 1..23: note = Description of Artificial Sequence: Syntheticoligonucleotide
  source 1..23: mol_type = other DNA
ggagactcaatattgagtctccc

SEQ ID NO: 5882 - DNA, 23 bp, synthetic construct
  misc_feature 1..23: note = Description of Artificial Sequence: Syntheticoligonucleotide
  source 1..23: mol_type = other DNA
ggcgactcaatattgagtcgcca

SEQ ID NO: 5883 - DNA, 23 bp, synthetic construct
  misc_feature 1..23: note = Description of Artificial Sequence: Syntheticoligonucleotide
  source 1..23: mol_type = other DNA
tgcgactcaatattgagtcgcac

SEQ ID NO: 5884 - DNA, 23 bp, synthetic construct
  misc_feature 1..23: note = Description of Artificial Sequence: Syntheticoligonucleotide
  source 1..23: mol_type = other DNA
ggtgactcaatattgagtcaccc

SEQ ID NO: 5885 - DNA, 23 bp, synthetic construct
  misc_feature 1..23: note = Description of Artificial Sequence: Syntheticoligonucleotide
  source 1..23: mol_type = other DNA
cgggactcaatattgagtcccgt

SEQ ID NO: 5886 - DNA, 23 bp, synthetic construct
  misc_feature 1..23: note = Description of Artificial Sequence: Syntheticoligonucleotide
  source 1..23: mol_type = other DNA
agggactcaatattgagtccctg

SEQ ID NO: 5887 - DNA, 23 bp, synthetic construct
  misc_feature 1..23: note = Description of Artificial Sequence: Syntheticoligonucleotide
  source 1..23: mol_type = other DNA
caggactcaatattgagtcctgg

SEQ ID NO: 5888 - DNA, 23 bp, synthetic construct
  misc_feature 1..23: note = Description of Artificial Sequence: Syntheticoligonucleotide
  source 1..23: mol_type = other DNA
cgagactcaatattgagtctcgg

SEQ ID NO: 5889 - DNA, 23 bp, synthetic construct
  misc_feature 1..23: note = Description of Artificial Sequence: Syntheticoligonucleotide
  source 1..23: mol_type = other DNA
cgggactcaatattgagtcccga

SEQ ID NO: 5890 - DNA, 23 bp, synthetic construct
  misc_feature 1..23: note = Description of Artificial Sequence: Syntheticoligonucleotide
  source 1..23: mol_type = other DNA
tgggactcaatattgagtcccag

SEQ ID NO: 5891 - DNA, 23 bp, synthetic construct
  misc_feature 1..23: note = Description of Artificial Sequence: Syntheticoligonucleotide
  source 1..23: mol_type = other DNA
ctggactcaatattgagtccagg

SEQ ID NO: 5892 - DNA, 23 bp, synthetic construct
  misc_feature 1..23: note = Description of Artificial Sequence: Syntheticoligonucleotide
  source 1..23: mol_type = other DNA
cgtgactcaatattgagtcacgg

SEQ ID NO: 5893 - DNA, 23 bp, synthetic construct
  misc_feature 1..23: note = Description of Artificial Sequence: Syntheticoligonucleotide
  source 1..23: mol_type = other DNA
ggcgactcaatattgagtcgccg

SEQ ID NO: 5894 - DNA, 23 bp, synthetic construct
  misc_feature 1..23: note = Description of Artificial Sequence: Syntheticoligonucleotide
  source 1..23: mol_type = other DNA
agcgactcaatattgagtcgctg

SEQ ID NO: 5895 - DNA, 23 bp, synthetic construct
  misc_feature 1..23: note = Description of Artificial Sequence: Syntheticoligonucleotide
  source 1..23: mol_type = other DNA
gacgactcaatattgagtcgtcg

SEQ ID NO: 5896 - DNA, 23 bp, synthetic construct
  misc_feature 1..23: note = Description of Artificial Sequence: Syntheticoligonucleotide
  source 1..23: mol_type = other DNA
ggagactcaatattgagtctccg

SEQ ID NO: 5897 - DNA, 23 bp, synthetic construct
  misc_feature 1..23: note = Description of Artificial Sequence: Syntheticoligonucleotide
  source 1..23: mol_type = other DNA
tgcgactcaatattgagtcgcag

SEQ ID NO: 5898 - DNA, 23 bp, synthetic construct
  misc_feature 1..23: note = Description of Artificial Sequence: Syntheticoligonucleotide
  source 1..23: mol_type = other DNA
ggtgactcaatattgagtcaccg

SEQ ID NO: 5899 - DNA, 23 bp, synthetic construct
  misc_feature 1..23: note = Description of Artificial Sequence: Syntheticoligonucleotide
  source 1..23: mol_type = other DNA
acggactcaatattgagtccgtg

SEQ ID NO: 5900 - DNA, 23 bp, synthetic construct
  misc_feature 1..23: note = Description of Artificial Sequence: Syntheticoligonucleotide
  source 1..23: mol_type = other DNA
ccagactcaatattgagtctggg

SEQ ID NO: 5901 - DNA, 23 bp, synthetic construct
  misc_feature 1..23: note = Description of Artificial Sequence: Syntheticoligonucleotide
  source 1..23: mol_type = other DNA
tcggactcaatattgagtccgag

SEQ ID NO: 5902 - DNA, 23 bp, synthetic construct
  misc_feature 1..23: note = Description of Artificial Sequence: Syntheticoligonucleotide
  source 1..23: mol_type = other DNA
cctgactcaatattgagtcaggg

SEQ ID NO: 5903 - DNA, 23 bp, synthetic construct
  misc_feature 1..23: note = Description of Artificial Sequence: Syntheticoligonucleotide
  source 1..23: mol_type = other DNA
cacgactcaatattgagtcgtgg

SEQ ID NO: 5904 - DNA, 23 bp, synthetic construct
  misc_feature 1..23: note = Description of Artificial Sequence: Syntheticoligonucleotide
  source 1..23: mol_type = other DNA
gccgactcaatattgagtcggct

SEQ ID NO: 5905 - DNA, 23 bp, synthetic construct
  misc_feature 1..23: note = Description of Artificial Sequence: Syntheticoligonucleotide
  source 1..23: mol_type = other DNA
gccgactcaatattgagtcggca

SEQ ID NO: 5906 - DNA, 23 bp, synthetic construct
  misc_feature 1..23: note = Description of Artificial Sequence: Syntheticoligonucleotide
  source 1..23: mol_type = other DNA
cgagactcaatattgagtctcgc

SEQ ID NO: 5907 - DNA, 23 bp, synthetic construct
  misc_feature 1..23: note = Description of Artificial Sequence: Syntheticoligonucleotide
  source 1..23: mol_type = other DNA
cgtgactcaatattgagtcacgc

SEQ ID NO: 5908 - DNA, 23 bp, synthetic construct
  misc_feature 1..23: note = Description of Artificial Sequence: Syntheticoligonucleotide
  source 1..23: mol_type = other DNA
caggactcaatattgagtcctgc

SEQ ID NO: 5909 - DNA, 23 bp, synthetic construct
  misc_feature 1..23: note = Description of Artificial Sequence: Syntheticoligonucleotide
  source 1..23: mol_type = other DNA
ctggactcaatattgagtccagc

SEQ ID NO: 5910 - DNA, 23 bp, synthetic construct
  misc_feature 1..23: note = Description of Artificial Sequence: Syntheticoligonucleotide
  source 1..23: mol_type = other DNA
gaggactcaatattgagtcctcg

SEQ ID NO: 5911 - DNA, 23 bp, synthetic construct
  misc_feature 1..23: note = Description of Artificial Sequence: Syntheticoligonucleotide
  source 1..23: mol_type = other DNA
gtggactcaatattgagtccacg

SEQ ID NO: 5912 - DNA, 23 bp, synthetic construct
  misc_feature 1..23: note = Description of Artificial Sequence: Syntheticoligonucleotide
  source 1..23: mol_type = other DNA
accgactcaatattgagtcggtg

SEQ ID NO: 5913 - DNA, 23 bp, synthetic construct
  misc_feature 1..23: note = Description of Artificial Sequence: Syntheticoligonucleotide
  source 1..23: mol_type = other DNA
tccgactcaatattgagtcggag

SEQ ID NO: 5914 - DNA, 23 bp, synthetic construct
  misc_feature 1..23: note = Description of Artificial Sequence: Syntheticoligonucleotide
  source 1..23: mol_type = other DNA
cgggactcaatattgagtcccgc

SEQ ID NO: 5915 - DNA, 23 bp, synthetic construct
  misc_feature 1..23: note = Description of Artificial Sequence: Syntheticoligonucleotide
  source 1..23: mol_type = other DNA
agggactcaatattgagtccctc

SEQ ID NO: 5916 - DNA, 23 bp, synthetic construct
  misc_feature 1..23: note = Description of Artificial Sequence: Syntheticoligonucleotide
  source 1..23: mol_type = other DNA
tgggactcaatattgagtcccac

SEQ ID NO: 5917 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcaagcttgagtcnnnn

SEQ ID NO: 5918 - DNA, 23 bp, synthetic construct
  misc_feature 1..23: note = Description of Artificial Sequence: Syntheticoligonucleotide
  source 1..23: mol_type = other DNA
gcggactcaagcttgagtccgcc

SEQ ID NO: 5919 - DNA, 23 bp, synthetic construct
  misc_feature 1..23: note = Description of Artificial Sequence: Syntheticoligonucleotide
  source 1..23: mol_type = other DNA
gcggactcaagcttgagtccgct

SEQ ID NO: 5920 - DNA, 23 bp, synthetic construct
  misc_feature 1..23: note = Description of Artificial Sequence: Syntheticoligonucleotide
  source 1..23: mol_type = other DNA
acggactcaagcttgagtccgtc

SEQ ID NO: 5921 - DNA, 23 bp, synthetic construct
  misc_feature 1..23: note = Description of Artificial Sequence: Syntheticoligonucleotide
  source 1..23: mol_type = other DNA
gaggactcaagcttgagtcctcc

SEQ ID NO: 5922 - DNA, 23 bp, synthetic construct
  misc_feature 1..23: note = Description of Artificial Sequence: Syntheticoligonucleotide
  source 1..23: mol_type = other DNA
gcagactcaagcttgagtctgcc

SEQ ID NO: 5923 - DNA, 23 bp, synthetic construct
  misc_feature 1..23: note = Description of Artificial Sequence: Syntheticoligonucleotide
  source 1..23: mol_type = other DNA
gcggactcaagcttgagtccgca

SEQ ID NO: 5924 - DNA, 23 bp, synthetic construct
  misc_feature 1..23: note = Description of Artificial Sequence: Syntheticoligonucleotide
  source 1..23: mol_type = other DNA
tcggactcaagcttgagtccgac

SEQ ID NO: 5925 - DNA, 23 bp, synthetic construct
  misc_feature 1..23: note = Description of Artificial Sequence: Syntheticoligonucleotide
  source 1..23: mol_type = other DNA
gtggactcaagcttgagtccacc

SEQ ID NO: 5926 - DNA, 23 bp, synthetic construct
  misc_feature 1..23: note = Description of Artificial Sequence: Syntheticoligonucleotide
  source 1..23: mol_type = other DNA
gctgactcaagcttgagtcagcc

SEQ ID NO: 5927 - DNA, 23 bp, synthetic construct
  misc_feature 1..23: note = Description of Artificial Sequence: Syntheticoligonucleotide
  source 1..23: mol_type = other DNA
cccgactcaagcttgagtcgggc

SEQ ID NO: 5928 - DNA, 23 bp, synthetic construct
  misc_feature 1..23: note = Description of Artificial Sequence: Syntheticoligonucleotide
  source 1..23: mol_type = other DNA
cccgactcaagcttgagtcgggt

SEQ ID NO: 5929 - DNA, 23 bp, synthetic construct
  misc_feature 1..23: note = Description of Artificial Sequence: Syntheticoligonucleotide
  source 1..23: mol_type = other DNA
accgactcaagcttgagtcggtc

SEQ ID NO: 5930 - DNA, 23 bp, synthetic construct
  misc_feature 1..23: note = Description of Artificial Sequence: Syntheticoligonucleotide
  source 1..23: mol_type = other DNA
cacgactcaagcttgagtcgtgc

SEQ ID NO: 5931 - DNA, 23 bp, synthetic construct
  misc_feature 1..23: note = Description of Artificial Sequence: Syntheticoligonucleotide
  source 1..23: mol_type = other DNA
ccagactcaagcttgagtctggc

SEQ ID NO: 5932 - DNA, 23 bp, synthetic construct
  misc_feature 1..23: note = Description of Artificial Sequence: Syntheticoligonucleotide
  source 1..23: mol_type = other DNA
cccgactcaagcttgagtcggga

SEQ ID NO: 5933 - DNA, 23 bp, synthetic construct
  misc_feature 1..23: note = Description of Artificial Sequence: Syntheticoligonucleotide
  source 1..23: mol_type = other DNA
tccgactcaagcttgagtcggac

SEQ ID NO: 5934 - DNA, 23 bp, synthetic construct
  misc_feature 1..23: note = Description of Artificial Sequence: Syntheticoligonucleotide
  source 1..23: mol_type = other DNA
cctgactcaagcttgagtcaggc

SEQ ID NO: 5935 - DNA, 23 bp, synthetic construct
  misc_feature 1..23: note = Description of Artificial Sequence: Syntheticoligonucleotide
  source 1..23: mol_type = other DNA
ggcgactcaagcttgagtcgccc

SEQ ID NO: 5936 - DNA, 23 bp, synthetic construct
  misc_feature 1..23: note = Description of Artificial Sequence: Syntheticoligonucleotide
  source 1..23: mol_type = other DNA
ggcgactcaagcttgagtcgcct

SEQ ID NO: 5937 - DNA, 23 bp, synthetic construct
  misc_feature 1..23: note = Description of Artificial Sequence: Syntheticoligonucleotide
  source 1..23: mol_type = other DNA
agcgactcaagcttgagtcgctc

SEQ ID NO: 5938 - DNA, 23 bp, synthetic construct
  misc_feature 1..23: note = Description of Artificial Sequence: Syntheticoligonucleotide
  source 1..23: mol_type = other DNA
gacgactcaagcttgagtcgtcc

SEQ ID NO: 5939 - DNA, 23 bp, synthetic construct
  misc_feature 1..23: note = Description of Artificial Sequence: Syntheticoligonucleotide
  source 1..23: mol_type = other DNA
ggagactcaagcttgagtctccc

SEQ ID NO: 5940 - DNA, 23 bp, synthetic construct
  misc_feature 1..23: note = Description of Artificial Sequence: Syntheticoligonucleotide
  source 1..23: mol_type = other DNA
ggcgactcaagcttgagtcgcca

SEQ ID NO: 5941 - DNA, 23 bp, synthetic construct
  misc_feature 1..23: note = Description of Artificial Sequence: Syntheticoligonucleotide
  source 1..23: mol_type = other DNA
tgcgactcaagcttgagtcgcac

SEQ ID NO: 5942 - DNA, 23 bp, synthetic construct
  misc_feature 1..23: note = Description of Artificial Sequence: Syntheticoligonucleotide
  source 1..23: mol_type = other DNA
ggtgactcaagcttgagtcaccc

SEQ ID NO: 5943 - DNA, 23 bp, synthetic construct
  misc_feature 1..23: note = Description of Artificial Sequence: Syntheticoligonucleotide
  source 1..23: mol_type = other DNA
cgggactcaagcttgagtcccgt

SEQ ID NO: 5944 - DNA, 23 bp, synthetic construct
  misc_feature 1..23: note = Description of Artificial Sequence: Syntheticoligonucleotide
  source 1..23: mol_type = other DNA
agggactcaagcttgagtccctg

SEQ ID NO: 5945 - DNA, 23 bp, synthetic construct
  misc_feature 1..23: note = Description of Artificial Sequence: Syntheticoligonucleotide
  source 1..23: mol_type = other DNA
caggactcaagcttgagtcctgg

SEQ ID NO: 5946 - DNA, 23 bp, synthetic construct
  misc_feature 1..23: note = Description of Artificial Sequence: Syntheticoligonucleotide
  source 1..23: mol_type = other DNA
cgagactcaagcttgagtctcgg

SEQ ID NO: 5947 - DNA, 23 bp, synthetic construct
  misc_feature 1..23: note = Description of Artificial Sequence: Syntheticoligonucleotide
  source 1..23: mol_type = other DNA
cgggactcaagcttgagtcccga

SEQ ID NO: 5948 - DNA, 23 bp, synthetic construct
  misc_feature 1..23: note = Description of Artificial Sequence: Syntheticoligonucleotide
  source 1..23: mol_type = other DNA
tgggactcaagcttgagtcccag

SEQ ID NO: 5949 - DNA, 23 bp, synthetic construct
  misc_feature 1..23: note = Description of Artificial Sequence: Syntheticoligonucleotide
  source 1..23: mol_type = other DNA
ctggactcaagcttgagtccagg

SEQ ID NO: 5950 - DNA, 23 bp, synthetic construct
  misc_feature 1..23: note = Description of Artificial Sequence: Syntheticoligonucleotide
  source 1..23: mol_type = other DNA
cgtgactcaagcttgagtcacgg

SEQ ID NO: 5951 - DNA, 23 bp, synthetic construct
  misc_feature 1..23: note = Description of Artificial Sequence: Syntheticoligonucleotide
  source 1..23: mol_type = other DNA
ggcgactcaagcttgagtcgccg

SEQ ID NO: 5952 - DNA, 23 bp, synthetic construct
  misc_feature 1..23: note = Description of Artificial Sequence: Syntheticoligonucleotide
  source 1..23: mol_type = other DNA
agcgactcaagcttgagtcgctg

SEQ ID NO: 5953 - DNA, 23 bp, synthetic construct
  misc_feature 1..23: note = Description of Artificial Sequence: Syntheticoligonucleotide
  source 1..23: mol_type = other DNA
gacgactcaagcttgagtcgtcg

SEQ ID NO: 5954 - DNA, 23 bp, synthetic construct
  misc_feature 1..23: note = Description of Artificial Sequence: Syntheticoligonucleotide
  source 1..23: mol_type = other DNA
ggagactcaagcttgagtctccg

SEQ ID NO: 5955 - DNA, 23 bp, synthetic construct
  misc_feature 1..23: note = Description of Artificial Sequence: Syntheticoligonucleotide
  source 1..23: mol_type = other DNA
tgcgactcaagcttgagtcgcag

SEQ ID NO: 5956 - DNA, 23 bp, synthetic construct
  misc_feature 1..23: note = Description of Artificial Sequence: Syntheticoligonucleotide
  source 1..23: mol_type = other DNA
ggtgactcaagcttgagtcaccg

SEQ ID NO: 5957 - DNA, 23 bp, synthetic construct
  misc_feature 1..23: note = Description of Artificial Sequence: Syntheticoligonucleotide
  source 1..23: mol_type = other DNA
acggactcaagcttgagtccgtg

SEQ ID NO: 5958 - DNA, 23 bp, synthetic construct
  misc_feature 1..23: note = Description of Artificial Sequence: Syntheticoligonucleotide
  source 1..23: mol_type = other DNA
ccagactcaagcttgagtctggg

SEQ ID NO: 5959 - DNA, 23 bp, synthetic construct
  misc_feature 1..23: note = Description of Artificial Sequence: Syntheticoligonucleotide
  source 1..23: mol_type = other DNA
tcggactcaagcttgagtccgag

SEQ ID NO: 5960 - DNA, 23 bp, synthetic construct
  misc_feature 1..23: note = Description of Artificial Sequence: Syntheticoligonucleotide
  source 1..23: mol_type = other DNA
cctgactcaagcttgagtcaggg

SEQ ID NO: 5961 - DNA, 23 bp, synthetic construct
  misc_feature 1..23: note = Description of Artificial Sequence: Syntheticoligonucleotide
  source 1..23: mol_type = other DNA
cacgactcaagcttgagtcgtgg

SEQ ID NO: 5962 - DNA, 23 bp, synthetic construct
  misc_feature 1..23: note = Description of Artificial Sequence: Syntheticoligonucleotide
  source 1..23: mol_type = other DNA
gccgactcaagcttgagtcggct

SEQ ID NO: 5963 - DNA, 23 bp, synthetic construct
  misc_feature 1..23: note = Description of Artificial Sequence: Syntheticoligonucleotide
  source 1..23: mol_type = other DNA
gccgactcaagcttgagtcggca

SEQ ID NO: 5964 - DNA, 23 bp, synthetic construct
  misc_feature 1..23: note = Description of Artificial Sequence: Syntheticoligonucleotide
  source 1..23: mol_type = other DNA
cgagactcaagcttgagtctcgc

SEQ ID NO: 5965 - DNA, 23 bp, synthetic construct
  misc_feature 1..23: note = Description of Artificial Sequence: Syntheticoligonucleotide
  source 1..23: mol_type = other DNA
cgtgactcaagcttgagtcacgc

SEQ ID NO: 5966 - DNA, 23 bp, synthetic construct
  misc_feature 1..23: note = Description of Artificial Sequence: Syntheticoligonucleotide
  source 1..23: mol_type = other DNA
caggactcaagcttgagtcctgc

SEQ ID NO: 5967 - DNA, 23 bp, synthetic construct
  misc_feature 1..23: note = Description of Artificial Sequence: Syntheticoligonucleotide
  source 1..23: mol_type = other DNA
ctggactcaagcttgagtccagc

SEQ ID NO: 5968 - DNA, 23 bp, synthetic construct
  misc_feature 1..23: note = Description of Artificial Sequence: Syntheticoligonucleotide
  source 1..23: mol_type = other DNA
gaggactcaagcttgagtcctcg

SEQ ID NO: 5969 - DNA, 23 bp, synthetic construct
  misc_feature 1..23: note = Description of Artificial Sequence: Syntheticoligonucleotide
  source 1..23: mol_type = other DNA
gtggactcaagcttgagtccacg

SEQ ID NO: 5970 - DNA, 23 bp, synthetic construct
  misc_feature 1..23: note = Description of Artificial Sequence: Syntheticoligonucleotide
  source 1..23: mol_type = other DNA
accgactcaagcttgagtcggtg

SEQ ID NO: 5971 - DNA, 23 bp, synthetic construct
  misc_feature 1..23: note = Description of Artificial Sequence: Syntheticoligonucleotide
  source 1..23: mol_type = other DNA
tccgactcaagcttgagtcggag

SEQ ID NO: 5972 - DNA, 23 bp, synthetic construct
  misc_feature 1..23: note = Description of Artificial Sequence: Syntheticoligonucleotide
  source 1..23: mol_type = other DNA
cgggactcaagcttgagtcccgc

SEQ ID NO: 5973 - DNA, 23 bp, synthetic construct
  misc_feature 1..23: note = Description of Artificial Sequence: Syntheticoligonucleotide
  source 1..23: mol_type = other DNA
agggactcaagcttgagtccctc

SEQ ID NO: 5974 - DNA, 23 bp, synthetic construct
  misc_feature 1..23: note = Description of Artificial Sequence: Syntheticoligonucleotide
  source 1..23: mol_type = other DNA
tgggactcaagcttgagtcccac

SEQ ID NO: 5975 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcaacgttgagtcnnnn

SEQ ID NO: 5976 - DNA, 23 bp, synthetic construct
  misc_feature 1..23: note = Description of Artificial Sequence: Syntheticoligonucleotide
  source 1..23: mol_type = other DNA
gcggactcaacgttgagtccgcc

SEQ ID NO: 5977 - DNA, 23 bp, synthetic construct
  misc_feature 1..23: note = Description of Artificial Sequence: Syntheticoligonucleotide
  source 1..23: mol_type = other DNA
gcggactcaacgttgagtccgct

SEQ ID NO: 5978 - DNA, 23 bp, synthetic construct
  misc_feature 1..23: note = Description of Artificial Sequence: Syntheticoligonucleotide
  source 1..23: mol_type = other DNA
acggactcaacgttgagtccgtc

SEQ ID NO: 5979 - DNA, 23 bp, synthetic construct
  misc_feature 1..23: note = Description of Artificial Sequence: Syntheticoligonucleotide
  source 1..23: mol_type = other DNA
gaggactcaacgttgagtcctcc

SEQ ID NO: 5980 - DNA, 23 bp, synthetic construct
  misc_feature 1..23: note = Description of Artificial Sequence: Syntheticoligonucleotide
  source 1..23: mol_type = other DNA
gcagactcaacgttgagtctgcc

SEQ ID NO: 5981 - DNA, 23 bp, synthetic construct
  misc_feature 1..23: note = Description of Artificial Sequence: Syntheticoligonucleotide
  source 1..23: mol_type = other DNA
gcggactcaacgttgagtccgca

SEQ ID NO: 5982 - DNA, 23 bp, synthetic construct
  misc_feature 1..23: note = Description of Artificial Sequence: Syntheticoligonucleotide
  source 1..23: mol_type = other DNA
tcggactcaacgttgagtccgac

SEQ ID NO: 5983 - DNA, 23 bp, synthetic construct
  misc_feature 1..23: note = Description of Artificial Sequence: Syntheticoligonucleotide
  source 1..23: mol_type = other DNA
gtggactcaacgttgagtccacc

SEQ ID NO: 5984 - DNA, 23 bp, synthetic construct
  misc_feature 1..23: note = Description of Artificial Sequence: Syntheticoligonucleotide
  source 1..23: mol_type = other DNA
gctgactcaacgttgagtcagcc

SEQ ID NO: 5985 - DNA, 23 bp, synthetic construct
  misc_feature 1..23: note = Description of Artificial Sequence: Syntheticoligonucleotide
  source 1..23: mol_type = other DNA
cccgactcaacgttgagtcgggc

SEQ ID NO: 5986 - DNA, 23 bp, synthetic construct
  misc_feature 1..23: note = Description of Artificial Sequence: Syntheticoligonucleotide
  source 1..23: mol_type = other DNA
cccgactcaacgttgagtcgggt

SEQ ID NO: 5987 - DNA, 23 bp, synthetic construct
  misc_feature 1..23: note = Description of Artificial Sequence: Syntheticoligonucleotide
  source 1..23: mol_type = other DNA
accgactcaacgttgagtcggtc

SEQ ID NO: 5988 - DNA, 23 bp, synthetic construct
  misc_feature 1..23: note = Description of Artificial Sequence: Syntheticoligonucleotide
  source 1..23: mol_type = other DNA
cacgactcaacgttgagtcgtgc

SEQ ID NO: 5989 - DNA, 23 bp, synthetic construct
  misc_feature 1..23: note = Description of Artificial Sequence: Syntheticoligonucleotide
  source 1..23: mol_type = other DNA
ccagactcaacgttgagtctggc

SEQ ID NO: 5990 - DNA, 23 bp, synthetic construct
  misc_feature 1..23: note = Description of Artificial Sequence: Syntheticoligonucleotide
  source 1..23: mol_type = other DNA
cccgactcaacgttgagtcggga

SEQ ID NO: 5991 - DNA, 23 bp, synthetic construct
  misc_feature 1..23: note = Description of Artificial Sequence: Syntheticoligonucleotide
  source 1..23: mol_type = other DNA
tccgactcaacgttgagtcggac

SEQ ID NO: 5992 - DNA, 23 bp, synthetic construct
  misc_feature 1..23: note = Description of Artificial Sequence: Syntheticoligonucleotide
  source 1..23: mol_type = other DNA
cctgactcaacgttgagtcaggc

SEQ ID NO: 5993 - DNA, 23 bp, synthetic construct
  misc_feature 1..23: note = Description of Artificial Sequence: Syntheticoligonucleotide
  source 1..23: mol_type = other DNA
ggcgactcaacgttgagtcgccc

SEQ ID NO: 5994 - DNA, 23 bp, synthetic construct
  misc_feature 1..23: note = Description of Artificial Sequence: Syntheticoligonucleotide
  source 1..23: mol_type = other DNA
ggcgactcaacgttgagtcgcct

SEQ ID NO: 5995 - DNA, 23 bp, synthetic construct
  misc_feature 1..23: note = Description of Artificial Sequence: Syntheticoligonucleotide
  source 1..23: mol_type = other DNA
agcgactcaacgttgagtcgctc

SEQ ID NO: 5996 - DNA, 23 bp, synthetic construct
  misc_feature 1..23: note = Description of Artificial Sequence: Syntheticoligonucleotide
  source 1..23: mol_type = other DNA
gacgactcaacgttgagtcgtcc

SEQ ID NO: 5997 - DNA, 23 bp, synthetic construct
  misc_feature 1..23: note = Description of Artificial Sequence: Syntheticoligonucleotide
  source 1..23: mol_type = other DNA
ggagactcaacgttgagtctccc

SEQ ID NO: 5998 - DNA, 23 bp, synthetic construct
  misc_feature 1..23: note = Description of Artificial Sequence: Syntheticoligonucleotide
  source 1..23: mol_type = other DNA
ggcgactcaacgttgagtcgcca

SEQ ID NO: 5999 - DNA, 23 bp, synthetic construct
  misc_feature 1..23: note = Description of Artificial Sequence: Syntheticoligonucleotide
  source 1..23: mol_type = other DNA
tgcgactcaacgttgagtcgcac

SEQ ID NO: 6000 - DNA, 23 bp, synthetic construct
  misc_feature 1..23: note = Description of Artificial Sequence: Syntheticoligonucleotide
  source 1..23: mol_type = other DNA
ggtgactcaacgttgagtcaccc

SEQ ID NO: 6001 - DNA, 23 bp, synthetic construct
  misc_feature 1..23: note = Description of Artificial Sequence: Syntheticoligonucleotide
  source 1..23: mol_type = other DNA
cgggactcaacgttgagtcccgt

SEQ ID NO: 6002 - DNA, 23 bp, synthetic construct
  misc_feature 1..23: note = Description of Artificial Sequence: Syntheticoligonucleotide
  source 1..23: mol_type = other DNA
agggactcaacgttgagtccctg

SEQ ID NO: 6003 - DNA, 23 bp, synthetic construct
  misc_feature 1..23: note = Description of Artificial Sequence: Syntheticoligonucleotide
  source 1..23: mol_type = other DNA
caggactcaacgttgagtcctgg

SEQ ID NO: 6004 - DNA, 23 bp, synthetic construct
  misc_feature 1..23: note = Description of Artificial Sequence: Syntheticoligonucleotide
  source 1..23: mol_type = other DNA
cgagactcaacgttgagtctcgg

SEQ ID NO: 6005 - DNA, 23 bp, synthetic construct
  misc_feature 1..23: note = Description of Artificial Sequence: Syntheticoligonucleotide
  source 1..23: mol_type = other DNA
cgggactcaacgttgagtcccga

SEQ ID NO: 6006 - DNA, 23 bp, synthetic construct
  misc_feature 1..23: note = Description of Artificial Sequence: Syntheticoligonucleotide
  source 1..23: mol_type = other DNA
tgggactcaacgttgagtcccag

SEQ ID NO: 6007 - DNA, 23 bp, synthetic construct
  misc_feature 1..23: note = Description of Artificial Sequence: Syntheticoligonucleotide
  source 1..23: mol_type = other DNA
ctggactcaacgttgagtccagg

SEQ ID NO: 6008 - DNA, 23 bp, synthetic construct
  misc_feature 1..23: note = Description of Artificial Sequence: Syntheticoligonucleotide
  source 1..23: mol_type = other DNA
cgtgactcaacgttgagtcacgg

SEQ ID NO: 6009 - DNA, 23 bp, synthetic construct
  misc_feature 1..23: note = Description of Artificial Sequence: Syntheticoligonucleotide
  source 1..23: mol_type = other DNA
ggcgactcaacgttgagtcgccg

SEQ ID NO: 6010 - DNA, 23 bp, synthetic construct
  misc_feature 1..23: note = Description of Artificial Sequence: Syntheticoligonucleotide
  source 1..23: mol_type = other DNA
agcgactcaacgttgagtcgctg

SEQ ID NO: 6011 - DNA, 23 bp, synthetic construct
  misc_feature 1..23: note = Description of Artificial Sequence: Syntheticoligonucleotide
  source 1..23: mol_type = other DNA
gacgactcaacgttgagtcgtcg

SEQ ID NO: 6012 - DNA, 23 bp, synthetic construct
  misc_feature 1..23: note = Description of Artificial Sequence: Syntheticoligonucleotide
  source 1..23: mol_type = other DNA
ggagactcaacgttgagtctccg

SEQ ID NO: 6013 - DNA, 23 bp, synthetic construct
  misc_feature 1..23: note = Description of Artificial Sequence: Syntheticoligonucleotide
  source 1..23: mol_type = other DNA
tgcgactcaacgttgagtcgcag

SEQ ID NO: 6014 - DNA, 23 bp, synthetic construct
  misc_feature 1..23: note = Description of Artificial Sequence: Syntheticoligonucleotide
  source 1..23: mol_type = other DNA
ggtgactcaacgttgagtcaccg

SEQ ID NO: 6015 - DNA, 23 bp, synthetic construct
  misc_feature 1..23: note = Description of Artificial Sequence: Syntheticoligonucleotide
  source 1..23: mol_type = other DNA
acggactcaacgttgagtccgtg

SEQ ID NO: 6016 - DNA, 23 bp, synthetic construct
  misc_feature 1..23: note = Description of Artificial Sequence: Syntheticoligonucleotide
  source 1..23: mol_type = other DNA
ccagactcaacgttgagtctggg

SEQ ID NO: 6017 - DNA, 23 bp, synthetic construct
  misc_feature 1..23: note = Description of Artificial Sequence: Syntheticoligonucleotide
  source 1..23: mol_type = other DNA
tcggactcaacgttgagtccgag

SEQ ID NO: 6018 - DNA, 23 bp, synthetic construct
  misc_feature 1..23: note = Description of Artificial Sequence: Syntheticoligonucleotide
  source 1..23: mol_type = other DNA
cctgactcaacgttgagtcaggg

SEQ ID NO: 6019 - DNA, 23 bp, synthetic construct
  misc_feature 1..23: note = Description of Artificial Sequence: Syntheticoligonucleotide
  source 1..23: mol_type = other DNA
cacgactcaacgttgagtcgtgg

SEQ ID NO: 6020 - DNA, 23 bp, synthetic construct
  misc_feature 1..23: note = Description of Artificial Sequence: Syntheticoligonucleotide
  source 1..23: mol_type = other DNA
gccgactcaacgttgagtcggct

SEQ ID NO: 6021 - DNA, 23 bp, synthetic construct
  misc_feature 1..23: note = Description of Artificial Sequence: Syntheticoligonucleotide
  source 1..23: mol_type = other DNA
gccgactcaacgttgagtcggca

SEQ ID NO: 6022 - DNA, 23 bp, synthetic construct
  misc_feature 1..23: note = Description of Artificial Sequence: Syntheticoligonucleotide
  source 1..23: mol_type = other DNA
cgagactcaacgttgagtctcgc

SEQ ID NO: 6023 - DNA, 23 bp, synthetic construct
  misc_feature 1..23: note = Description of Artificial Sequence: Syntheticoligonucleotide
  source 1..23: mol_type = other DNA
cgtgactcaacgttgagtcacgc

SEQ ID NO: 6024 - DNA, 23 bp, synthetic construct
  misc_feature 1..23: note = Description of Artificial Sequence: Syntheticoligonucleotide
  source 1..23: mol_type = other DNA
caggactcaacgttgagtcctgc

SEQ ID NO: 6025 - DNA, 23 bp, synthetic construct
  misc_feature 1..23: note = Description of Artificial Sequence: Syntheticoligonucleotide
  source 1..23: mol_type = other DNA
ctggactcaacgttgagtccagc

SEQ ID NO: 6026 - DNA, 23 bp, synthetic construct
  misc_feature 1..23: note = Description of Artificial Sequence: Syntheticoligonucleotide
  source 1..23: mol_type = other DNA
gaggactcaacgttgagtcctcg

SEQ ID NO: 6027 - DNA, 23 bp, synthetic construct
  misc_feature 1..23: note = Description of Artificial Sequence: Syntheticoligonucleotide
  source 1..23: mol_type = other DNA
gtggactcaacgttgagtccacg

SEQ ID NO: 6028 - DNA, 23 bp, synthetic construct
  misc_feature 1..23: note = Description of Artificial Sequence: Syntheticoligonucleotide
  source 1..23: mol_type = other DNA
accgactcaacgttgagtcggtg

SEQ ID NO: 6029 - DNA, 23 bp, synthetic construct
  misc_feature 1..23: note = Description of Artificial Sequence: Syntheticoligonucleotide
  source 1..23: mol_type = other DNA
tccgactcaacgttgagtcggag

SEQ ID NO: 6030 - DNA, 23 bp, synthetic construct
  misc_feature 1..23: note = Description of Artificial Sequence: Syntheticoligonucleotide
  source 1..23: mol_type = other DNA
cgggactcaacgttgagtcccgc

SEQ ID NO: 6031 - DNA, 23 bp, synthetic construct
  misc_feature 1..23: note = Description of Artificial Sequence: Syntheticoligonucleotide
  source 1..23: mol_type = other DNA
agggactcaacgttgagtccctc

SEQ ID NO: 6032 - DNA, 23 bp, synthetic construct
  misc_feature 1..23: note = Description of Artificial Sequence: Syntheticoligonucleotide
  source 1..23: mol_type = other DNA
tgggactcaacgttgagtcccac

SEQ ID NO: 6033 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactctaattagagtcnnnn

SEQ ID NO: 6034 - DNA, 23 bp, synthetic construct
  misc_feature 1..23: note = Description of Artificial Sequence: Syntheticoligonucleotide
  source 1..23: mol_type = other DNA
gcggactctaattagagtccgcc

SEQ ID NO: 6035 - DNA, 23 bp, synthetic construct
  misc_feature 1..23: note = Description of Artificial Sequence: Syntheticoligonucleotide
  source 1..23: mol_type = other DNA
gcggactctaattagagtccgct

SEQ ID NO: 6036 - DNA, 23 bp, synthetic construct
  misc_feature 1..23: note = Description of Artificial Sequence: Syntheticoligonucleotide
  source 1..23: mol_type = other DNA
acggactctaattagagtccgtc

SEQ ID NO: 6037 - DNA, 23 bp, synthetic construct
  misc_feature 1..23: note = Description of Artificial Sequence: Syntheticoligonucleotide
  source 1..23: mol_type = other DNA
gaggactctaattagagtcctcc

SEQ ID NO: 6038 - DNA, 23 bp, synthetic construct
  misc_feature 1..23: note = Description of Artificial Sequence: Syntheticoligonucleotide
  source 1..23: mol_type = other DNA
gcagactctaattagagtctgcc

SEQ ID NO: 6039 - DNA, 23 bp, synthetic construct
  misc_feature 1..23: note = Description of Artificial Sequence: Syntheticoligonucleotide
  source 1..23: mol_type = other DNA
gcggactctaattagagtccgca

SEQ ID NO: 6040 - DNA, 23 bp, synthetic construct
  misc_feature 1..23: note = Description of Artificial Sequence: Syntheticoligonucleotide
  source 1..23: mol_type = other DNA
tcggactctaattagagtccgac

SEQ ID NO: 6041 - DNA, 23 bp, synthetic construct
  misc_feature 1..23: note = Description of Artificial Sequence: Syntheticoligonucleotide
  source 1..23: mol_type = other DNA
gtggactctaattagagtccacc

SEQ ID NO: 6042 - DNA, 23 bp, synthetic construct
  misc_feature 1..23: note = Description of Artificial Sequence: Syntheticoligonucleotide
  source 1..23: mol_type = other DNA
gctgactctaattagagtcagcc

SEQ ID NO: 6043 - DNA, 23 bp, synthetic construct
  misc_feature 1..23: note = Description of Artificial Sequence: Syntheticoligonucleotide
  source 1..23: mol_type = other DNA
cccgactctaattagagtcgggc

SEQ ID NO: 6044 - DNA, 23 bp, synthetic construct
  misc_feature 1..23: note = Description of Artificial Sequence: Syntheticoligonucleotide
  source 1..23: mol_type = other DNA
cccgactctaattagagtcgggt

SEQ ID NO: 6045 - DNA, 23 bp, synthetic construct
  misc_feature 1..23: note = Description of Artificial Sequence: Syntheticoligonucleotide
  source 1..23: mol_type = other DNA
accgactctaattagagtcggtc

SEQ ID NO: 6046 - DNA, 23 bp, synthetic construct
  misc_feature 1..23: note = Description of Artificial Sequence: Syntheticoligonucleotide
  source 1..23: mol_type = other DNA
cacgactctaattagagtcgtgc

SEQ ID NO: 6047 - DNA, 23 bp, synthetic construct
  misc_feature 1..23: note = Description of Artificial Sequence: Syntheticoligonucleotide
  source 1..23: mol_type = other DNA
ccagactctaattagagtctggc

SEQ ID NO: 6048 - DNA, 23 bp, synthetic construct
  misc_feature 1..23: note = Description of Artificial Sequence: Syntheticoligonucleotide
  source 1..23: mol_type = other DNA
cccgactctaattagagtcggga

SEQ ID NO: 6049 - DNA, 23 bp, synthetic construct
  misc_feature 1..23: note = Description of Artificial Sequence: Syntheticoligonucleotide
  source 1..23: mol_type = other DNA
tccgactctaattagagtcggac

SEQ ID NO: 6050 - DNA, 23 bp, synthetic construct
  misc_feature 1..23: note = Description of Artificial Sequence: Syntheticoligonucleotide
  source 1..23: mol_type = other DNA
cctgactctaattagagtcaggc

SEQ ID NO: 6051 - DNA, 23 bp, synthetic construct
  misc_feature 1..23: note = Description of Artificial Sequence: Syntheticoligonucleotide
  source 1..23: mol_type = other DNA
ggcgactctaattagagtcgccc

SEQ ID NO: 6052 - DNA, 23 bp, synthetic construct
  misc_feature 1..23: note = Description of Artificial Sequence: Syntheticoligonucleotide
  source 1..23: mol_type = other DNA
ggcgactctaattagagtcgcct

SEQ ID NO: 6053 - DNA, 23 bp, synthetic construct
  misc_feature 1..23: note = Description of Artificial Sequence: Syntheticoligonucleotide
  source 1..23: mol_type = other DNA
agcgactctaattagagtcgctc

SEQ ID NO: 6054 - DNA, 23 bp, synthetic construct
  misc_feature 1..23: note = Description of Artificial Sequence: Syntheticoligonucleotide
  source 1..23: mol_type = other DNA
gacgactctaattagagtcgtcc

SEQ ID NO: 6055 - DNA, 23 bp, synthetic construct
  misc_feature 1..23: note = Description of Artificial Sequence: Syntheticoligonucleotide
  source 1..23: mol_type = other DNA
ggagactctaattagagtctccc

SEQ ID NO: 6056 - DNA, 23 bp, synthetic construct
  misc_feature 1..23: note = Description of Artificial Sequence: Syntheticoligonucleotide
  source 1..23: mol_type = other DNA
ggcgactctaattagagtcgcca

SEQ ID NO: 6057 - DNA, 23 bp, synthetic construct
  misc_feature 1..23: note = Description of Artificial Sequence: Syntheticoligonucleotide
  source 1..23: mol_type = other DNA
tgcgactctaattagagtcgcac

SEQ ID NO: 6058 - DNA, 23 bp, synthetic construct
  misc_feature 1..23: note = Description of Artificial Sequence: Syntheticoligonucleotide
  source 1..23: mol_type = other DNA
ggtgactctaattagagtcaccc

SEQ ID NO: 6059 - DNA, 23 bp, synthetic construct
  misc_feature 1..23: note = Description of Artificial Sequence: Syntheticoligonucleotide
  source 1..23: mol_type = other DNA
cgggactctaattagagtcccgt

SEQ ID NO: 6060 - DNA, 23 bp, synthetic construct
  misc_feature 1..23: note = Description of Artificial Sequence: Syntheticoligonucleotide
  source 1..23: mol_type = other DNA
agggactctaattagagtccctg

SEQ ID NO: 6061 - DNA, 23 bp, synthetic construct
  misc_feature 1..23: note = Description of Artificial Sequence: Syntheticoligonucleotide
  source 1..23: mol_type = other DNA
caggactctaattagagtcctgg

SEQ ID NO: 6062 - DNA, 23 bp, synthetic construct
  misc_feature 1..23: note = Description of Artificial Sequence: Syntheticoligonucleotide
  source 1..23: mol_type = other DNA
cgagactctaattagagtctcgg

SEQ ID NO: 6063 - DNA, 23 bp, synthetic construct
  misc_feature 1..23: note = Description of Artificial Sequence: Syntheticoligonucleotide
  source 1..23: mol_type = other DNA
cgggactctaattagagtcccga

SEQ ID NO: 6064 - DNA, 23 bp, synthetic construct
  misc_feature 1..23: note = Description of Artificial Sequence: Syntheticoligonucleotide
  source 1..23: mol_type = other DNA
tgggactctaattagagtcccag

SEQ ID NO: 6065 - DNA, 23 bp, synthetic construct
  misc_feature 1..23: note = Description of Artificial Sequence: Syntheticoligonucleotide
  source 1..23: mol_type = other DNA
ctggactctaattagagtccagg

SEQ ID NO: 6066 - DNA, 23 bp, synthetic construct
  misc_feature 1..23: note = Description of Artificial Sequence: Syntheticoligonucleotide
  source 1..23: mol_type = other DNA
cgtgactctaattagagtcacgg

SEQ ID NO: 6067 - DNA, 23 bp, synthetic construct
  misc_feature 1..23: note = Description of Artificial Sequence: Syntheticoligonucleotide
  source 1..23: mol_type = other DNA
ggcgactctaattagagtcgccg

SEQ ID NO: 6068 - DNA, 23 bp, synthetic construct
  misc_feature 1..23: note = Description of Artificial Sequence: Syntheticoligonucleotide
  source 1..23: mol_type = other DNA
agcgactctaattagagtcgctg

SEQ ID NO: 6069 - DNA, 23 bp, synthetic construct
  misc_feature 1..23: note = Description of Artificial Sequence: Syntheticoligonucleotide
  source 1..23: mol_type = other DNA
gacgactctaattagagtcgtcg

SEQ ID NO: 6070 - DNA, 23 bp, synthetic construct
  misc_feature 1..23: note = Description of Artificial Sequence: Syntheticoligonucleotide
  source 1..23: mol_type = other DNA
ggagactctaattagagtctccg

SEQ ID NO: 6071 - DNA, 23 bp, synthetic construct
  misc_feature 1..23: note = Description of Artificial Sequence: Syntheticoligonucleotide
  source 1..23: mol_type = other DNA
tgcgactctaattagagtcgcag

SEQ ID NO: 6072 - DNA, 23 bp, synthetic construct
  misc_feature 1..23: note = Description of Artificial Sequence: Syntheticoligonucleotide
  source 1..23: mol_type = other DNA
ggtgactctaattagagtcaccg

SEQ ID NO: 6073 - DNA, 23 bp, synthetic construct
  misc_feature 1..23: note = Description of Artificial Sequence: Syntheticoligonucleotide
  source 1..23: mol_type = other DNA
acggactctaattagagtccgtg

SEQ ID NO: 6074 - DNA, 23 bp, synthetic construct
  misc_feature 1..23: note = Description of Artificial Sequence: Syntheticoligonucleotide
  source 1..23: mol_type = other DNA
ccagactctaattagagtctggg

SEQ ID NO: 6075 - DNA, 23 bp, synthetic construct
  misc_feature 1..23: note = Description of Artificial Sequence: Syntheticoligonucleotide
  source 1..23: mol_type = other DNA
tcggactctaattagagtccgag

SEQ ID NO: 6076 - DNA, 23 bp, synthetic construct
  misc_feature 1..23: note = Description of Artificial Sequence: Syntheticoligonucleotide
  source 1..23: mol_type = other DNA
cctgactctaattagagtcaggg

SEQ ID NO: 6077 - DNA, 23 bp, synthetic construct
  misc_feature 1..23: note = Description of Artificial Sequence: Syntheticoligonucleotide
  source 1..23: mol_type = other DNA
cacgactctaattagagtcgtgg

SEQ ID NO: 6078 - DNA, 23 bp, synthetic construct
  misc_feature 1..23: note = Description of Artificial Sequence: Syntheticoligonucleotide
  source 1..23: mol_type = other DNA
gccgactctaattagagtcggct

SEQ ID NO: 6079 - DNA, 23 bp, synthetic construct
  misc_feature 1..23: note = Description of Artificial Sequence: Syntheticoligonucleotide
  source 1..23: mol_type = other DNA
gccgactctaattagagtcggca

SEQ ID NO: 6080 - DNA, 23 bp, synthetic construct
  misc_feature 1..23: note = Description of Artificial Sequence: Syntheticoligonucleotide
  source 1..23: mol_type = other DNA
cgagactctaattagagtctcgc

SEQ ID NO: 6081 - DNA, 23 bp, synthetic construct
  misc_feature 1..23: note = Description of Artificial Sequence: Syntheticoligonucleotide
  source 1..23: mol_type = other DNA
cgtgactctaattagagtcacgc

SEQ ID NO: 6082 - DNA, 23 bp, synthetic construct
  misc_feature 1..23: note = Description of Artificial Sequence: Syntheticoligonucleotide
  source 1..23: mol_type = other DNA
caggactctaattagagtcctgc

SEQ ID NO: 6083 - DNA, 23 bp, synthetic construct
  misc_feature 1..23: note = Description of Artificial Sequence: Syntheticoligonucleotide
  source 1..23: mol_type = other DNA
ctggactctaattagagtccagc

SEQ ID NO: 6084 - DNA, 23 bp, synthetic construct
  misc_feature 1..23: note = Description of Artificial Sequence: Syntheticoligonucleotide
  source 1..23: mol_type = other DNA
gaggactctaattagagtcctcg

SEQ ID NO: 6085 - DNA, 23 bp, synthetic construct
  misc_feature 1..23: note = Description of Artificial Sequence: Syntheticoligonucleotide
  source 1..23: mol_type = other DNA
gtggactctaattagagtccacg

SEQ ID NO: 6086 - DNA, 23 bp, synthetic construct
  misc_feature 1..23: note = Description of Artificial Sequence: Syntheticoligonucleotide
  source 1..23: mol_type = other DNA
accgactctaattagagtcggtg

SEQ ID NO: 6087 - DNA, 23 bp, synthetic construct
  misc_feature 1..23: note = Description of Artificial Sequence: Syntheticoligonucleotide
  source 1..23: mol_type = other DNA
tccgactctaattagagtcggag

SEQ ID NO: 6088 - DNA, 23 bp, synthetic construct
  misc_feature 1..23: note = Description of Artificial Sequence: Syntheticoligonucleotide
  source 1..23: mol_type = other DNA
cgggactctaattagagtcccgc

SEQ ID NO: 6089 - DNA, 23 bp, synthetic construct
  misc_feature 1..23: note = Description of Artificial Sequence: Syntheticoligonucleotide
  source 1..23: mol_type = other DNA
agggactctaattagagtccctc

SEQ ID NO: 6090 - DNA, 23 bp, synthetic construct
  misc_feature 1..23: note = Description of Artificial Sequence: Syntheticoligonucleotide
  source 1..23: mol_type = other DNA
tgggactctaattagagtcccac

SEQ ID NO: 6091 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactctatatagagtcnnnn

SEQ ID NO: 6092 - DNA, 23 bp, synthetic construct
  misc_feature 1..23: note = Description of Artificial Sequence: Syntheticoligonucleotide
  source 1..23: mol_type = other DNA
gcggactctatatagagtccgcc

SEQ ID NO: 6093 - DNA, 23 bp, synthetic construct
  misc_feature 1..23: note = Description of Artificial Sequence: Syntheticoligonucleotide
  source 1..23: mol_type = other DNA
gcggactctatatagagtccgct

SEQ ID NO: 6094 - DNA, 23 bp, synthetic construct
  misc_feature 1..23: note = Description of Artificial Sequence: Syntheticoligonucleotide
  source 1..23: mol_type = other DNA
acggactctatatagagtccgtc

SEQ ID NO: 6095 - DNA, 23 bp, synthetic construct
  misc_feature 1..23: note = Description of Artificial Sequence: Syntheticoligonucleotide
  source 1..23: mol_type = other DNA
gaggactctatatagagtcctcc

SEQ ID NO: 6096 - DNA, 23 bp, synthetic construct
  misc_feature 1..23: note = Description of Artificial Sequence: Syntheticoligonucleotide
  source 1..23: mol_type = other DNA
gcagactctatatagagtctgcc

SEQ ID NO: 6097 - DNA, 23 bp, synthetic construct
  misc_feature 1..23: note = Description of Artificial Sequence: Syntheticoligonucleotide
  source 1..23: mol_type = other DNA
gcggactctatatagagtccgca

SEQ ID NO: 6098 - DNA, 23 bp, synthetic construct
  misc_feature 1..23: note = Description of Artificial Sequence: Syntheticoligonucleotide
  source 1..23: mol_type = other DNA
tcggactctatatagagtccgac

SEQ ID NO: 6099 - DNA, 23 bp, synthetic construct
  misc_feature 1..23: note = Description of Artificial Sequence: Syntheticoligonucleotide
  source 1..23: mol_type = other DNA
gtggactctatatagagtccacc

SEQ ID NO: 6100 - DNA, 23 bp, synthetic construct
  misc_feature 1..23: note = Description of Artificial Sequence: Syntheticoligonucleotide
  source 1..23: mol_type = other DNA
gctgactctatatagagtcagcc

SEQ ID NO: 6101 - DNA, 23 bp, synthetic construct
  misc_feature 1..23: note = Description of Artificial Sequence: Syntheticoligonucleotide
  source 1..23: mol_type = other DNA
cccgactctatatagagtcgggc

SEQ ID NO: 6102 - DNA, 23 bp, synthetic construct
  misc_feature 1..23: note = Description of Artificial Sequence: Syntheticoligonucleotide
  source 1..23: mol_type = other DNA
cccgactctatatagagtcgggt

SEQ ID NO: 6103 - DNA, 23 bp, synthetic construct
  misc_feature 1..23: note = Description of Artificial Sequence: Syntheticoligonucleotide
  source 1..23: mol_type = other DNA
accgactctatatagagtcggtc

SEQ ID NO: 6104 - DNA, 23 bp, synthetic construct
  misc_feature 1..23: note = Description of Artificial Sequence: Syntheticoligonucleotide
  source 1..23: mol_type = other DNA
cacgactctatatagagtcgtgc

SEQ ID NO: 6105 - DNA, 23 bp, synthetic construct
  misc_feature 1..23: note = Description of Artificial Sequence: Syntheticoligonucleotide
  source 1..23: mol_type = other DNA
ccagactctatatagagtctggc

SEQ ID NO: 6106 - DNA, 23 bp, synthetic construct
  misc_feature 1..23: note = Description of Artificial Sequence: Syntheticoligonucleotide
  source 1..23: mol_type = other DNA
cccgactctatatagagtcggga

SEQ ID NO: 6107 - DNA, 23 bp, synthetic construct
  misc_feature 1..23: note = Description of Artificial Sequence: Syntheticoligonucleotide
  source 1..23: mol_type = other DNA
tccgactctatatagagtcggac

SEQ ID NO: 6108 - DNA, 23 bp, synthetic construct
  misc_feature 1..23: note = Description of Artificial Sequence: Syntheticoligonucleotide
  source 1..23: mol_type = other DNA
cctgactctatatagagtcaggc

SEQ ID NO: 6109 - DNA, 23 bp, synthetic construct
  misc_feature 1..23: note = Description of Artificial Sequence: Syntheticoligonucleotide
  source 1..23: mol_type = other DNA
ggcgactctatatagagtcgccc

SEQ ID NO: 6110 - DNA, 23 bp, synthetic construct
  misc_feature 1..23: note = Description of Artificial Sequence: Syntheticoligonucleotide
  source 1..23: mol_type = other DNA
ggcgactctatatagagtcgcct

SEQ ID NO: 6111 - DNA, 23 bp, synthetic construct
  misc_feature 1..23: note = Description of Artificial Sequence: Syntheticoligonucleotide
  source 1..23: mol_type = other DNA
agcgactctatatagagtcgctc

SEQ ID NO: 6112 - DNA, 23 bp, synthetic construct
  misc_feature 1..23: note = Description of Artificial Sequence: Syntheticoligonucleotide
  source 1..23: mol_type = other DNA
gacgactctatatagagtcgtcc

SEQ ID NO: 6113 - DNA, 23 bp, synthetic construct
  misc_feature 1..23: note = Description of Artificial Sequence: Syntheticoligonucleotide
  source 1..23: mol_type = other DNA
ggagactctatatagagtctccc

SEQ ID NO: 6114 - DNA, 23 bp, synthetic construct
  misc_feature 1..23: note = Description of Artificial Sequence: Syntheticoligonucleotide
  source 1..23: mol_type = other DNA
ggcgactctatatagagtcgcca

SEQ ID NO: 6115 - DNA, 23 bp, synthetic construct
  misc_feature 1..23: note = Description of Artificial Sequence: Syntheticoligonucleotide
  source 1..23: mol_type = other DNA
tgcgactctatatagagtcgcac

SEQ ID NO: 6116 - DNA, 23 bp, synthetic construct
  misc_feature 1..23: note = Description of Artificial Sequence: Syntheticoligonucleotide
  source 1..23: mol_type = other DNA
ggtgactctatatagagtcaccc

SEQ ID NO: 6117 - DNA, 23 bp, synthetic construct
  misc_feature 1..23: note = Description of Artificial Sequence: Syntheticoligonucleotide
  source 1..23: mol_type = other DNA
cgggactctatatagagtcccgt

SEQ ID NO: 6118 - DNA, 23 bp, synthetic construct
  misc_feature 1..23: note = Description of Artificial Sequence: Syntheticoligonucleotide
  source 1..23: mol_type = other DNA
agggactctatatagagtccctg

SEQ ID NO: 6119 - DNA, 23 bp, synthetic construct
  misc_feature 1..23: note = Description of Artificial Sequence: Syntheticoligonucleotide
  source 1..23: mol_type = other DNA
caggactctatatagagtcctgg

SEQ ID NO: 6120 - DNA, 23 bp, synthetic construct
  misc_feature 1..23: note = Description of Artificial Sequence: Syntheticoligonucleotide
  source 1..23: mol_type = other DNA
cgagactctatatagagtctcgg

SEQ ID NO: 6121 - DNA, 23 bp, synthetic construct
  misc_feature 1..23: note = Description of Artificial Sequence: Syntheticoligonucleotide
  source 1..23: mol_type = other DNA
cgggactctatatagagtcccga

SEQ ID NO: 6122 - DNA, 23 bp, synthetic construct
  misc_feature 1..23: note = Description of Artificial Sequence: Syntheticoligonucleotide
  source 1..23: mol_type = other DNA
tgggactctatatagagtcccag

SEQ ID NO: 6123 - DNA, 23 bp, synthetic construct
  misc_feature 1..23: note = Description of Artificial Sequence: Syntheticoligonucleotide
  source 1..23: mol_type = other DNA
ctggactctatatagagtccagg

SEQ ID NO: 6124 - DNA, 23 bp, synthetic construct
  misc_feature 1..23: note = Description of Artificial Sequence: Syntheticoligonucleotide
  source 1..23: mol_type = other DNA
cgtgactctatatagagtcacgg

SEQ ID NO: 6125 - DNA, 23 bp, synthetic construct
  misc_feature 1..23: note = Description of Artificial Sequence: Syntheticoligonucleotide
  source 1..23: mol_type = other DNA
ggcgactctatatagagtcgccg

SEQ ID NO: 6126 - DNA, 23 bp, synthetic construct
  misc_feature 1..23: note = Description of Artificial Sequence: Syntheticoligonucleotide
  source 1..23: mol_type = other DNA
agcgactctatatagagtcgctg

SEQ ID NO: 6127 - DNA, 23 bp, synthetic construct
  misc_feature 1..23: note = Description of Artificial Sequence: Syntheticoligonucleotide
  source 1..23: mol_type = other DNA
gacgactctatatagagtcgtcg

SEQ ID NO: 6128 - DNA, 23 bp, synthetic construct
  misc_feature 1..23: note = Description of Artificial Sequence: Syntheticoligonucleotide
  source 1..23: mol_type = other DNA
ggagactctatatagagtctccg

SEQ ID NO: 6129 - DNA, 23 bp, synthetic construct
  misc_feature 1..23: note = Description of Artificial Sequence: Syntheticoligonucleotide
  source 1..23: mol_type = other DNA
tgcgactctatatagagtcgcag

SEQ ID NO: 6130 - DNA, 23 bp, synthetic construct
  misc_feature 1..23: note = Description of Artificial Sequence: Syntheticoligonucleotide
  source 1..23: mol_type = other DNA
ggtgactctatatagagtcaccg

SEQ ID NO: 6131 - DNA, 23 bp, synthetic construct
  misc_feature 1..23: note = Description of Artificial Sequence: Syntheticoligonucleotide
  source 1..23: mol_type = other DNA
acggactctatatagagtccgtg

SEQ ID NO: 6132 - DNA, 23 bp, synthetic construct
  misc_feature 1..23: note = Description of Artificial Sequence: Syntheticoligonucleotide
  source 1..23: mol_type = other DNA
ccagactctatatagagtctggg

SEQ ID NO: 6133 - DNA, 23 bp, synthetic construct
  misc_feature 1..23: note = Description of Artificial Sequence: Syntheticoligonucleotide
  source 1..23: mol_type = other DNA
tcggactctatatagagtccgag

SEQ ID NO: 6134 - DNA, 23 bp, synthetic construct
  misc_feature 1..23: note = Description of Artificial Sequence: Syntheticoligonucleotide
  source 1..23: mol_type = other DNA
cctgactctatatagagtcaggg

SEQ ID NO: 6135 - DNA, 23 bp, synthetic construct
  misc_feature 1..23: note = Description of Artificial Sequence: Syntheticoligonucleotide
  source 1..23: mol_type = other DNA
cacgactctatatagagtcgtgg

SEQ ID NO: 6136 - DNA, 23 bp, synthetic construct
  misc_feature 1..23: note = Description of Artificial Sequence: Syntheticoligonucleotide
  source 1..23: mol_type = other DNA
gccgactctatatagagtcggct

SEQ ID NO: 6137 - DNA, 23 bp, synthetic construct
  misc_feature 1..23: note = Description of Artificial Sequence: Syntheticoligonucleotide
  source 1..23: mol_type = other DNA
gccgactctatatagagtcggca

SEQ ID NO: 6138 - DNA, 23 bp, synthetic construct
  misc_feature 1..23: note = Description of Artificial Sequence: Syntheticoligonucleotide
  source 1..23: mol_type = other DNA
cgagactctatatagagtctcgc

SEQ ID NO: 6139 - DNA, 23 bp, synthetic construct
  misc_feature 1..23: note = Description of Artificial Sequence: Syntheticoligonucleotide
  source 1..23: mol_type = other DNA
cgtgactctatatagagtcacgc

SEQ ID NO: 6140 - DNA, 23 bp, synthetic construct
  misc_feature 1..23: note = Description of Artificial Sequence: Syntheticoligonucleotide
  source 1..23: mol_type = other DNA
caggactctatatagagtcctgc

SEQ ID NO: 6141 - DNA, 23 bp, synthetic construct
  misc_feature 1..23: note = Description of Artificial Sequence: Syntheticoligonucleotide
  source 1..23: mol_type = other DNA
ctggactctatatagagtccagc

SEQ ID NO: 6142 - DNA, 23 bp, synthetic construct
  misc_feature 1..23: note = Description of Artificial Sequence: Syntheticoligonucleotide
  source 1..23: mol_type = other DNA
gaggactctatatagagtcctcg

SEQ ID NO: 6143 - DNA, 23 bp, synthetic construct
  misc_feature 1..23: note = Description of Artificial Sequence: Syntheticoligonucleotide
  source 1..23: mol_type = other DNA
gtggactctatatagagtccacg

SEQ ID NO: 6144 - DNA, 23 bp, synthetic construct
  misc_feature 1..23: note = Description of Artificial Sequence: Syntheticoligonucleotide
  source 1..23: mol_type = other DNA
accgactctatatagagtcggtg

SEQ ID NO: 6145 - DNA, 23 bp, synthetic construct
  misc_feature 1..23: note = Description of Artificial Sequence: Syntheticoligonucleotide
  source 1..23: mol_type = other DNA
tccgactctatatagagtcggag

SEQ ID NO: 6146 - DNA, 23 bp, synthetic construct
  misc_feature 1..23: note = Description of Artificial Sequence: Syntheticoligonucleotide
  source 1..23: mol_type = other DNA
cgggactctatatagagtcccgc

SEQ ID NO: 6147 - DNA, 23 bp, synthetic construct
  misc_feature 1..23: note = Description of Artificial Sequence: Syntheticoligonucleotide
  source 1..23: mol_type = other DNA
agggactctatatagagtccctc

SEQ ID NO: 6148 - DNA, 23 bp, synthetic construct
  misc_feature 1..23: note = Description of Artificial Sequence: Syntheticoligonucleotide
  source 1..23: mol_type = other DNA
tgggactctatatagagtcccac

SEQ ID NO: 6149 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactctagctagagtcnnnn

SEQ ID NO: 6150 - DNA, 23 bp, synthetic construct
  misc_feature 1..23: note = Description of Artificial Sequence: Syntheticoligonucleotide
  source 1..23: mol_type = other DNA
gcggactctagctagagtccgcc

SEQ ID NO: 6151 - DNA, 23 bp, synthetic construct
  misc_feature 1..23: note = Description of Artificial Sequence: Syntheticoligonucleotide
  source 1..23: mol_type = other DNA
gcggactctagctagagtccgct

SEQ ID NO: 6152 - DNA, 23 bp, synthetic construct
  misc_feature 1..23: note = Description of Artificial Sequence: Syntheticoligonucleotide
  source 1..23: mol_type = other DNA
acggactctagctagagtccgtc

SEQ ID NO: 6153 - DNA, 23 bp, synthetic construct
  misc_feature 1..23: note = Description of Artificial Sequence: Syntheticoligonucleotide
  source 1..23: mol_type = other DNA
gaggactctagctagagtcctcc

SEQ ID NO: 6154 - DNA, 23 bp, synthetic construct
  misc_feature 1..23: note = Description of Artificial Sequence: Syntheticoligonucleotide
  source 1..23: mol_type = other DNA
gcagactctagctagagtctgcc

SEQ ID NO: 6155 - DNA, 23 bp, synthetic construct
  misc_feature 1..23: note = Description of Artificial Sequence: Syntheticoligonucleotide
  source 1..23: mol_type = other DNA
gcggactctagctagagtccgca

SEQ ID NO: 6156 - DNA, 23 bp, synthetic construct
  misc_feature 1..23: note = Description of Artificial Sequence: Syntheticoligonucleotide
  source 1..23: mol_type = other DNA
tcggactctagctagagtccgac

SEQ ID NO: 6157 - DNA, 23 bp, synthetic construct
  misc_feature 1..23: note = Description of Artificial Sequence: Syntheticoligonucleotide
  source 1..23: mol_type = other DNA
gtggactctagctagagtccacc

SEQ ID NO: 6158 - DNA, 23 bp, synthetic construct
  misc_feature 1..23: note = Description of Artificial Sequence: Syntheticoligonucleotide
  source 1..23: mol_type = other DNA
gctgactctagctagagtcagcc

SEQ ID NO: 6159 - DNA, 23 bp, synthetic construct
  misc_feature 1..23: note = Description of Artificial Sequence: Syntheticoligonucleotide
  source 1..23: mol_type = other DNA
cccgactctagctagagtcgggc

SEQ ID NO: 6160 - DNA, 23 bp, synthetic construct
  misc_feature 1..23: note = Description of Artificial Sequence: Syntheticoligonucleotide
  source 1..23: mol_type = other DNA
cccgactctagctagagtcgggt

SEQ ID NO: 6161 - DNA, 23 bp, synthetic construct
  misc_feature 1..23: note = Description of Artificial Sequence: Syntheticoligonucleotide
  source 1..23: mol_type = other DNA
accgactctagctagagtcggtc

SEQ ID NO: 6162 - DNA, 23 bp, synthetic construct
  misc_feature 1..23: note = Description of Artificial Sequence: Syntheticoligonucleotide
  source 1..23: mol_type = other DNA
cacgactctagctagagtcgtgc

SEQ ID NO: 6163 - DNA, 23 bp, synthetic construct
  misc_feature 1..23: note = Description of Artificial Sequence: Syntheticoligonucleotide
  source 1..23: mol_type = other DNA
ccagactctagctagagtctggc

SEQ ID NO: 6164 - DNA, 23 bp, synthetic construct
  misc_feature 1..23: note = Description of Artificial Sequence: Syntheticoligonucleotide
  source 1..23: mol_type = other DNA
cccgactctagctagagtcggga

SEQ ID NO: 6165 - DNA, 23 bp, synthetic construct
  misc_feature 1..23: note = Description of Artificial Sequence: Syntheticoligonucleotide
  source 1..23: mol_type = other DNA
tccgactctagctagagtcggac

SEQ ID NO: 6166 - DNA, 23 bp, synthetic construct
  misc_feature 1..23: note = Description of Artificial Sequence: Syntheticoligonucleotide
  source 1..23: mol_type = other DNA
cctgactctagctagagtcaggc

SEQ ID NO: 6167 - DNA, 23 bp, synthetic construct
  misc_feature 1..23: note = Description of Artificial Sequence: Syntheticoligonucleotide
  source 1..23: mol_type = other DNA
ggcgactctagctagagtcgccc

SEQ ID NO: 6168 - DNA, 23 bp, synthetic construct
  misc_feature 1..23: note = Description of Artificial Sequence: Syntheticoligonucleotide
  source 1..23: mol_type = other DNA
ggcgactctagctagagtcgcct

SEQ ID NO: 6169 - DNA, 23 bp, synthetic construct
  misc_feature 1..23: note = Description of Artificial Sequence: Syntheticoligonucleotide
  source 1..23: mol_type = other DNA
agcgactctagctagagtcgctc

SEQ ID NO: 6170 - DNA, 23 bp, synthetic construct
  misc_feature 1..23: note = Description of Artificial Sequence: Syntheticoligonucleotide
  source 1..23: mol_type = other DNA
gacgactctagctagagtcgtcc

SEQ ID NO: 6171 - DNA, 23 bp, synthetic construct
  misc_feature 1..23: note = Description of Artificial Sequence: Syntheticoligonucleotide
  source 1..23: mol_type = other DNA
ggagactctagctagagtctccc

SEQ ID NO: 6172 - DNA, 23 bp, synthetic construct
  misc_feature 1..23: note = Description of Artificial Sequence: Syntheticoligonucleotide
  source 1..23: mol_type = other DNA
ggcgactctagctagagtcgcca

SEQ ID NO: 6173 - DNA, 23 bp, synthetic construct
  misc_feature 1..23: note = Description of Artificial Sequence: Syntheticoligonucleotide
  source 1..23: mol_type = other DNA
tgcgactctagctagagtcgcac

SEQ ID NO: 6174 - DNA, 23 bp, synthetic construct
  misc_feature 1..23: note = Description of Artificial Sequence: Syntheticoligonucleotide
  source 1..23: mol_type = other DNA
ggtgactctagctagagtcaccc

SEQ ID NO: 6175 - DNA, 23 bp, synthetic construct
  misc_feature 1..23: note = Description of Artificial Sequence: Syntheticoligonucleotide
  source 1..23: mol_type = other DNA
cgggactctagctagagtcccgt

SEQ ID NO: 6176 - DNA, 23 bp, synthetic construct
  misc_feature 1..23: note = Description of Artificial Sequence: Syntheticoligonucleotide
  source 1..23: mol_type = other DNA
agggactctagctagagtccctg

SEQ ID NO: 6177 - DNA, 23 bp, synthetic construct
  misc_feature 1..23: note = Description of Artificial Sequence: Syntheticoligonucleotide
  source 1..23: mol_type = other DNA
caggactctagctagagtcctgg

SEQ ID NO: 6178 - DNA, 23 bp, synthetic construct
  misc_feature 1..23: note = Description of Artificial Sequence: Syntheticoligonucleotide
  source 1..23: mol_type = other DNA
cgagactctagctagagtctcgg

SEQ ID NO: 6179 - DNA, 23 bp, synthetic construct
  misc_feature 1..23: note = Description of Artificial Sequence: Syntheticoligonucleotide
  source 1..23: mol_type = other DNA
cgggactctagctagagtcccga

SEQ ID NO: 6180 - DNA, 23 bp, synthetic construct
  misc_feature 1..23: note = Description of Artificial Sequence: Syntheticoligonucleotide
  source 1..23: mol_type = other DNA
tgggactctagctagagtcccag

SEQ ID NO: 6181 - DNA, 23 bp, synthetic construct
  misc_feature 1..23: note = Description of Artificial Sequence: Syntheticoligonucleotide
  source 1..23: mol_type = other DNA
ctggactctagctagagtccagg

SEQ ID NO: 6182 - DNA, 23 bp, synthetic construct
  misc_feature 1..23: note = Description of Artificial Sequence: Syntheticoligonucleotide
  source 1..23: mol_type = other DNA
cgtgactctagctagagtcacgg

SEQ ID NO: 6183 - DNA, 23 bp, synthetic construct
  misc_feature 1..23: note = Description of Artificial Sequence: Syntheticoligonucleotide
  source 1..23: mol_type = other DNA
ggcgactctagctagagtcgccg

SEQ ID NO: 6184 - DNA, 23 bp, synthetic construct
  misc_feature 1..23: note = Description of Artificial Sequence: Syntheticoligonucleotide
  source 1..23: mol_type = other DNA
agcgactctagctagagtcgctg

SEQ ID NO: 6185 - DNA, 23 bp, synthetic construct
  misc_feature 1..23: note = Description of Artificial Sequence: Syntheticoligonucleotide
  source 1..23: mol_type = other DNA
gacgactctagctagagtcgtcg

SEQ ID NO: 6186 - DNA, 23 bp, synthetic construct
  misc_feature 1..23: note = Description of Artificial Sequence: Syntheticoligonucleotide
  source 1..23: mol_type = other DNA
ggagactctagctagagtctccg

SEQ ID NO: 6187 - DNA, 23 bp, synthetic construct
  misc_feature 1..23: note = Description of Artificial Sequence: Syntheticoligonucleotide
  source 1..23: mol_type = other DNA
tgcgactctagctagagtcgcag

SEQ ID NO: 6188 - DNA, 23 bp, synthetic construct
  misc_feature 1..23: note = Description of Artificial Sequence: Syntheticoligonucleotide
  source 1..23: mol_type = other DNA
ggtgactctagctagagtcaccg

SEQ ID NO: 6189 - DNA, 23 bp, synthetic construct
  misc_feature 1..23: note = Description of Artificial Sequence: Syntheticoligonucleotide
  source 1..23: mol_type = other DNA
acggactctagctagagtccgtg

SEQ ID NO: 6190 - DNA, 23 bp, synthetic construct
  misc_feature 1..23: note = Description of Artificial Sequence: Syntheticoligonucleotide
  source 1..23: mol_type = other DNA
ccagactctagctagagtctggg

SEQ ID NO: 6191 - DNA, 23 bp, synthetic construct
  misc_feature 1..23: note = Description of Artificial Sequence: Syntheticoligonucleotide
  source 1..23: mol_type = other DNA
tcggactctagctagagtccgag

SEQ ID NO: 6192 - DNA, 23 bp, synthetic construct
  misc_feature 1..23: note = Description of Artificial Sequence: Syntheticoligonucleotide
  source 1..23: mol_type = other DNA
cctgactctagctagagtcaggg

SEQ ID NO: 6193 - DNA, 23 bp, synthetic construct
  misc_feature 1..23: note = Description of Artificial Sequence: Syntheticoligonucleotide
  source 1..23: mol_type = other DNA
cacgactctagctagagtcgtgg

SEQ ID NO: 6194 - DNA, 23 bp, synthetic construct
  misc_feature 1..23: note = Description of Artificial Sequence: Syntheticoligonucleotide
  source 1..23: mol_type = other DNA
gccgactctagctagagtcggct

SEQ ID NO: 6195 - DNA, 23 bp, synthetic construct
  misc_feature 1..23: note = Description of Artificial Sequence: Syntheticoligonucleotide
  source 1..23: mol_type = other DNA
gccgactctagctagagtcggca

SEQ ID NO: 6196 - DNA, 23 bp, synthetic construct
  misc_feature 1..23: note = Description of Artificial Sequence: Syntheticoligonucleotide
  source 1..23: mol_type = other DNA
cgagactctagctagagtctcgc

SEQ ID NO: 6197 - DNA, 23 bp, synthetic construct
  misc_feature 1..23: note = Description of Artificial Sequence: Syntheticoligonucleotide
  source 1..23: mol_type = other DNA
cgtgactctagctagagtcacgc

SEQ ID NO: 6198 - DNA, 23 bp, synthetic construct
  misc_feature 1..23: note = Description of Artificial Sequence: Syntheticoligonucleotide
  source 1..23: mol_type = other DNA
caggactctagctagagtcctgc

SEQ ID NO: 6199 - DNA, 23 bp, synthetic construct
  misc_feature 1..23: note = Description of Artificial Sequence: Syntheticoligonucleotide
  source 1..23: mol_type = other DNA
ctggactctagctagagtccagc

SEQ ID NO: 6200 - DNA, 23 bp, synthetic construct
  misc_feature 1..23: note = Description of Artificial Sequence: Syntheticoligonucleotide
  source 1..23: mol_type = other DNA
gaggactctagctagagtcctcg

SEQ ID NO: 6201 - DNA, 23 bp, synthetic construct
  misc_feature 1..23: note = Description of Artificial Sequence: Syntheticoligonucleotide
  source 1..23: mol_type = other DNA
gtggactctagctagagtccacg

SEQ ID NO: 6202 - DNA, 23 bp, synthetic construct
  misc_feature 1..23: note = Description of Artificial Sequence: Syntheticoligonucleotide
  source 1..23: mol_type = other DNA
accgactctagctagagtcggtg

SEQ ID NO: 6203 - DNA, 23 bp, synthetic construct
  misc_feature 1..23: note = Description of Artificial Sequence: Syntheticoligonucleotide
  source 1..23: mol_type = other DNA
tccgactctagctagagtcggag

SEQ ID NO: 6204 - DNA, 23 bp, synthetic construct
  misc_feature 1..23: note = Description of Artificial Sequence: Syntheticoligonucleotide
  source 1..23: mol_type = other DNA
cgggactctagctagagtcccgc

SEQ ID NO: 6205 - DNA, 23 bp, synthetic construct
  misc_feature 1..23: note = Description of Artificial Sequence: Syntheticoligonucleotide
  source 1..23: mol_type = other DNA
agggactctagctagagtccctc

SEQ ID NO: 6206 - DNA, 23 bp, synthetic construct
  misc_feature 1..23: note = Description of Artificial Sequence: Syntheticoligonucleotide
  source 1..23: mol_type = other DNA
tgggactctagctagagtcccac

SEQ ID NO: 6207 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactctacgtagagtcnnnn

SEQ ID NO: 6208 - DNA, 23 bp, synthetic construct
  misc_feature 1..23: note = Description of Artificial Sequence: Syntheticoligonucleotide
  source 1..23: mol_type = other DNA
gcggactctacgtagagtccgcc

SEQ ID NO: 6209 - DNA, 23 bp, synthetic construct
  misc_feature 1..23: note = Description of Artificial Sequence: Syntheticoligonucleotide
  source 1..23: mol_type = other DNA
gcggactctacgtagagtccgct

SEQ ID NO: 6210 - DNA, 23 bp, synthetic construct
  misc_feature 1..23: note = Description of Artificial Sequence: Syntheticoligonucleotide
  source 1..23: mol_type = other DNA
acggactctacgtagagtccgtc

SEQ ID NO: 6211 - DNA, 23 bp, synthetic construct
  misc_feature 1..23: note = Description of Artificial Sequence: Syntheticoligonucleotide
  source 1..23: mol_type = other DNA
gaggactctacgtagagtcctcc

SEQ ID NO: 6212 - DNA, 23 bp, synthetic construct
  misc_feature 1..23: note = Description of Artificial Sequence: Syntheticoligonucleotide
  source 1..23: mol_type = other DNA
gcagactctacgtagagtctgcc

SEQ ID NO: 6213 - DNA, 23 bp, synthetic construct
  misc_feature 1..23: note = Description of Artificial Sequence: Syntheticoligonucleotide
  source 1..23: mol_type = other DNA
gcggactctacgtagagtccgca

SEQ ID NO: 6214 - DNA, 23 bp, synthetic construct
  misc_feature 1..23: note = Description of Artificial Sequence: Syntheticoligonucleotide
  source 1..23: mol_type = other DNA
tcggactctacgtagagtccgac

SEQ ID NO: 6215 - DNA, 23 bp, synthetic construct
  misc_feature 1..23: note = Description of Artificial Sequence: Syntheticoligonucleotide
  source 1..23: mol_type = other DNA
gtggactctacgtagagtccacc

SEQ ID NO: 6216 - DNA, 23 bp, synthetic construct
  misc_feature 1..23: note = Description of Artificial Sequence: Syntheticoligonucleotide
  source 1..23: mol_type = other DNA
gctgactctacgtagagtcagcc

SEQ ID NO: 6217 - DNA, 23 bp, synthetic construct
  misc_feature 1..23: note = Description of Artificial Sequence: Syntheticoligonucleotide
  source 1..23: mol_type = other DNA
cccgactctacgtagagtcgggc

SEQ ID NO: 6218 - DNA, 23 bp, synthetic construct
  misc_feature 1..23: note = Description of Artificial Sequence: Syntheticoligonucleotide
  source 1..23: mol_type = other DNA
cccgactctacgtagagtcgggt

SEQ ID NO: 6219 - DNA, 23 bp, synthetic construct
  misc_feature 1..23: note = Description of Artificial Sequence: Syntheticoligonucleotide
  source 1..23: mol_type = other DNA
accgactctacgtagagtcggtc

SEQ ID NO: 6220 - DNA, 23 bp, synthetic construct
  misc_feature 1..23: note = Description of Artificial Sequence: Syntheticoligonucleotide
  source 1..23: mol_type = other DNA
cacgactctacgtagagtcgtgc

SEQ ID NO: 6221 - DNA, 23 bp, synthetic construct
  misc_feature 1..23: note = Description of Artificial Sequence: Syntheticoligonucleotide
  source 1..23: mol_type = other DNA
ccagactctacgtagagtctggc

SEQ ID NO: 6222 - DNA, 23 bp, synthetic construct
  misc_feature 1..23: note = Description of Artificial Sequence: Syntheticoligonucleotide
  source 1..23: mol_type = other DNA
cccgactctacgtagagtcggga

SEQ ID NO: 6223 - DNA, 23 bp, synthetic construct
  misc_feature 1..23: note = Description of Artificial Sequence: Syntheticoligonucleotide
  source 1..23: mol_type = other DNA
tccgactctacgtagagtcggac

SEQ ID NO: 6224 - DNA, 23 bp, synthetic construct
  misc_feature 1..23: note = Description of Artificial Sequence: Syntheticoligonucleotide
  source 1..23: mol_type = other DNA
cctgactctacgtagagtcaggc

SEQ ID NO: 6225 - DNA, 23 bp, synthetic construct
  misc_feature 1..23: note = Description of Artificial Sequence: Syntheticoligonucleotide
  source 1..23: mol_type = other DNA
ggcgactctacgtagagtcgccc

SEQ ID NO: 6226 - DNA, 23 bp, synthetic construct
  misc_feature 1..23: note = Description of Artificial Sequence: Syntheticoligonucleotide
  source 1..23: mol_type = other DNA
ggcgactctacgtagagtcgcct

SEQ ID NO: 6227 - DNA, 23 bp, synthetic construct
  misc_feature 1..23: note = Description of Artificial Sequence: Syntheticoligonucleotide
  source 1..23: mol_type = other DNA
agcgactctacgtagagtcgctc

SEQ ID NO: 6228 - DNA, 23 bp, synthetic construct
  misc_feature 1..23: note = Description of Artificial Sequence: Syntheticoligonucleotide
  source 1..23: mol_type = other DNA
gacgactctacgtagagtcgtcc

SEQ ID NO: 6229 - DNA, 23 bp, synthetic construct
  misc_feature 1..23: note = Description of Artificial Sequence: Syntheticoligonucleotide
  source 1..23: mol_type = other DNA
ggagactctacgtagagtctccc

SEQ ID NO: 6230 - DNA, 23 bp, synthetic construct
  misc_feature 1..23: note = Description of Artificial Sequence: Syntheticoligonucleotide
  source 1..23: mol_type = other DNA
ggcgactctacgtagagtcgcca

SEQ ID NO: 6231 - DNA, 23 bp, synthetic construct
  misc_feature 1..23: note = Description of Artificial Sequence: Syntheticoligonucleotide
  source 1..23: mol_type = other DNA
tgcgactctacgtagagtcgcac

SEQ ID NO: 6232 - DNA, 23 bp, synthetic construct
  misc_feature 1..23: note = Description of Artificial Sequence: Syntheticoligonucleotide
  source 1..23: mol_type = other DNA
ggtgactctacgtagagtcaccc

SEQ ID NO: 6233 - DNA, 23 bp, synthetic construct
  misc_feature 1..23: note = Description of Artificial Sequence: Syntheticoligonucleotide
  source 1..23: mol_type = other DNA
cgggactctacgtagagtcccgt

SEQ ID NO: 6234 - DNA, 23 bp, synthetic construct
  misc_feature 1..23: note = Description of Artificial Sequence: Syntheticoligonucleotide
  source 1..23: mol_type = other DNA
agggactctacgtagagtccctg

SEQ ID NO: 6235 - DNA, 23 bp, synthetic construct
  misc_feature 1..23: note = Description of Artificial Sequence: Syntheticoligonucleotide
  source 1..23: mol_type = other DNA
caggactctacgtagagtcctgg

SEQ ID NO: 6236 - DNA, 23 bp, synthetic construct
  misc_feature 1..23: note = Description of Artificial Sequence: Syntheticoligonucleotide
  source 1..23: mol_type = other DNA
cgagactctacgtagagtctcgg

SEQ ID NO: 6237 - DNA, 23 bp, synthetic construct
  misc_feature 1..23: note = Description of Artificial Sequence: Syntheticoligonucleotide
  source 1..23: mol_type = other DNA
cgggactctacgtagagtcccga

SEQ ID NO: 6238 - DNA, 23 bp, synthetic construct
  misc_feature 1..23: note = Description of Artificial Sequence: Syntheticoligonucleotide
  source 1..23: mol_type = other DNA
tgggactctacgtagagtcccag

SEQ ID NO: 6239 - DNA, 23 bp, synthetic construct
  misc_feature 1..23: note = Description of Artificial Sequence: Syntheticoligonucleotide
  source 1..23: mol_type = other DNA
ctggactctacgtagagtccagg

SEQ ID NO: 6240 - DNA, 23 bp, synthetic construct
  misc_feature 1..23: note = Description of Artificial Sequence: Syntheticoligonucleotide
  source 1..23: mol_type = other DNA
cgtgactctacgtagagtcacgg

SEQ ID NO: 6241 - DNA, 23 bp, synthetic construct
  misc_feature 1..23: note = Description of Artificial Sequence: Syntheticoligonucleotide
  source 1..23: mol_type = other DNA
ggcgactctacgtagagtcgccg

SEQ ID NO: 6242 - DNA, 23 bp, synthetic construct
  misc_feature 1..23: note = Description of Artificial Sequence: Syntheticoligonucleotide
  source 1..23: mol_type = other DNA
agcgactctacgtagagtcgctg

SEQ ID NO: 6243 - DNA, 23 bp, synthetic construct
  misc_feature 1..23: note = Description of Artificial Sequence: Syntheticoligonucleotide
  source 1..23: mol_type = other DNA
gacgactctacgtagagtcgtcg

SEQ ID NO: 6244 - DNA, 23 bp, synthetic construct
  misc_feature 1..23: note = Description of Artificial Sequence: Syntheticoligonucleotide
  source 1..23: mol_type = other DNA
ggagactctacgtagagtctccg

SEQ ID NO: 6245 - DNA, 23 bp, synthetic construct
  misc_feature 1..23: note = Description of Artificial Sequence: Syntheticoligonucleotide
  source 1..23: mol_type = other DNA
tgcgactctacgtagagtcgcag

SEQ ID NO: 6246 - DNA, 23 bp, synthetic construct
  misc_feature 1..23: note = Description of Artificial Sequence: Syntheticoligonucleotide
  source 1..23: mol_type = other DNA
ggtgactctacgtagagtcaccg

SEQ ID NO: 6247 - DNA, 23 bp, synthetic construct
  misc_feature 1..23: note = Description of Artificial Sequence: Syntheticoligonucleotide
  source 1..23: mol_type = other DNA
acggactctacgtagagtccgtg

SEQ ID NO: 6248 - DNA, 23 bp, synthetic construct
  misc_feature 1..23: note = Description of Artificial Sequence: Syntheticoligonucleotide
  source 1..23: mol_type = other DNA
ccagactctacgtagagtctggg

SEQ ID NO: 6249 - DNA, 23 bp, synthetic construct
  misc_feature 1..23: note = Description of Artificial Sequence: Syntheticoligonucleotide
  source 1..23: mol_type = other DNA
tcggactctacgtagagtccgag

SEQ ID NO: 6250 - DNA, 23 bp, synthetic construct
  misc_feature 1..23: note = Description of Artificial Sequence: Syntheticoligonucleotide
  source 1..23: mol_type = other DNA
cctgactctacgtagagtcaggg

SEQ ID NO: 6251 - DNA, 23 bp, synthetic construct
  misc_feature 1..23: note = Description of Artificial Sequence: Syntheticoligonucleotide
  source 1..23: mol_type = other DNA
cacgactctacgtagagtcgtgg

SEQ ID NO: 6252 - DNA, 23 bp, synthetic construct
  misc_feature 1..23: note = Description of Artificial Sequence: Syntheticoligonucleotide
  source 1..23: mol_type = other DNA
gccgactctacgtagagtcggct

SEQ ID NO: 6253 - DNA, 23 bp, synthetic construct
  misc_feature 1..23: note = Description of Artificial Sequence: Syntheticoligonucleotide
  source 1..23: mol_type = other DNA
gccgactctacgtagagtcggca

SEQ ID NO: 6254 - DNA, 23 bp, synthetic construct
  misc_feature 1..23: note = Description of Artificial Sequence: Syntheticoligonucleotide
  source 1..23: mol_type = other DNA
cgagactctacgtagagtctcgc

SEQ ID NO: 6255 - DNA, 23 bp, synthetic construct
  misc_feature 1..23: note = Description of Artificial Sequence: Syntheticoligonucleotide
  source 1..23: mol_type = other DNA
cgtgactctacgtagagtcacgc

SEQ ID NO: 6256 - DNA, 23 bp, synthetic construct
  misc_feature 1..23: note = Description of Artificial Sequence: Syntheticoligonucleotide
  source 1..23: mol_type = other DNA
caggactctacgtagagtcctgc

SEQ ID NO: 6257 - DNA, 23 bp, synthetic construct
  misc_feature 1..23: note = Description of Artificial Sequence: Syntheticoligonucleotide
  source 1..23: mol_type = other DNA
ctggactctacgtagagtccagc

SEQ ID NO: 6258 - DNA, 23 bp, synthetic construct
  misc_feature 1..23: note = Description of Artificial Sequence: Syntheticoligonucleotide
  source 1..23: mol_type = other DNA
gaggactctacgtagagtcctcg

SEQ ID NO: 6259 - DNA, 23 bp, synthetic construct
  misc_feature 1..23: note = Description of Artificial Sequence: Syntheticoligonucleotide
  source 1..23: mol_type = other DNA
gtggactctacgtagagtccacg

SEQ ID NO: 6260 - DNA, 23 bp, synthetic construct
  misc_feature 1..23: note = Description of Artificial Sequence: Syntheticoligonucleotide
  source 1..23: mol_type = other DNA
accgactctacgtagagtcggtg

SEQ ID NO: 6261 - DNA, 23 bp, synthetic construct
  misc_feature 1..23: note = Description of Artificial Sequence: Syntheticoligonucleotide
  source 1..23: mol_type = other DNA
tccgactctacgtagagtcggag

SEQ ID NO: 6262 - DNA, 23 bp, synthetic construct
  misc_feature 1..23: note = Description of Artificial Sequence: Syntheticoligonucleotide
  source 1..23: mol_type = other DNA
cgggactctacgtagagtcccgc

SEQ ID NO: 6263 - DNA, 23 bp, synthetic construct
  misc_feature 1..23: note = Description of Artificial Sequence: Syntheticoligonucleotide
  source 1..23: mol_type = other DNA
agggactctacgtagagtccctc

SEQ ID NO: 6264 - DNA, 23 bp, synthetic construct
  misc_feature 1..23: note = Description of Artificial Sequence: Syntheticoligonucleotide
  source 1..23: mol_type = other DNA
tgggactctacgtagagtcccac

SEQ ID NO: 6265 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcatatatgagtcnnnn

SEQ ID NO: 6266 - DNA, 23 bp, synthetic construct
  misc_feature 1..23: note = Description of Artificial Sequence: Syntheticoligonucleotide
  source 1..23: mol_type = other DNA
gcggactcatatatgagtccgcc

SEQ ID NO: 6267 - DNA, 23 bp, synthetic construct
  misc_feature 1..23: note = Description of Artificial Sequence: Syntheticoligonucleotide
  source 1..23: mol_type = other DNA
gcggactcatatatgagtccgct

SEQ ID NO: 6268 - DNA, 23 bp, synthetic construct
  misc_feature 1..23: note = Description of Artificial Sequence: Syntheticoligonucleotide
  source 1..23: mol_type = other DNA
acggactcatatatgagtccgtc

SEQ ID NO: 6269 - DNA, 23 bp, synthetic construct
  misc_feature 1..23: note = Description of Artificial Sequence: Syntheticoligonucleotide
  source 1..23: mol_type = other DNA
gaggactcatatatgagtcctcc

SEQ ID NO: 6270 - DNA, 23 bp, synthetic construct
  misc_feature 1..23: note = Description of Artificial Sequence: Syntheticoligonucleotide
  source 1..23: mol_type = other DNA
gcagactcatatatgagtctgcc

SEQ ID NO: 6271 - DNA, 23 bp, synthetic construct
  misc_feature 1..23: note = Description of Artificial Sequence: Syntheticoligonucleotide
  source 1..23: mol_type = other DNA
gcggactcatatatgagtccgca

SEQ ID NO: 6272 - DNA, 23 bp, synthetic construct
  misc_feature 1..23: note = Description of Artificial Sequence: Syntheticoligonucleotide
  source 1..23: mol_type = other DNA
tcggactcatatatgagtccgac

SEQ ID NO: 6273 - DNA, 23 bp, synthetic construct
  misc_feature 1..23: note = Description of Artificial Sequence: Syntheticoligonucleotide
  source 1..23: mol_type = other DNA
gtggactcatatatgagtccacc

SEQ ID NO: 6274 - DNA, 23 bp, synthetic construct
  misc_feature 1..23: note = Description of Artificial Sequence: Syntheticoligonucleotide
  source 1..23: mol_type = other DNA
gctgactcatatatgagtcagcc

SEQ ID NO: 6275 - DNA, 23 bp, synthetic construct
  misc_feature 1..23: note = Description of Artificial Sequence: Syntheticoligonucleotide
  source 1..23: mol_type = other DNA
cccgactcatatatgagtcgggc

SEQ ID NO: 6276 - DNA, 23 bp, synthetic construct
  misc_feature 1..23: note = Description of Artificial Sequence: Syntheticoligonucleotide
  source 1..23: mol_type = other DNA
cccgactcatatatgagtcgggt

SEQ ID NO: 6277 - DNA, 23 bp, synthetic construct
  misc_feature 1..23: note = Description of Artificial Sequence: Syntheticoligonucleotide
  source 1..23: mol_type = other DNA
accgactcatatatgagtcggtc

SEQ ID NO: 6278 - DNA, 23 bp, synthetic construct
  misc_feature 1..23: note = Description of Artificial Sequence: Syntheticoligonucleotide
  source 1..23: mol_type = other DNA
cacgactcatatatgagtcgtgc

SEQ ID NO: 6279 - DNA, 23 bp, synthetic construct
  misc_feature 1..23: note = Description of Artificial Sequence: Syntheticoligonucleotide
  source 1..23: mol_type = other DNA
ccagactcatatatgagtctggc

SEQ ID NO: 6280 - DNA, 23 bp, synthetic construct
  misc_feature 1..23: note = Description of Artificial Sequence: Syntheticoligonucleotide
  source 1..23: mol_type = other DNA
cccgactcatatatgagtcggga

SEQ ID NO: 6281 - DNA, 23 bp, synthetic construct
  misc_feature 1..23: note = Description of Artificial Sequence: Syntheticoligonucleotide
  source 1..23: mol_type = other DNA
tccgactcatatatgagtcggac

SEQ ID NO: 6282 - DNA, 23 bp, synthetic construct
  misc_feature 1..23: note = Description of Artificial Sequence: Syntheticoligonucleotide
  source 1..23: mol_type = other DNA
cctgactcatatatgagtcaggc

SEQ ID NO: 6283 - DNA, 23 bp, synthetic construct
  misc_feature 1..23: note = Description of Artificial Sequence: Syntheticoligonucleotide
  source 1..23: mol_type = other DNA
ggcgactcatatatgagtcgccc

SEQ ID NO: 6284 - DNA, 23 bp, synthetic construct
  misc_feature 1..23: note = Description of Artificial Sequence: Syntheticoligonucleotide
  source 1..23: mol_type = other DNA
ggcgactcatatatgagtcgcct

SEQ ID NO: 6285 - DNA, 23 bp, synthetic construct
  misc_feature 1..23: note = Description of Artificial Sequence: Syntheticoligonucleotide
  source 1..23: mol_type = other DNA
agcgactcatatatgagtcgctc

SEQ ID NO: 6286 - DNA, 23 bp, synthetic construct
  misc_feature 1..23: note = Description of Artificial Sequence: Syntheticoligonucleotide
  source 1..23: mol_type = other DNA
gacgactcatatatgagtcgtcc

SEQ ID NO: 6287 - DNA, 23 bp, synthetic construct
  misc_feature 1..23: note = Description of Artificial Sequence: Syntheticoligonucleotide
  source 1..23: mol_type = other DNA
ggagactcatatatgagtctccc

SEQ ID NO: 6288 - DNA, 23 bp, synthetic construct
  misc_feature 1..23: note = Description of Artificial Sequence: Syntheticoligonucleotide
  source 1..23: mol_type = other DNA
ggcgactcatatatgagtcgcca

SEQ ID NO: 6289 - DNA, 23 bp, synthetic construct
  misc_feature 1..23: note = Description of Artificial Sequence: Syntheticoligonucleotide
  source 1..23: mol_type = other DNA
tgcgactcatatatgagtcgcac

SEQ ID NO: 6290 - DNA, 23 bp, synthetic construct
  misc_feature 1..23: note = Description of Artificial Sequence: Syntheticoligonucleotide
  source 1..23: mol_type = other DNA
ggtgactcatatatgagtcaccc

SEQ ID NO: 6291 - DNA, 23 bp, synthetic construct
  misc_feature 1..23: note = Description of Artificial Sequence: Syntheticoligonucleotide
  source 1..23: mol_type = other DNA
cgggactcatatatgagtcccgt

SEQ ID NO: 6292 - DNA, 23 bp, synthetic construct
  misc_feature 1..23: note = Description of Artificial Sequence: Syntheticoligonucleotide
  source 1..23: mol_type = other DNA
agggactcatatatgagtccctg

SEQ ID NO: 6293 - DNA, 23 bp, synthetic construct
  misc_feature 1..23: note = Description of Artificial Sequence: Syntheticoligonucleotide
  source 1..23: mol_type = other DNA
caggactcatatatgagtcctgg

SEQ ID NO: 6294 - DNA, 23 bp, synthetic construct
  misc_feature 1..23: note = Description of Artificial Sequence: Syntheticoligonucleotide
  source 1..23: mol_type = other DNA
cgagactcatatatgagtctcgg

SEQ ID NO: 6295 - DNA, 23 bp, synthetic construct
  misc_feature 1..23: note = Description of Artificial Sequence: Syntheticoligonucleotide
  source 1..23: mol_type = other DNA
cgggactcatatatgagtcccga

SEQ ID NO: 6296 - DNA, 23 bp, synthetic construct
  misc_feature 1..23: note = Description of Artificial Sequence: Syntheticoligonucleotide
  source 1..23: mol_type = other DNA
tgggactcatatatgagtcccag

SEQ ID NO: 6297 - DNA, 23 bp, synthetic construct
  misc_feature 1..23: note = Description of Artificial Sequence: Syntheticoligonucleotide
  source 1..23: mol_type = other DNA
ctggactcatatatgagtccagg

SEQ ID NO: 6298 - DNA, 23 bp, synthetic construct
  misc_feature 1..23: note = Description of Artificial Sequence: Syntheticoligonucleotide
  source 1..23: mol_type = other DNA
cgtgactcatatatgagtcacgg

SEQ ID NO: 6299 - DNA, 23 bp, synthetic construct
  misc_feature 1..23: note = Description of Artificial Sequence: Syntheticoligonucleotide
  source 1..23: mol_type = other DNA
ggcgactcatatatgagtcgccg

SEQ ID NO: 6300 - DNA, 23 bp, synthetic construct
  misc_feature 1..23: note = Description of Artificial Sequence: Syntheticoligonucleotide
  source 1..23: mol_type = other DNA
agcgactcatatatgagtcgctg

SEQ ID NO: 6301 - DNA, 23 bp, synthetic construct
  misc_feature 1..23: note = Description of Artificial Sequence: Syntheticoligonucleotide
  source 1..23: mol_type = other DNA
gacgactcatatatgagtcgtcg

SEQ ID NO: 6302 - DNA, 23 bp, synthetic construct
  misc_feature 1..23: note = Description of Artificial Sequence: Syntheticoligonucleotide
  source 1..23: mol_type = other DNA
ggagactcatatatgagtctccg

SEQ ID NO: 6303 - DNA, 23 bp, synthetic construct
  misc_feature 1..23: note = Description of Artificial Sequence: Syntheticoligonucleotide
  source 1..23: mol_type = other DNA
tgcgactcatatatgagtcgcag

SEQ ID NO: 6304 - DNA, 23 bp, synthetic construct
  misc_feature 1..23: note = Description of Artificial Sequence: Syntheticoligonucleotide
  source 1..23: mol_type = other DNA
ggtgactcatatatgagtcaccg

SEQ ID NO: 6305 - DNA, 23 bp, synthetic construct
  misc_feature 1..23: note = Description of Artificial Sequence: Syntheticoligonucleotide
  source 1..23: mol_type = other DNA
acggactcatatatgagtccgtg

SEQ ID NO: 6306 - DNA, 23 bp, synthetic construct
  misc_feature 1..23: note = Description of Artificial Sequence: Syntheticoligonucleotide
  source 1..23: mol_type = other DNA
ccagactcatatatgagtctggg

SEQ ID NO: 6307 - DNA, 23 bp, synthetic construct
  misc_feature 1..23: note = Description of Artificial Sequence: Syntheticoligonucleotide
  source 1..23: mol_type = other DNA
tcggactcatatatgagtccgag

SEQ ID NO: 6308 - DNA, 23 bp, synthetic construct
  misc_feature 1..23: note = Description of Artificial Sequence: Syntheticoligonucleotide
  source 1..23: mol_type = other DNA
cctgactcatatatgagtcaggg

SEQ ID NO: 6309 - DNA, 23 bp, synthetic construct
  misc_feature 1..23: note = Description of Artificial Sequence: Syntheticoligonucleotide
  source 1..23: mol_type = other DNA
cacgactcatatatgagtcgtgg

SEQ ID NO: 6310 - DNA, 23 bp, synthetic construct
  misc_feature 1..23: note = Description of Artificial Sequence: Syntheticoligonucleotide
  source 1..23: mol_type = other DNA
gccgactcatatatgagtcggct

SEQ ID NO: 6311 - DNA, 23 bp, synthetic construct
  misc_feature 1..23: note = Description of Artificial Sequence: Syntheticoligonucleotide
  source 1..23: mol_type = other DNA
gccgactcatatatgagtcggca

SEQ ID NO: 6312 - DNA, 23 bp, synthetic construct
  misc_feature 1..23: note = Description of Artificial Sequence: Syntheticoligonucleotide
  source 1..23: mol_type = other DNA
cgagactcatatatgagtctcgc

SEQ ID NO: 6313 - DNA, 23 bp, synthetic construct
  misc_feature 1..23: note = Description of Artificial Sequence: Syntheticoligonucleotide
  source 1..23: mol_type = other DNA
cgtgactcatatatgagtcacgc

SEQ ID NO: 6314 - DNA, 23 bp, synthetic construct
  misc_feature 1..23: note = Description of Artificial Sequence: Syntheticoligonucleotide
  source 1..23: mol_type = other DNA
caggactcatatatgagtcctgc

SEQ ID NO: 6315 - DNA, 23 bp, synthetic construct
  misc_feature 1..23: note = Description of Artificial Sequence: Syntheticoligonucleotide
  source 1..23: mol_type = other DNA
ctggactcatatatgagtccagc

SEQ ID NO: 6316 - DNA, 23 bp, synthetic construct
  misc_feature 1..23: note = Description of Artificial Sequence: Syntheticoligonucleotide
  source 1..23: mol_type = other DNA
gaggactcatatatgagtcctcg

SEQ ID NO: 6317 - DNA, 23 bp, synthetic construct
  misc_feature 1..23: note = Description of Artificial Sequence: Syntheticoligonucleotide
  source 1..23: mol_type = other DNA
gtggactcatatatgagtccacg

SEQ ID NO: 6318 - DNA, 23 bp, synthetic construct
  misc_feature 1..23: note = Description of Artificial Sequence: Syntheticoligonucleotide
  source 1..23: mol_type = other DNA
accgactcatatatgagtcggtg

SEQ ID NO: 6319 - DNA, 23 bp, synthetic construct
  misc_feature 1..23: note = Description of Artificial Sequence: Syntheticoligonucleotide
  source 1..23: mol_type = other DNA
tccgactcatatatgagtcggag

SEQ ID NO: 6320 - DNA, 23 bp, synthetic construct
  misc_feature 1..23: note = Description of Artificial Sequence: Syntheticoligonucleotide
  source 1..23: mol_type = other DNA
cgggactcatatatgagtcccgc

SEQ ID NO: 6321 - DNA, 23 bp, synthetic construct
  misc_feature 1..23: note = Description of Artificial Sequence: Syntheticoligonucleotide
  source 1..23: mol_type = other DNA
agggactcatatatgagtccctc

SEQ ID NO: 6322 - DNA, 23 bp, synthetic construct
  misc_feature 1..23: note = Description of Artificial Sequence: Syntheticoligonucleotide
  source 1..23: mol_type = other DNA
tgggactcatatatgagtcccac

SEQ ID NO: 6323 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcattaatgagtcnnnn

SEQ ID NO: 6324 - DNA, 23 bp, synthetic construct
  misc_feature 1..23: note = Description of Artificial Sequence: Syntheticoligonucleotide
  source 1..23: mol_type = other DNA
gcggactcattaatgagtccgcc

SEQ ID NO: 6325 - DNA, 23 bp, synthetic construct
  misc_feature 1..23: note = Description of Artificial Sequence: Syntheticoligonucleotide
  source 1..23: mol_type = other DNA
gcggactcattaatgagtccgct

SEQ ID NO: 6326 - DNA, 23 bp, synthetic construct
  misc_feature 1..23: note = Description of Artificial Sequence: Syntheticoligonucleotide
  source 1..23: mol_type = other DNA
acggactcattaatgagtccgtc

SEQ ID NO: 6327 - DNA, 23 bp, synthetic construct
  misc_feature 1..23: note = Description of Artificial Sequence: Syntheticoligonucleotide
  source 1..23: mol_type = other DNA
gaggactcattaatgagtcctcc

SEQ ID NO: 6328 - DNA, 23 bp, synthetic construct
  misc_feature 1..23: note = Description of Artificial Sequence: Syntheticoligonucleotide
  source 1..23: mol_type = other DNA
gcagactcattaatgagtctgcc

SEQ ID NO: 6329 - DNA, 23 bp, synthetic construct
  misc_feature 1..23: note = Description of Artificial Sequence: Syntheticoligonucleotide
  source 1..23: mol_type = other DNA
gcggactcattaatgagtccgca

SEQ ID NO: 6330 - DNA, 23 bp, synthetic construct
  misc_feature 1..23: note = Description of Artificial Sequence: Syntheticoligonucleotide
  source 1..23: mol_type = other DNA
tcggactcattaatgagtccgac

SEQ ID NO: 6331 - DNA, 23 bp, synthetic construct
  misc_feature 1..23: note = Description of Artificial Sequence: Syntheticoligonucleotide
  source 1..23: mol_type = other DNA
gtggactcattaatgagtccacc

SEQ ID NO: 6332 - DNA, 23 bp, synthetic construct
  misc_feature 1..23: note = Description of Artificial Sequence: Syntheticoligonucleotide
  source 1..23: mol_type = other DNA
gctgactcattaatgagtcagcc

SEQ ID NO: 6333 - DNA, 23 bp, synthetic construct
  misc_feature 1..23: note = Description of Artificial Sequence: Syntheticoligonucleotide
  source 1..23: mol_type = other DNA
cccgactcattaatgagtcgggc

SEQ ID NO: 6334 - DNA, 23 bp, synthetic construct
  misc_feature 1..23: note = Description of Artificial Sequence: Syntheticoligonucleotide
  source 1..23: mol_type = other DNA
cccgactcattaatgagtcgggt

SEQ ID NO: 6335 - DNA, 23 bp, synthetic construct
  misc_feature 1..23: note = Description of Artificial Sequence: Syntheticoligonucleotide
  source 1..23: mol_type = other DNA
accgactcattaatgagtcggtc

SEQ ID NO: 6336 - DNA, 23 bp, synthetic construct
  misc_feature 1..23: note = Description of Artificial Sequence: Syntheticoligonucleotide
  source 1..23: mol_type = other DNA
cacgactcattaatgagtcgtgc

SEQ ID NO: 6337 - DNA, 23 bp, synthetic construct
  misc_feature 1..23: note = Description of Artificial Sequence: Syntheticoligonucleotide
  source 1..23: mol_type = other DNA
ccagactcattaatgagtctggc

SEQ ID NO: 6338 - DNA, 23 bp, synthetic construct
  misc_feature 1..23: note = Description of Artificial Sequence: Syntheticoligonucleotide
  source 1..23: mol_type = other DNA
cccgactcattaatgagtcggga

SEQ ID NO: 6339 - DNA, 23 bp, synthetic construct
  misc_feature 1..23: note = Description of Artificial Sequence: Syntheticoligonucleotide
  source 1..23: mol_type = other DNA
tccgactcattaatgagtcggac

SEQ ID NO: 6340 - DNA, 23 bp, synthetic construct
  misc_feature 1..23: note = Description of Artificial Sequence: Syntheticoligonucleotide
  source 1..23: mol_type = other DNA
cctgactcattaatgagtcaggc

SEQ ID NO: 6341 - DNA, 23 bp, synthetic construct
  misc_feature 1..23: note = Description of Artificial Sequence: Syntheticoligonucleotide
  source 1..23: mol_type = other DNA
ggcgactcattaatgagtcgccc

SEQ ID NO: 6342 - DNA, 23 bp, synthetic construct
  misc_feature 1..23: note = Description of Artificial Sequence: Syntheticoligonucleotide
  source 1..23: mol_type = other DNA
ggcgactcattaatgagtcgcct

SEQ ID NO: 6343 - DNA, 23 bp, synthetic construct
  misc_feature 1..23: note = Description of Artificial Sequence: Syntheticoligonucleotide
  source 1..23: mol_type = other DNA
agcgactcattaatgagtcgctc

SEQ ID NO: 6344 - DNA, 23 bp, synthetic construct
  misc_feature 1..23: note = Description of Artificial Sequence: Syntheticoligonucleotide
  source 1..23: mol_type = other DNA
gacgactcattaatgagtcgtcc

SEQ ID NO: 6345 - DNA, 23 bp, synthetic construct
  misc_feature 1..23: note = Description of Artificial Sequence: Syntheticoligonucleotide
  source 1..23: mol_type = other DNA
ggagactcattaatgagtctccc

SEQ ID NO: 6346 - DNA, 23 bp, synthetic construct
  misc_feature 1..23: note = Description of Artificial Sequence: Syntheticoligonucleotide
  source 1..23: mol_type = other DNA
ggcgactcattaatgagtcgcca

SEQ ID NO: 6347 - DNA, 23 bp, synthetic construct
  misc_feature 1..23: note = Description of Artificial Sequence: Syntheticoligonucleotide
  source 1..23: mol_type = other DNA
tgcgactcattaatgagtcgcac

SEQ ID NO: 6348 - DNA, 23 bp, synthetic construct
  misc_feature 1..23: note = Description of Artificial Sequence: Syntheticoligonucleotide
  source 1..23: mol_type = other DNA
ggtgactcattaatgagtcaccc

SEQ ID NO: 6349 - DNA, 23 bp, synthetic construct
  misc_feature 1..23: note = Description of Artificial Sequence: Syntheticoligonucleotide
  source 1..23: mol_type = other DNA
cgggactcattaatgagtcccgt

SEQ ID NO: 6350 - DNA, 23 bp, synthetic construct
  misc_feature 1..23: note = Description of Artificial Sequence: Syntheticoligonucleotide
  source 1..23: mol_type = other DNA
agggactcattaatgagtccctg

SEQ ID NO: 6351 - DNA, 23 bp, synthetic construct
  misc_feature 1..23: note = Description of Artificial Sequence: Syntheticoligonucleotide
  source 1..23: mol_type = other DNA
caggactcattaatgagtcctgg

SEQ ID NO: 6352 - DNA, 23 bp, synthetic construct
  misc_feature 1..23: note = Description of Artificial Sequence: Syntheticoligonucleotide
  source 1..23: mol_type = other DNA
cgagactcattaatgagtctcgg

SEQ ID NO: 6353 - DNA, 23 bp, synthetic construct
  misc_feature 1..23: note = Description of Artificial Sequence: Syntheticoligonucleotide
  source 1..23: mol_type = other DNA
cgggactcattaatgagtcccga

SEQ ID NO: 6354 - DNA, 23 bp, synthetic construct
  misc_feature 1..23: note = Description of Artificial Sequence: Syntheticoligonucleotide
  source 1..23: mol_type = other DNA
tgggactcattaatgagtcccag

SEQ ID NO: 6355 - DNA, 23 bp, synthetic construct
  misc_feature 1..23: note = Description of Artificial Sequence: Syntheticoligonucleotide
  source 1..23: mol_type = other DNA
ctggactcattaatgagtccagg

SEQ ID NO: 6356 - DNA, 23 bp, synthetic construct
  misc_feature 1..23: note = Description of Artificial Sequence: Syntheticoligonucleotide
  source 1..23: mol_type = other DNA
cgtgactcattaatgagtcacgg

SEQ ID NO: 6357 - DNA, 23 bp, synthetic construct
  misc_feature 1..23: note = Description of Artificial Sequence: Syntheticoligonucleotide
  source 1..23: mol_type = other DNA
ggcgactcattaatgagtcgccg

SEQ ID NO: 6358 - DNA, 23 bp, synthetic construct
  misc_feature 1..23: note = Description of Artificial Sequence: Syntheticoligonucleotide
  source 1..23: mol_type = other DNA
agcgactcattaatgagtcgctg

SEQ ID NO: 6359 - DNA, 23 bp, synthetic construct
  misc_feature 1..23: note = Description of Artificial Sequence: Syntheticoligonucleotide
  source 1..23: mol_type = other DNA
gacgactcattaatgagtcgtcg

SEQ ID NO: 6360 - DNA, 23 bp, synthetic construct
  misc_feature 1..23: note = Description of Artificial Sequence: Syntheticoligonucleotide
  source 1..23: mol_type = other DNA
ggagactcattaatgagtctccg

SEQ ID NO: 6361 - DNA, 23 bp, synthetic construct
  misc_feature 1..23: note = Description of Artificial Sequence: Syntheticoligonucleotide
  source 1..23: mol_type = other DNA
tgcgactcattaatgagtcgcag

SEQ ID NO: 6362 - DNA, 23 bp, synthetic construct
  misc_feature 1..23: note = Description of Artificial Sequence: Syntheticoligonucleotide
  source 1..23: mol_type = other DNA
ggtgactcattaatgagtcaccg

SEQ ID NO: 6363 - DNA, 23 bp, synthetic construct
  misc_feature 1..23: note = Description of Artificial Sequence: Syntheticoligonucleotide
  source 1..23: mol_type = other DNA
acggactcattaatgagtccgtg

SEQ ID NO: 6364 - DNA, 23 bp, synthetic construct
  misc_feature 1..23: note = Description of Artificial Sequence: Syntheticoligonucleotide
  source 1..23: mol_type = other DNA
ccagactcattaatgagtctggg

SEQ ID NO: 6365 - DNA, 23 bp, synthetic construct
  misc_feature 1..23: note = Description of Artificial Sequence: Syntheticoligonucleotide
  source 1..23: mol_type = other DNA
tcggactcattaatgagtccgag

SEQ ID NO: 6366 - DNA, 23 bp, synthetic construct
  misc_feature 1..23: note = Description of Artificial Sequence: Syntheticoligonucleotide
  source 1..23: mol_type = other DNA
cctgactcattaatgagtcaggg

SEQ ID NO: 6367 - DNA, 23 bp, synthetic construct
  misc_feature 1..23: note = Description of Artificial Sequence: Syntheticoligonucleotide
  source 1..23: mol_type = other DNA
cacgactcattaatgagtcgtgg

SEQ ID NO: 6368 - DNA, 23 bp, synthetic construct
  misc_feature 1..23: note = Description of Artificial Sequence: Syntheticoligonucleotide
  source 1..23: mol_type = other DNA
gccgactcattaatgagtcggct

SEQ ID NO: 6369 - DNA, 23 bp, synthetic construct
  misc_feature 1..23: note = Description of Artificial Sequence: Syntheticoligonucleotide
  source 1..23: mol_type = other DNA
gccgactcattaatgagtcggca

SEQ ID NO: 6370 - DNA, 23 bp, synthetic construct
  misc_feature 1..23: note = Description of Artificial Sequence: Syntheticoligonucleotide
  source 1..23: mol_type = other DNA
cgagactcattaatgagtctcgc

SEQ ID NO: 6371 - DNA, 23 bp, synthetic construct
  misc_feature 1..23: note = Description of Artificial Sequence: Syntheticoligonucleotide
  source 1..23: mol_type = other DNA
cgtgactcattaatgagtcacgc

SEQ ID NO: 6372 - DNA, 23 bp, synthetic construct
  misc_feature 1..23: note = Description of Artificial Sequence: Syntheticoligonucleotide
  source 1..23: mol_type = other DNA
caggactcattaatgagtcctgc

SEQ ID NO: 6373 - DNA, 23 bp, synthetic construct
  misc_feature 1..23: note = Description of Artificial Sequence: Syntheticoligonucleotide
  source 1..23: mol_type = other DNA
ctggactcattaatgagtccagc

SEQ ID NO: 6374 - DNA, 23 bp, synthetic construct
  misc_feature 1..23: note = Description of Artificial Sequence: Syntheticoligonucleotide
  source 1..23: mol_type = other DNA
gaggactcattaatgagtcctcg

SEQ ID NO: 6375 - DNA, 23 bp, synthetic construct
  misc_feature 1..23: note = Description of Artificial Sequence: Syntheticoligonucleotide
  source 1..23: mol_type = other DNA
gtggactcattaatgagtccacg

SEQ ID NO: 6376 - DNA, 23 bp, synthetic construct
  misc_feature 1..23: note = Description of Artificial Sequence: Syntheticoligonucleotide
  source 1..23: mol_type = other DNA
accgactcattaatgagtcggtg

SEQ ID NO: 6377 - DNA, 23 bp, synthetic construct
  misc_feature 1..23: note = Description of Artificial Sequence: Syntheticoligonucleotide
  source 1..23: mol_type = other DNA
tccgactcattaatgagtcggag

SEQ ID NO: 6378 - DNA, 23 bp, synthetic construct
  misc_feature 1..23: note = Description of Artificial Sequence: Syntheticoligonucleotide
  source 1..23: mol_type = other DNA
cgggactcattaatgagtcccgc

SEQ ID NO: 6379 - DNA, 23 bp, synthetic construct
  misc_feature 1..23: note = Description of Artificial Sequence: Syntheticoligonucleotide
  source 1..23: mol_type = other DNA
agggactcattaatgagtccctc

SEQ ID NO: 6380 - DNA, 23 bp, synthetic construct
  misc_feature 1..23: note = Description of Artificial Sequence: Syntheticoligonucleotide
  source 1..23: mol_type = other DNA
tgggactcattaatgagtcccac

SEQ ID NO: 6381 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcatgcatgagtcnnnn

SEQ ID NO: 6382 - DNA, 23 bp, synthetic construct
  misc_feature 1..23: note = Description of Artificial Sequence: Syntheticoligonucleotide
  source 1..23: mol_type = other DNA
gcggactcatgcatgagtccgcc

SEQ ID NO: 6383 - DNA, 23 bp, synthetic construct
  misc_feature 1..23: note = Description of Artificial Sequence: Syntheticoligonucleotide
  source 1..23: mol_type = other DNA
gcggactcatgcatgagtccgct

SEQ ID NO: 6384 - DNA, 23 bp, synthetic construct
  misc_feature 1..23: note = Description of Artificial Sequence: Syntheticoligonucleotide
  source 1..23: mol_type = other DNA
acggactcatgcatgagtccgtc

SEQ ID NO: 6385 - DNA, 23 bp, synthetic construct
  misc_feature 1..23: note = Description of Artificial Sequence: Syntheticoligonucleotide
  source 1..23: mol_type = other DNA
gaggactcatgcatgagtcctcc

SEQ ID NO: 6386 - DNA, 23 bp, synthetic construct
  misc_feature 1..23: note = Description of Artificial Sequence: Syntheticoligonucleotide
  source 1..23: mol_type = other DNA
gcagactcatgcatgagtctgcc

SEQ ID NO: 6387 - DNA, 23 bp, synthetic construct
  misc_feature 1..23: note = Description of Artificial Sequence: Syntheticoligonucleotide
  source 1..23: mol_type = other DNA
gcggactcatgcatgagtccgca

SEQ ID NO: 6388 - DNA, 23 bp, synthetic construct
  misc_feature 1..23: note = Description of Artificial Sequence: Syntheticoligonucleotide
  source 1..23: mol_type = other DNA
tcggactcatgcatgagtccgac

SEQ ID NO: 6389 - DNA, 23 bp, synthetic construct
  misc_feature 1..23: note = Description of Artificial Sequence: Syntheticoligonucleotide
  source 1..23: mol_type = other DNA
gtggactcatgcatgagtccacc

SEQ ID NO: 6390 - DNA, 23 bp, synthetic construct
  misc_feature 1..23: note = Description of Artificial Sequence: Syntheticoligonucleotide
  source 1..23: mol_type = other DNA
gctgactcatgcatgagtcagcc

SEQ ID NO: 6391 - DNA, 23 bp, synthetic construct
  misc_feature 1..23: note = Description of Artificial Sequence: Syntheticoligonucleotide
  source 1..23: mol_type = other DNA
cccgactcatgcatgagtcgggc

SEQ ID NO: 6392 - DNA, 23 bp, synthetic construct
  misc_feature 1..23: note = Description of Artificial Sequence: Syntheticoligonucleotide
  source 1..23: mol_type = other DNA
cccgactcatgcatgagtcgggt

SEQ ID NO: 6393 - DNA, 23 bp, synthetic construct
  misc_feature 1..23: note = Description of Artificial Sequence: Syntheticoligonucleotide
  source 1..23: mol_type = other DNA
accgactcatgcatgagtcggtc

SEQ ID NO: 6394 - DNA, 23 bp, synthetic construct
  misc_feature 1..23: note = Description of Artificial Sequence: Syntheticoligonucleotide
  source 1..23: mol_type = other DNA
cacgactcatgcatgagtcgtgc

SEQ ID NO: 6395 - DNA, 23 bp, synthetic construct
  misc_feature 1..23: note = Description of Artificial Sequence: Syntheticoligonucleotide
  source 1..23: mol_type = other DNA
ccagactcatgcatgagtctggc

SEQ ID NO: 6396 - DNA, 23 bp, synthetic construct
  misc_feature 1..23: note = Description of Artificial Sequence: Syntheticoligonucleotide
  source 1..23: mol_type = other DNA
cccgactcatgcatgagtcggga

SEQ ID NO: 6397 - DNA, 23 bp, synthetic construct
  misc_feature 1..23: note = Description of Artificial Sequence: Syntheticoligonucleotide
  source 1..23: mol_type = other DNA
tccgactcatgcatgagtcggac

SEQ ID NO: 6398 - DNA, 23 bp, synthetic construct
  misc_feature 1..23: note = Description of Artificial Sequence: Syntheticoligonucleotide
  source 1..23: mol_type = other DNA
cctgactcatgcatgagtcaggc

SEQ ID NO: 6399 - DNA, 23 bp, synthetic construct
  misc_feature 1..23: note = Description of Artificial Sequence: Syntheticoligonucleotide
  source 1..23: mol_type = other DNA
ggcgactcatgcatgagtcgccc

SEQ ID NO: 6400 - DNA, 23 bp, synthetic construct
  misc_feature 1..23: note = Description of Artificial Sequence: Syntheticoligonucleotide
  source 1..23: mol_type = other DNA
ggcgactcatgcatgagtcgcct

SEQ ID NO: 6401 - DNA, 23 bp, synthetic construct
  misc_feature 1..23: note = Description of Artificial Sequence: Syntheticoligonucleotide
  source 1..23: mol_type = other DNA
agcgactcatgcatgagtcgctc

SEQ ID NO: 6402 - DNA, 23 bp, synthetic construct
  misc_feature 1..23: note = Description of Artificial Sequence: Syntheticoligonucleotide
  source 1..23: mol_type = other DNA
gacgactcatgcatgagtcgtcc

SEQ ID NO: 6403 - DNA, 23 bp, synthetic construct
  misc_feature 1..23: note = Description of Artificial Sequence: Syntheticoligonucleotide
  source 1..23: mol_type = other DNA
ggagactcatgcatgagtctccc

SEQ ID NO: 6404 - DNA, 23 bp, synthetic construct
  misc_feature 1..23: note = Description of Artificial Sequence: Syntheticoligonucleotide
  source 1..23: mol_type = other DNA
ggcgactcatgcatgagtcgcca

SEQ ID NO: 6405 - DNA, 23 bp, synthetic construct
  misc_feature 1..23: note = Description of Artificial Sequence: Syntheticoligonucleotide
  source 1..23: mol_type = other DNA
tgcgactcatgcatgagtcgcac

SEQ ID NO: 6406 - DNA, 23 bp, synthetic construct
  misc_feature 1..23: note = Description of Artificial Sequence: Syntheticoligonucleotide
  source 1..23: mol_type = other DNA
ggtgactcatgcatgagtcaccc

SEQ ID NO: 6407 - DNA, 23 bp, synthetic construct
  misc_feature 1..23: note = Description of Artificial Sequence: Syntheticoligonucleotide
  source 1..23: mol_type = other DNA
cgggactcatgcatgagtcccgt

SEQ ID NO: 6408 - DNA, 23 bp, synthetic construct
  misc_feature 1..23: note = Description of Artificial Sequence: Syntheticoligonucleotide
  source 1..23: mol_type = other DNA
agggactcatgcatgagtccctg

SEQ ID NO: 6409 - DNA, 23 bp, synthetic construct
  misc_feature 1..23: note = Description of Artificial Sequence: Syntheticoligonucleotide
  source 1..23: mol_type = other DNA
caggactcatgcatgagtcctgg

SEQ ID NO: 6410 - DNA, 23 bp, synthetic construct
  misc_feature 1..23: note = Description of Artificial Sequence: Syntheticoligonucleotide
  source 1..23: mol_type = other DNA
cgagactcatgcatgagtctcgg

SEQ ID NO: 6411 - DNA, 23 bp, synthetic construct
  misc_feature 1..23: note = Description of Artificial Sequence: Syntheticoligonucleotide
  source 1..23: mol_type = other DNA
cgggactcatgcatgagtcccga

SEQ ID NO: 6412 - DNA, 23 bp, synthetic construct
  misc_feature 1..23: note = Description of Artificial Sequence: Syntheticoligonucleotide
  source 1..23: mol_type = other DNA
tgggactcatgcatgagtcccag

SEQ ID NO: 6413 - DNA, 23 bp, synthetic construct
  misc_feature 1..23: note = Description of Artificial Sequence: Syntheticoligonucleotide
  source 1..23: mol_type = other DNA
ctggactcatgcatgagtccagg

SEQ ID NO: 6414 - DNA, 23 bp, synthetic construct
  misc_feature 1..23: note = Description of Artificial Sequence: Syntheticoligonucleotide
  source 1..23: mol_type = other DNA
cgtgactcatgcatgagtcacgg

SEQ ID NO: 6415 - DNA, 23 bp, synthetic construct
  misc_feature 1..23: note = Description of Artificial Sequence: Syntheticoligonucleotide
  source 1..23: mol_type = other DNA
ggcgactcatgcatgagtcgccg

SEQ ID NO: 6416 - DNA, 23 bp, synthetic construct
  misc_feature 1..23: note = Description of Artificial Sequence: Syntheticoligonucleotide
  source 1..23: mol_type = other DNA
agcgactcatgcatgagtcgctg

SEQ ID NO: 6417 - DNA, 23 bp, synthetic construct
  misc_feature 1..23: note = Description of Artificial Sequence: Syntheticoligonucleotide
  source 1..23: mol_type = other DNA
gacgactcatgcatgagtcgtcg

SEQ ID NO: 6418 - DNA, 23 bp, synthetic construct
  misc_feature 1..23: note = Description of Artificial Sequence: Syntheticoligonucleotide
  source 1..23: mol_type = other DNA
ggagactcatgcatgagtctccg

SEQ ID NO: 6419 - DNA, 23 bp, synthetic construct
  misc_feature 1..23: note = Description of Artificial Sequence: Syntheticoligonucleotide
  source 1..23: mol_type = other DNA
tgcgactcatgcatgagtcgcag

SEQ ID NO: 6420 - DNA, 23 bp, synthetic construct
  misc_feature 1..23: note = Description of Artificial Sequence: Syntheticoligonucleotide
  source 1..23: mol_type = other DNA
ggtgactcatgcatgagtcaccg

SEQ ID NO: 6421 - DNA, 23 bp, synthetic construct
  misc_feature 1..23: note = Description of Artificial Sequence: Syntheticoligonucleotide
  source 1..23: mol_type = other DNA
acggactcatgcatgagtccgtg

SEQ ID NO: 6422 - DNA, 23 bp, synthetic construct
  misc_feature 1..23: note = Description of Artificial Sequence: Syntheticoligonucleotide
  source 1..23: mol_type = other DNA
ccagactcatgcatgagtctggg

SEQ ID NO: 6423 - DNA, 23 bp, synthetic construct
  misc_feature 1..23: note = Description of Artificial Sequence: Syntheticoligonucleotide
  source 1..23: mol_type = other DNA
tcggactcatgcatgagtccgag

SEQ ID NO: 6424 - DNA, 23 bp, synthetic construct
  misc_feature 1..23: note = Description of Artificial Sequence: Syntheticoligonucleotide
  source 1..23: mol_type = other DNA
cctgactcatgcatgagtcaggg

SEQ ID NO: 6425 - DNA, 23 bp, synthetic construct
  misc_feature 1..23: note = Description of Artificial Sequence: Syntheticoligonucleotide
  source 1..23: mol_type = other DNA
cacgactcatgcatgagtcgtgg

SEQ ID NO: 6426 - DNA, 23 bp, synthetic construct
  misc_feature 1..23: note = Description of Artificial Sequence: Syntheticoligonucleotide
  source 1..23: mol_type = other DNA
gccgactcatgcatgagtcggct

SEQ ID NO: 6427 - DNA, 23 bp, synthetic construct
  misc_feature 1..23: note = Description of Artificial Sequence: Syntheticoligonucleotide
  source 1..23: mol_type = other DNA
gccgactcatgcatgagtcggca

SEQ ID NO: 6428 - DNA, 23 bp, synthetic construct
  misc_feature 1..23: note = Description of Artificial Sequence: Syntheticoligonucleotide
  source 1..23: mol_type = other DNA
cgagactcatgcatgagtctcgc

SEQ ID NO: 6429 - DNA, 23 bp, synthetic construct
  misc_feature 1..23: note = Description of Artificial Sequence: Syntheticoligonucleotide
  source 1..23: mol_type = other DNA
cgtgactcatgcatgagtcacgc

SEQ ID NO: 6430 - DNA, 23 bp, synthetic construct
  misc_feature 1..23: note = Description of Artificial Sequence: Syntheticoligonucleotide
  source 1..23: mol_type = other DNA
caggactcatgcatgagtcctgc

SEQ ID NO: 6431 - DNA, 23 bp, synthetic construct
  misc_feature 1..23: note = Description of Artificial Sequence: Syntheticoligonucleotide
  source 1..23: mol_type = other DNA
ctggactcatgcatgagtccagc

SEQ ID NO: 6432 - DNA, 23 bp, synthetic construct
  misc_feature 1..23: note = Description of Artificial Sequence: Syntheticoligonucleotide
  source 1..23: mol_type = other DNA
gaggactcatgcatgagtcctcg

SEQ ID NO: 6433 - DNA, 23 bp, synthetic construct
  misc_feature 1..23: note = Description of Artificial Sequence: Syntheticoligonucleotide
  source 1..23: mol_type = other DNA
gtggactcatgcatgagtccacg

SEQ ID NO: 6434 - DNA, 23 bp, synthetic construct
  misc_feature 1..23: note = Description of Artificial Sequence: Syntheticoligonucleotide
  source 1..23: mol_type = other DNA
accgactcatgcatgagtcggtg

SEQ ID NO: 6435 - DNA, 23 bp, synthetic construct
  misc_feature 1..23: note = Description of Artificial Sequence: Syntheticoligonucleotide
  source 1..23: mol_type = other DNA
tccgactcatgcatgagtcggag

SEQ ID NO: 6436 - DNA, 23 bp, synthetic construct
  misc_feature 1..23: note = Description of Artificial Sequence: Syntheticoligonucleotide
  source 1..23: mol_type = other DNA
cgggactcatgcatgagtcccgc

SEQ ID NO: 6437 - DNA, 23 bp, synthetic construct
  misc_feature 1..23: note = Description of Artificial Sequence: Syntheticoligonucleotide
  source 1..23: mol_type = other DNA
agggactcatgcatgagtccctc

SEQ ID NO: 6438 - DNA, 23 bp, synthetic construct
  misc_feature 1..23: note = Description of Artificial Sequence: Syntheticoligonucleotide
  source 1..23: mol_type = other DNA
tgggactcatgcatgagtcccac

SEQ ID NO: 6439 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcatcgatgagtcnnnn

SEQ ID NO: 6440 - DNA, 23 bp, synthetic construct
  misc_feature 1..23: note = Description of Artificial Sequence: Syntheticoligonucleotide
  source 1..23: mol_type = other DNA
gcggactcatcgatgagtccgcc

SEQ ID NO: 6441 - DNA, 23 bp, synthetic construct
  misc_feature 1..23: note = Description of Artificial Sequence: Syntheticoligonucleotide
  source 1..23: mol_type = other DNA
gcggactcatcgatgagtccgct

SEQ ID NO: 6442 - DNA, 23 bp, synthetic construct
  misc_feature 1..23: note = Description of Artificial Sequence: Syntheticoligonucleotide
  source 1..23: mol_type = other DNA
acggactcatcgatgagtccgtc

SEQ ID NO: 6443 - DNA, 23 bp, synthetic construct
  misc_feature 1..23: note = Description of Artificial Sequence: Syntheticoligonucleotide
  source 1..23: mol_type = other DNA
gaggactcatcgatgagtcctcc

SEQ ID NO: 6444 - DNA, 23 bp, synthetic construct
  misc_feature 1..23: note = Description of Artificial Sequence: Syntheticoligonucleotide
  source 1..23: mol_type = other DNA
gcagactcatcgatgagtctgcc

SEQ ID NO: 6445 - DNA, 23 bp, synthetic construct
  misc_feature 1..23: note = Description of Artificial Sequence: Syntheticoligonucleotide
  source 1..23: mol_type = other DNA
gcggactcatcgatgagtccgca

SEQ ID NO: 6446 - DNA, 23 bp, synthetic construct
  misc_feature 1..23: note = Description of Artificial Sequence: Syntheticoligonucleotide
  source 1..23: mol_type = other DNA
tcggactcatcgatgagtccgac

SEQ ID NO: 6447 - DNA, 23 bp, synthetic construct
  misc_feature 1..23: note = Description of Artificial Sequence: Syntheticoligonucleotide
  source 1..23: mol_type = other DNA
gtggactcatcgatgagtccacc

SEQ ID NO: 6448 - DNA, 23 bp, synthetic construct
  misc_feature 1..23: note = Description of Artificial Sequence: Syntheticoligonucleotide
  source 1..23: mol_type = other DNA
gctgactcatcgatgagtcagcc

SEQ ID NO: 6449 - DNA, 23 bp, synthetic construct
  misc_feature 1..23: note = Description of Artificial Sequence: Syntheticoligonucleotide
  source 1..23: mol_type = other DNA
cccgactcatcgatgagtcgggc

SEQ ID NO: 6450 - DNA, 23 bp, synthetic construct
  misc_feature 1..23: note = Description of Artificial Sequence: Syntheticoligonucleotide
  source 1..23: mol_type = other DNA
cccgactcatcgatgagtcgggt

SEQ ID NO: 6451 - DNA, 23 bp, synthetic construct
  misc_feature 1..23: note = Description of Artificial Sequence: Syntheticoligonucleotide
  source 1..23: mol_type = other DNA
accgactcatcgatgagtcggtc

SEQ ID NO: 6452 - DNA, 23 bp, synthetic construct
  misc_feature 1..23: note = Description of Artificial Sequence: Syntheticoligonucleotide
  source 1..23: mol_type = other DNA
cacgactcatcgatgagtcgtgc

SEQ ID NO: 6453 - DNA, 23 bp, synthetic construct
  misc_feature 1..23: note = Description of Artificial Sequence: Syntheticoligonucleotide
  source 1..23: mol_type = other DNA
ccagactcatcgatgagtctggc

SEQ ID NO: 6454 - DNA, 23 bp, synthetic construct
  misc_feature 1..23: note = Description of Artificial Sequence: Syntheticoligonucleotide
  source 1..23: mol_type = other DNA
cccgactcatcgatgagtcggga

SEQ ID NO: 6455 - DNA, 23 bp, synthetic construct
  misc_feature 1..23: note = Description of Artificial Sequence: Syntheticoligonucleotide
  source 1..23: mol_type = other DNA
tccgactcatcgatgagtcggac

SEQ ID NO: 6456 - DNA, 23 bp, synthetic construct
  misc_feature 1..23: note = Description of Artificial Sequence: Syntheticoligonucleotide
  source 1..23: mol_type = other DNA
cctgactcatcgatgagtcaggc

SEQ ID NO: 6457 - DNA, 23 bp, synthetic construct
  misc_feature 1..23: note = Description of Artificial Sequence: Syntheticoligonucleotide
  source 1..23: mol_type = other DNA
ggcgactcatcgatgagtcgccc

SEQ ID NO: 6458 - DNA, 23 bp, synthetic construct
  misc_feature 1..23: note = Description of Artificial Sequence: Syntheticoligonucleotide
  source 1..23: mol_type = other DNA
ggcgactcatcgatgagtcgcct

SEQ ID NO: 6459 - DNA, 23 bp, synthetic construct
  misc_feature 1..23: note = Description of Artificial Sequence: Syntheticoligonucleotide
  source 1..23: mol_type = other DNA
agcgactcatcgatgagtcgctc

SEQ ID NO: 6460 - DNA, 23 bp, synthetic construct
  misc_feature 1..23: note = Description of Artificial Sequence: Syntheticoligonucleotide
  source 1..23: mol_type = other DNA
gacgactcatcgatgagtcgtcc

SEQ ID NO: 6461 - DNA, 23 bp, synthetic construct
  misc_feature 1..23: note = Description of Artificial Sequence: Syntheticoligonucleotide
  source 1..23: mol_type = other DNA
ggagactcatcgatgagtctccc

SEQ ID NO: 6462 - DNA, 23 bp, synthetic construct
  misc_feature 1..23: note = Description of Artificial Sequence: Syntheticoligonucleotide
  source 1..23: mol_type = other DNA
ggcgactcatcgatgagtcgcca

SEQ ID NO: 6463 - DNA, 23 bp, synthetic construct
  misc_feature 1..23: note = Description of Artificial Sequence: Syntheticoligonucleotide
  source 1..23: mol_type = other DNA
tgcgactcatcgatgagtcgcac

SEQ ID NO: 6464 - DNA, 23 bp, synthetic construct
  misc_feature 1..23: note = Description of Artificial Sequence: Syntheticoligonucleotide
  source 1..23: mol_type = other DNA
ggtgactcatcgatgagtcaccc

SEQ ID NO: 6465 - DNA, 23 bp, synthetic construct
  misc_feature 1..23: note = Description of Artificial Sequence: Syntheticoligonucleotide
  source 1..23: mol_type = other DNA
cgggactcatcgatgagtcccgt

SEQ ID NO: 6466 - DNA, 23 bp, synthetic construct
  misc_feature 1..23: note = Description of Artificial Sequence: Syntheticoligonucleotide
  source 1..23: mol_type = other DNA
agggactcatcgatgagtccctg

SEQ ID NO: 6467 - DNA, 23 bp, synthetic construct
  misc_feature 1..23: note = Description of Artificial Sequence: Syntheticoligonucleotide
  source 1..23: mol_type = other DNA
caggactcatcgatgagtcctgg

SEQ ID NO: 6468 - DNA, 23 bp, synthetic construct
  misc_feature 1..23: note = Description of Artificial Sequence: Syntheticoligonucleotide
  source 1..23: mol_type = other DNA
cgagactcatcgatgagtctcgg

SEQ ID NO: 6469 - DNA, 23 bp, synthetic construct
  misc_feature 1..23: note = Description of Artificial Sequence: Syntheticoligonucleotide
  source 1..23: mol_type = other DNA
cgggactcatcgatgagtcccga

SEQ ID NO: 6470 - DNA, 23 bp, synthetic construct
  misc_feature 1..23: note = Description of Artificial Sequence: Syntheticoligonucleotide
  source 1..23: mol_type = other DNA
tgggactcatcgatgagtcccag

SEQ ID NO: 6471 - DNA, 23 bp, synthetic construct
  misc_feature 1..23: note = Description of Artificial Sequence: Syntheticoligonucleotide
  source 1..23: mol_type = other DNA
ctggactcatcgatgagtccagg

SEQ ID NO: 6472 - DNA, 23 bp, synthetic construct
  misc_feature 1..23: note = Description of Artificial Sequence: Syntheticoligonucleotide
  source 1..23: mol_type = other DNA
cgtgactcatcgatgagtcacgg

SEQ ID NO: 6473 - DNA, 23 bp, synthetic construct
  misc_feature 1..23: note = Description of Artificial Sequence: Syntheticoligonucleotide
  source 1..23: mol_type = other DNA
ggcgactcatcgatgagtcgccg

SEQ ID NO: 6474 - DNA, 23 bp, synthetic construct
  misc_feature 1..23: note = Description of Artificial Sequence: Syntheticoligonucleotide
  source 1..23: mol_type = other DNA
agcgactcatcgatgagtcgctg

SEQ ID NO: 6475 - DNA, 23 bp, synthetic construct
  misc_feature 1..23: note = Description of Artificial Sequence: Syntheticoligonucleotide
  source 1..23: mol_type = other DNA
gacgactcatcgatgagtcgtcg

SEQ ID NO: 6476 - DNA, 23 bp, synthetic construct
  misc_feature 1..23: note = Description of Artificial Sequence: Syntheticoligonucleotide
  source 1..23: mol_type = other DNA
ggagactcatcgatgagtctccg

SEQ ID NO: 6477 - DNA, 23 bp, synthetic construct
  misc_feature 1..23: note = Description of Artificial Sequence: Syntheticoligonucleotide
  source 1..23: mol_type = other DNA
tgcgactcatcgatgagtcgcag

SEQ ID NO: 6478 - DNA, 23 bp, synthetic construct
  misc_feature 1..23: note = Description of Artificial Sequence: Syntheticoligonucleotide
  source 1..23: mol_type = other DNA
ggtgactcatcgatgagtcaccg

SEQ ID NO: 6479 - DNA, 23 bp, synthetic construct
  misc_feature 1..23: note = Description of Artificial Sequence: Syntheticoligonucleotide
  source 1..23: mol_type = other DNA
acggactcatcgatgagtccgtg

SEQ ID NO: 6480 - DNA, 23 bp, synthetic construct
  misc_feature 1..23: note = Description of Artificial Sequence: Syntheticoligonucleotide
  source 1..23: mol_type = other DNA
ccagactcatcgatgagtctggg

SEQ ID NO: 6481 - DNA, 23 bp, synthetic construct
  misc_feature 1..23: note = Description of Artificial Sequence: Syntheticoligonucleotide
  source 1..23: mol_type = other DNA
tcggactcatcgatgagtccgag

SEQ ID NO: 6482 - DNA, 23 bp, synthetic construct
  misc_feature 1..23: note = Description of Artificial Sequence: Syntheticoligonucleotide
  source 1..23: mol_type = other DNA
cctgactcatcgatgagtcaggg

SEQ ID NO: 6483 - DNA, 23 bp, synthetic construct
  misc_feature 1..23: note = Description of Artificial Sequence: Syntheticoligonucleotide
  source 1..23: mol_type = other DNA
cacgactcatcgatgagtcgtgg

SEQ ID NO: 6484 - DNA, 23 bp, synthetic construct
  misc_feature 1..23: note = Description of Artificial Sequence: Syntheticoligonucleotide
  source 1..23: mol_type = other DNA
gccgactcatcgatgagtcggct

SEQ ID NO: 6485 - DNA, 23 bp, synthetic construct
  misc_feature 1..23: note = Description of Artificial Sequence: Syntheticoligonucleotide
  source 1..23: mol_type = other DNA
gccgactcatcgatgagtcggca

SEQ ID NO: 6486 - DNA, 23 bp, synthetic construct
  misc_feature 1..23: note = Description of Artificial Sequence: Syntheticoligonucleotide
  source 1..23: mol_type = other DNA
cgagactcatcgatgagtctcgc

SEQ ID NO: 6487 - DNA, 23 bp, synthetic construct
  misc_feature 1..23: note = Description of Artificial Sequence: Syntheticoligonucleotide
  source 1..23: mol_type = other DNA
cgtgactcatcgatgagtcacgc

SEQ ID NO: 6488 - DNA, 23 bp, synthetic construct
  misc_feature 1..23: note = Description of Artificial Sequence: Syntheticoligonucleotide
  source 1..23: mol_type = other DNA
caggactcatcgatgagtcctgc

SEQ ID NO: 6489 - DNA, 23 bp, synthetic construct
  misc_feature 1..23: note = Description of Artificial Sequence: Syntheticoligonucleotide
  source 1..23: mol_type = other DNA
ctggactcatcgatgagtccagc

SEQ ID NO: 6490 - DNA, 23 bp, synthetic construct
  misc_feature 1..23: note = Description of Artificial Sequence: Syntheticoligonucleotide
  source 1..23: mol_type = other DNA
gaggactcatcgatgagtcctcg

SEQ ID NO: 6491 - DNA, 23 bp, synthetic construct
  misc_feature 1..23: note = Description of Artificial Sequence: Syntheticoligonucleotide
  source 1..23: mol_type = other DNA
gtggactcatcgatgagtccacg

SEQ ID NO: 6492 - DNA, 23 bp, synthetic construct
  misc_feature 1..23: note = Description of Artificial Sequence: Syntheticoligonucleotide
  source 1..23: mol_type = other DNA
accgactcatcgatgagtcggtg

SEQ ID NO: 6493 - DNA, 23 bp, synthetic construct
  misc_feature 1..23: note = Description of Artificial Sequence: Syntheticoligonucleotide
  source 1..23: mol_type = other DNA
tccgactcatcgatgagtcggag

SEQ ID NO: 6494 - DNA, 23 bp, synthetic construct
  misc_feature 1..23: note = Description of Artificial Sequence: Syntheticoligonucleotide
  source 1..23: mol_type = other DNA
cgggactcatcgatgagtcccgc

SEQ ID NO: 6495 - DNA, 23 bp, synthetic construct
  misc_feature 1..23: note = Description of Artificial Sequence: Syntheticoligonucleotide
  source 1..23: mol_type = other DNA
agggactcatcgatgagtccctc

SEQ ID NO: 6496 - DNA, 23 bp, synthetic construct
  misc_feature 1..23: note = Description of Artificial Sequence: Syntheticoligonucleotide
  source 1..23: mol_type = other DNA
tgggactcatcgatgagtcccac

SEQ ID NO: 6497 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcttataagagtcnnnn

SEQ ID NO: 6498 - DNA, 23 bp, synthetic construct
  misc_feature 1..23: note = Description of Artificial Sequence: Syntheticoligonucleotide
  source 1..23: mol_type = other DNA
gcggactcttataagagtccgcc

SEQ ID NO: 6499 - DNA, 23 bp, synthetic construct
  misc_feature 1..23: note = Description of Artificial Sequence: Syntheticoligonucleotide
  source 1..23: mol_type = other DNA
gcggactcttataagagtccgct

SEQ ID NO: 6500 - DNA, 23 bp, synthetic construct
  misc_feature 1..23: note = Description of Artificial Sequence: Syntheticoligonucleotide
  source 1..23: mol_type = other DNA
acggactcttataagagtccgtc

SEQ ID NO: 6501 - DNA, 23 bp, synthetic construct
  misc_feature 1..23: note = Description of Artificial Sequence: Syntheticoligonucleotide
  source 1..23: mol_type = other DNA
gaggactcttataagagtcctcc

SEQ ID NO: 6502 - DNA, 23 bp, synthetic construct
  misc_feature 1..23: note = Description of Artificial Sequence: Syntheticoligonucleotide
  source 1..23: mol_type = other DNA
gcagactcttataagagtctgcc

SEQ ID NO: 6503 - DNA, 23 bp, synthetic construct
  misc_feature 1..23: note = Description of Artificial Sequence: Syntheticoligonucleotide
  source 1..23: mol_type = other DNA
gcggactcttataagagtccgca

SEQ ID NO: 6504 - DNA, 23 bp, synthetic construct
  misc_feature 1..23: note = Description of Artificial Sequence: Syntheticoligonucleotide
  source 1..23: mol_type = other DNA
tcggactcttataagagtccgac

SEQ ID NO: 6505 - DNA, 23 bp, synthetic construct
  misc_feature 1..23: note = Description of Artificial Sequence: Syntheticoligonucleotide
  source 1..23: mol_type = other DNA
gtggactcttataagagtccacc

SEQ ID NO: 6506 - DNA, 23 bp, synthetic construct
  misc_feature 1..23: note = Description of Artificial Sequence: Syntheticoligonucleotide
  source 1..23: mol_type = other DNA
gctgactcttataagagtcagcc

SEQ ID NO: 6507 - DNA, 23 bp, synthetic construct
  misc_feature 1..23: note = Description of Artificial Sequence: Syntheticoligonucleotide
  source 1..23: mol_type = other DNA
cccgactcttataagagtcgggc

SEQ ID NO: 6508 - DNA, 23 bp, synthetic construct
  misc_feature 1..23: note = Description of Artificial Sequence: Syntheticoligonucleotide
  source 1..23: mol_type = other DNA
cccgactcttataagagtcgggt

SEQ ID NO: 6509 - DNA, 23 bp, synthetic construct
  misc_feature 1..23: note = Description of Artificial Sequence: Syntheticoligonucleotide
  source 1..23: mol_type = other DNA
accgactcttataagagtcggtc

SEQ ID NO: 6510 - DNA, 23 bp, synthetic construct
  misc_feature 1..23: note = Description of Artificial Sequence: Syntheticoligonucleotide
  source 1..23: mol_type = other DNA
cacgactcttataagagtcgtgc

SEQ ID NO: 6511 - DNA, 23 bp, synthetic construct
  misc_feature 1..23: note = Description of Artificial Sequence: Syntheticoligonucleotide
  source 1..23: mol_type = other DNA
ccagactcttataagagtctggc

SEQ ID NO: 6512 - DNA, 23 bp, synthetic construct
  misc_feature 1..23: note = Description of Artificial Sequence: Syntheticoligonucleotide
  source 1..23: mol_type = other DNA
cccgactcttataagagtcggga

SEQ ID NO: 6513 - DNA, 23 bp, synthetic construct
  misc_feature 1..23: note = Description of Artificial Sequence: Syntheticoligonucleotide
  source 1..23: mol_type = other DNA
tccgactcttataagagtcggac

SEQ ID NO: 6514 - DNA, 23 bp, synthetic construct
  misc_feature 1..23: note = Description of Artificial Sequence: Syntheticoligonucleotide
  source 1..23: mol_type = other DNA
cctgactcttataagagtcaggc

SEQ ID NO: 6515 - DNA, 23 bp, synthetic construct
  misc_feature 1..23: note = Description of Artificial Sequence: Syntheticoligonucleotide
  source 1..23: mol_type = other DNA
ggcgactcttataagagtcgccc

SEQ ID NO: 6516 - DNA, 23 bp, synthetic construct
  misc_feature 1..23: note = Description of Artificial Sequence: Syntheticoligonucleotide
  source 1..23: mol_type = other DNA
ggcgactcttataagagtcgcct

SEQ ID NO: 6517 - DNA, 23 bp, synthetic construct
  misc_feature 1..23: note = Description of Artificial Sequence: Syntheticoligonucleotide
  source 1..23: mol_type = other DNA
agcgactcttataagagtcgctc

SEQ ID NO: 6518 - DNA, 23 bp, synthetic construct
  misc_feature 1..23: note = Description of Artificial Sequence: Syntheticoligonucleotide
  source 1..23: mol_type = other DNA
gacgactcttataagagtcgtcc

SEQ ID NO: 6519 - DNA, 23 bp, synthetic construct
  misc_feature 1..23: note = Description of Artificial Sequence: Syntheticoligonucleotide
  source 1..23: mol_type = other DNA
ggagactcttataagagtctccc

SEQ ID NO: 6520 - DNA, 23 bp, synthetic construct
  misc_feature 1..23: note = Description of Artificial Sequence: Syntheticoligonucleotide
  source 1..23: mol_type = other DNA
ggcgactcttataagagtcgcca

SEQ ID NO: 6521 - DNA, 23 bp, synthetic construct
  misc_feature 1..23: note = Description of Artificial Sequence: Syntheticoligonucleotide
  source 1..23: mol_type = other DNA
tgcgactcttataagagtcgcac

SEQ ID NO: 6522 - DNA, 23 bp, synthetic construct
  misc_feature 1..23: note = Description of Artificial Sequence: Syntheticoligonucleotide
  source 1..23: mol_type = other DNA
ggtgactcttataagagtcaccc

SEQ ID NO: 6523 - DNA, 23 bp, synthetic construct
  misc_feature 1..23: note = Description of Artificial Sequence: Syntheticoligonucleotide
  source 1..23: mol_type = other DNA
cgggactcttataagagtcccgt

SEQ ID NO: 6524 - DNA, 23 bp, synthetic construct
  misc_feature 1..23: note = Description of Artificial Sequence: Syntheticoligonucleotide
  source 1..23: mol_type = other DNA
agggactcttataagagtccctg

SEQ ID NO: 6525 - DNA, 23 bp, synthetic construct
  misc_feature 1..23: note = Description of Artificial Sequence: Syntheticoligonucleotide
  source 1..23: mol_type = other DNA
caggactcttataagagtcctgg

SEQ ID NO: 6526 - DNA, 23 bp, synthetic construct
  misc_feature 1..23: note = Description of Artificial Sequence: Syntheticoligonucleotide
  source 1..23: mol_type = other DNA
cgagactcttataagagtctcgg

SEQ ID NO: 6527 - DNA, 23 bp, synthetic construct
  misc_feature 1..23: note = Description of Artificial Sequence: Syntheticoligonucleotide
  source 1..23: mol_type = other DNA
cgggactcttataagagtcccga

SEQ ID NO: 6528 - DNA, 23 bp, synthetic construct
  misc_feature 1..23: note = Description of Artificial Sequence: Syntheticoligonucleotide
  source 1..23: mol_type = other DNA
tgggactcttataagagtcccag

SEQ ID NO: 6529 - DNA, 23 bp, synthetic construct
  misc_feature 1..23: note = Description of Artificial Sequence: Syntheticoligonucleotide
  source 1..23: mol_type = other DNA
ctggactcttataagagtccagg

SEQ ID NO: 6530 - DNA, 23 bp, synthetic construct
  misc_feature 1..23: note = Description of Artificial Sequence: Syntheticoligonucleotide
  source 1..23: mol_type = other DNA
cgtgactcttataagagtcacgg

SEQ ID NO: 6531 - DNA, 23 bp, synthetic construct
  misc_feature 1..23: note = Description of Artificial Sequence: Syntheticoligonucleotide
  source 1..23: mol_type = other DNA
ggcgactcttataagagtcgccg

SEQ ID NO: 6532 - DNA, 23 bp, synthetic construct
  misc_feature 1..23: note = Description of Artificial Sequence: Syntheticoligonucleotide
  source 1..23: mol_type = other DNA
agcgactcttataagagtcgctg

SEQ ID NO: 6533 - DNA, 23 bp, synthetic construct
  misc_feature 1..23: note = Description of Artificial Sequence: Syntheticoligonucleotide
  source 1..23: mol_type = other DNA
gacgactcttataagagtcgtcg

SEQ ID NO: 6534 - DNA, 23 bp, synthetic construct
  misc_feature 1..23: note = Description of Artificial Sequence: Syntheticoligonucleotide
  source 1..23: mol_type = other DNA
ggagactcttataagagtctccg

SEQ ID NO: 6535 - DNA, 23 bp, synthetic construct
  misc_feature 1..23: note = Description of Artificial Sequence: Syntheticoligonucleotide
  source 1..23: mol_type = other DNA
tgcgactcttataagagtcgcag

SEQ ID NO: 6536 - DNA, 23 bp, synthetic construct
  misc_feature 1..23: note = Description of Artificial Sequence: Syntheticoligonucleotide
  source 1..23: mol_type = other DNA
ggtgactcttataagagtcaccg

SEQ ID NO: 6537 - DNA, 23 bp, synthetic construct
  misc_feature 1..23: note = Description of Artificial Sequence: Syntheticoligonucleotide
  source 1..23: mol_type = other DNA
acggactcttataagagtccgtg

SEQ ID NO: 6538 - DNA, 23 bp, synthetic construct
  misc_feature 1..23: note = Description of Artificial Sequence: Syntheticoligonucleotide
  source 1..23: mol_type = other DNA
ccagactcttataagagtctggg

SEQ ID NO: 6539 - DNA, 23 bp, synthetic construct
  misc_feature 1..23: note = Description of Artificial Sequence: Syntheticoligonucleotide
  source 1..23: mol_type = other DNA
tcggactcttataagagtccgag

SEQ ID NO: 6540 - DNA, 23 bp, synthetic construct
  misc_feature 1..23: note = Description of Artificial Sequence: Syntheticoligonucleotide
  source 1..23: mol_type = other DNA
cctgactcttataagagtcaggg

SEQ ID NO: 6541 - DNA, 23 bp, synthetic construct
  misc_feature 1..23: note = Description of Artificial Sequence: Syntheticoligonucleotide
  source 1..23: mol_type = other DNA
cacgactcttataagagtcgtgg

SEQ ID NO: 6542 - DNA, 23 bp, synthetic construct
  misc_feature 1..23: note = Description of Artificial Sequence: Syntheticoligonucleotide
  source 1..23: mol_type = other DNA
gccgactcttataagagtcggct

SEQ ID NO: 6543 - DNA, 23 bp, synthetic construct
  misc_feature 1..23: note = Description of Artificial Sequence: Syntheticoligonucleotide
  source 1..23: mol_type = other DNA
gccgactcttataagagtcggca

SEQ ID NO: 6544 - DNA, 23 bp, synthetic construct
  misc_feature 1..23: note = Description of Artificial Sequence: Syntheticoligonucleotide
  source 1..23: mol_type = other DNA
cgagactcttataagagtctcgc

SEQ ID NO: 6545 - DNA, 23 bp, synthetic construct
  misc_feature 1..23: note = Description of Artificial Sequence: Syntheticoligonucleotide
  source 1..23: mol_type = other DNA
cgtgactcttataagagtcacgc

SEQ ID NO: 6546 - DNA, 23 bp, synthetic construct
  misc_feature 1..23: note = Description of Artificial Sequence: Syntheticoligonucleotide
  source 1..23: mol_type = other DNA
caggactcttataagagtcctgc

SEQ ID NO: 6547 - DNA, 23 bp, synthetic construct
  misc_feature 1..23: note = Description of Artificial Sequence: Syntheticoligonucleotide
  source 1..23: mol_type = other DNA
ctggactcttataagagtccagc

SEQ ID NO: 6548 - DNA, 23 bp, synthetic construct
  misc_feature 1..23: note = Description of Artificial Sequence: Syntheticoligonucleotide
  source 1..23: mol_type = other DNA
gaggactcttataagagtcctcg

SEQ ID NO: 6549 - DNA, 23 bp, synthetic construct
  misc_feature 1..23: note = Description of Artificial Sequence: Syntheticoligonucleotide
  source 1..23: mol_type = other DNA
gtggactcttataagagtccacg

SEQ ID NO: 6550 - DNA, 23 bp, synthetic construct
  misc_feature 1..23: note = Description of Artificial Sequence: Syntheticoligonucleotide
  source 1..23: mol_type = other DNA
accgactcttataagagtcggtg

SEQ ID NO: 6551 - DNA, 23 bp, synthetic construct
  misc_feature 1..23: note = Description of Artificial Sequence: Syntheticoligonucleotide
  source 1..23: mol_type = other DNA
tccgactcttataagagtcggag

SEQ ID NO: 6552 - DNA, 23 bp, synthetic construct
  misc_feature 1..23: note = Description of Artificial Sequence: Syntheticoligonucleotide
  source 1..23: mol_type = other DNA
cgggactcttataagagtcccgc

SEQ ID NO: 6553 - DNA, 23 bp, synthetic construct
  misc_feature 1..23: note = Description of Artificial Sequence: Syntheticoligonucleotide
  source 1..23: mol_type = other DNA
agggactcttataagagtccctc

SEQ ID NO: 6554 - DNA, 23 bp, synthetic construct
  misc_feature 1..23: note = Description of Artificial Sequence: Syntheticoligonucleotide
  source 1..23: mol_type = other DNA
tgggactcttataagagtcccac

SEQ ID NO: 6555 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactctttaaagagtcnnnn

SEQ ID NO: 6556 - DNA, 23 bp, synthetic construct
  misc_feature 1..23: note = Description of Artificial Sequence: Syntheticoligonucleotide
  source 1..23: mol_type = other DNA
gcggactctttaaagagtccgcc

SEQ ID NO: 6557 - DNA, 23 bp, synthetic construct
  misc_feature 1..23: note = Description of Artificial Sequence: Syntheticoligonucleotide
  source 1..23: mol_type = other DNA
gcggactctttaaagagtccgct

SEQ ID NO: 6558 - DNA, 23 bp, synthetic construct
  misc_feature 1..23: note = Description of Artificial Sequence: Syntheticoligonucleotide
  source 1..23: mol_type = other DNA
acggactctttaaagagtccgtc

SEQ ID NO: 6559 - DNA, 23 bp, synthetic construct
  misc_feature 1..23: note = Description of Artificial Sequence: Syntheticoligonucleotide
  source 1..23: mol_type = other DNA
gaggactctttaaagagtcctcc

SEQ ID NO: 6560 - DNA, 23 bp, synthetic construct
  misc_feature 1..23: note = Description of Artificial Sequence: Syntheticoligonucleotide
  source 1..23: mol_type = other DNA
gcagactctttaaagagtctgcc

SEQ ID NO: 6561 - DNA, 23 bp, synthetic construct
  misc_feature 1..23: note = Description of Artificial Sequence: Syntheticoligonucleotide
  source 1..23: mol_type = other DNA
gcggactctttaaagagtccgca

SEQ ID NO: 6562 - DNA, 23 bp, synthetic construct
  misc_feature 1..23: note = Description of Artificial Sequence: Syntheticoligonucleotide
  source 1..23: mol_type = other DNA
tcggactctttaaagagtccgac

SEQ ID NO: 6563 - DNA, 23 bp, synthetic construct
  misc_feature 1..23: note = Description of Artificial Sequence: Syntheticoligonucleotide
  source 1..23: mol_type = other DNA
gtggactctttaaagagtccacc

SEQ ID NO: 6564 - DNA, 23 bp, synthetic construct
  misc_feature 1..23: note = Description of Artificial Sequence: Syntheticoligonucleotide
  source 1..23: mol_type = other DNA
gctgactctttaaagagtcagcc

SEQ ID NO: 6565 - DNA, 23 bp, synthetic construct
  misc_feature 1..23: note = Description of Artificial Sequence: Syntheticoligonucleotide
  source 1..23: mol_type = other DNA
cccgactctttaaagagtcgggc

SEQ ID NO: 6566 - DNA, 23 bp, synthetic construct
  misc_feature 1..23: note = Description of Artificial Sequence: Syntheticoligonucleotide
  source 1..23: mol_type = other DNA
cccgactctttaaagagtcgggt

SEQ ID NO: 6567 - DNA, 23 bp, synthetic construct
  misc_feature 1..23: note = Description of Artificial Sequence: Syntheticoligonucleotide
  source 1..23: mol_type = other DNA
accgactctttaaagagtcggtc

SEQ ID NO: 6568 - DNA, 23 bp, synthetic construct
  misc_feature 1..23: note = Description of Artificial Sequence: Syntheticoligonucleotide
  source 1..23: mol_type = other DNA
cacgactctttaaagagtcgtgc

SEQ ID NO: 6569 - DNA, 23 bp, synthetic construct
  misc_feature 1..23: note = Description of Artificial Sequence: Syntheticoligonucleotide
  source 1..23: mol_type = other DNA
ccagactctttaaagagtctggc

SEQ ID NO: 6570 - DNA, 23 bp, synthetic construct
  misc_feature 1..23: note = Description of Artificial Sequence: Syntheticoligonucleotide
  source 1..23: mol_type = other DNA
cccgactctttaaagagtcggga

SEQ ID NO: 6571 - DNA, 23 bp, synthetic construct
  misc_feature 1..23: note = Description of Artificial Sequence: Syntheticoligonucleotide
  source 1..23: mol_type = other DNA
tccgactctttaaagagtcggac

SEQ ID NO: 6572 - DNA, 23 bp, synthetic construct
  misc_feature 1..23: note = Description of Artificial Sequence: Syntheticoligonucleotide
  source 1..23: mol_type = other DNA
cctgactctttaaagagtcaggc

SEQ ID NO: 6573 - DNA, 23 bp, synthetic construct
  misc_feature 1..23: note = Description of Artificial Sequence: Syntheticoligonucleotide
  source 1..23: mol_type = other DNA
ggcgactctttaaagagtcgccc

SEQ ID NO: 6574 - DNA, 23 bp, synthetic construct
  misc_feature 1..23: note = Description of Artificial Sequence: Syntheticoligonucleotide
  source 1..23: mol_type = other DNA
ggcgactctttaaagagtcgcct

SEQ ID NO: 6575 - DNA, 23 bp, synthetic construct
  misc_feature 1..23: note = Description of Artificial Sequence: Syntheticoligonucleotide
  source 1..23: mol_type = other DNA
agcgactctttaaagagtcgctc

SEQ ID NO: 6576 - DNA, 23 bp, synthetic construct
  misc_feature 1..23: note = Description of Artificial Sequence: Syntheticoligonucleotide
  source 1..23: mol_type = other DNA
gacgactctttaaagagtcgtcc

SEQ ID NO: 6577 - DNA, 23 bp, synthetic construct
  misc_feature 1..23: note = Description of Artificial Sequence: Syntheticoligonucleotide
  source 1..23: mol_type = other DNA
ggagactctttaaagagtctccc

SEQ ID NO: 6578 - DNA, 23 bp, synthetic construct
  misc_feature 1..23: note = Description of Artificial Sequence: Syntheticoligonucleotide
  source 1..23: mol_type = other DNA
ggcgactctttaaagagtcgcca

SEQ ID NO: 6579 - DNA, 23 bp, synthetic construct
  misc_feature 1..23: note = Description of Artificial Sequence: Syntheticoligonucleotide
  source 1..23: mol_type = other DNA
tgcgactctttaaagagtcgcac

SEQ ID NO: 6580 - DNA, 23 bp, synthetic construct
  misc_feature 1..23: note = Description of Artificial Sequence: Syntheticoligonucleotide
  source 1..23: mol_type = other DNA
ggtgactctttaaagagtcaccc

SEQ ID NO: 6581 - DNA, 23 bp, synthetic construct
  misc_feature 1..23: note = Description of Artificial Sequence: Syntheticoligonucleotide
  source 1..23: mol_type = other DNA
cgggactctttaaagagtcccgt

SEQ ID NO: 6582 - DNA, 23 bp, synthetic construct
  misc_feature 1..23: note = Description of Artificial Sequence: Syntheticoligonucleotide
  source 1..23: mol_type = other DNA
agggactctttaaagagtccctg

SEQ ID NO: 6583 - DNA, 23 bp, synthetic construct
  misc_feature 1..23: note = Description of Artificial Sequence: Syntheticoligonucleotide
  source 1..23: mol_type = other DNA
caggactctttaaagagtcctgg

SEQ ID NO: 6584 - DNA, 23 bp, synthetic construct
  misc_feature 1..23: note = Description of Artificial Sequence: Syntheticoligonucleotide
  source 1..23: mol_type = other DNA
cgagactctttaaagagtctcgg

SEQ ID NO: 6585 - DNA, 23 bp, synthetic construct
  misc_feature 1..23: note = Description of Artificial Sequence: Syntheticoligonucleotide
  source 1..23: mol_type = other DNA
cgggactctttaaagagtcccga

SEQ ID NO: 6586 - DNA, 23 bp, synthetic construct
  misc_feature 1..23: note = Description of Artificial Sequence: Syntheticoligonucleotide
  source 1..23: mol_type = other DNA
tgggactctttaaagagtcccag

SEQ ID NO: 6587 - DNA, 23 bp, synthetic construct
  misc_feature 1..23: note = Description of Artificial Sequence: Syntheticoligonucleotide
  source 1..23: mol_type = other DNA
ctggactctttaaagagtccagg

SEQ ID NO: 6588 - DNA, 23 bp, synthetic construct
  misc_feature 1..23: note = Description of Artificial Sequence: Syntheticoligonucleotide
  source 1..23: mol_type = other DNA
cgtgactctttaaagagtcacgg

SEQ ID NO: 6589 - DNA, 23 bp, synthetic construct
  misc_feature 1..23: note = Description of Artificial Sequence: Syntheticoligonucleotide
  source 1..23: mol_type = other DNA
ggcgactctttaaagagtcgccg

SEQ ID NO: 6590 - DNA, 23 bp, synthetic construct
  misc_feature 1..23: note = Description of Artificial Sequence: Syntheticoligonucleotide
  source 1..23: mol_type = other DNA
agcgactctttaaagagtcgctg

SEQ ID NO: 6591 - DNA, 23 bp, synthetic construct
  misc_feature 1..23: note = Description of Artificial Sequence: Syntheticoligonucleotide
  source 1..23: mol_type = other DNA
gacgactctttaaagagtcgtcg

SEQ ID NO: 6592 - DNA, 23 bp, synthetic construct
  misc_feature 1..23: note = Description of Artificial Sequence: Syntheticoligonucleotide
  source 1..23: mol_type = other DNA
ggagactctttaaagagtctccg

SEQ ID NO: 6593 - DNA, 23 bp, synthetic construct
  misc_feature 1..23: note = Description of Artificial Sequence: Syntheticoligonucleotide
  source 1..23: mol_type = other DNA
tgcgactctttaaagagtcgcag

SEQ ID NO: 6594 - DNA, 23 bp, synthetic construct
  misc_feature 1..23: note = Description of Artificial Sequence: Syntheticoligonucleotide
  source 1..23: mol_type = other DNA
ggtgactctttaaagagtcaccg

SEQ ID NO: 6595 - DNA, 23 bp, synthetic construct
  misc_feature 1..23: note = Description of Artificial Sequence: Syntheticoligonucleotide
  source 1..23: mol_type = other DNA
acggactctttaaagagtccgtg

SEQ ID NO: 6596 - DNA, 23 bp, synthetic construct
  misc_feature 1..23: note = Description of Artificial Sequence: Syntheticoligonucleotide
  source 1..23: mol_type = other DNA
ccagactctttaaagagtctggg

SEQ ID NO: 6597 - DNA, 23 bp, synthetic construct
  misc_feature 1..23: note = Description of Artificial Sequence: Syntheticoligonucleotide
  source 1..23: mol_type = other DNA
tcggactctttaaagagtccgag

SEQ ID NO: 6598 - DNA, 23 bp, synthetic construct
  misc_feature 1..23: note = Description of Artificial Sequence: Syntheticoligonucleotide
  source 1..23: mol_type = other DNA
cctgactctttaaagagtcaggg

SEQ ID NO: 6599 - DNA, 23 bp, synthetic construct
  misc_feature 1..23: note = Description of Artificial Sequence: Syntheticoligonucleotide
  source 1..23: mol_type = other DNA
cacgactctttaaagagtcgtgg

SEQ ID NO: 6600 - DNA, 23 bp, synthetic construct
  misc_feature 1..23: note = Description of Artificial Sequence: Syntheticoligonucleotide
  source 1..23: mol_type = other DNA
gccgactctttaaagagtcggct

SEQ ID NO: 6601 - DNA, 23 bp, synthetic construct
  misc_feature 1..23: note = Description of Artificial Sequence: Syntheticoligonucleotide
  source 1..23: mol_type = other DNA
gccgactctttaaagagtcggca

SEQ ID NO: 6602 - DNA, 23 bp, synthetic construct
  misc_feature 1..23: note = Description of Artificial Sequence: Syntheticoligonucleotide
  source 1..23: mol_type = other DNA
cgagactctttaaagagtctcgc

SEQ ID NO: 6603 - DNA, 23 bp, synthetic construct
  misc_feature 1..23: note = Description of Artificial Sequence: Syntheticoligonucleotide
  source 1..23: mol_type = other DNA
cgtgactctttaaagagtcacgc

SEQ ID NO: 6604 - DNA, 23 bp, synthetic construct
  misc_feature 1..23: note = Description of Artificial Sequence: Syntheticoligonucleotide
  source 1..23: mol_type = other DNA
caggactctttaaagagtcctgc

SEQ ID NO: 6605 - DNA, 23 bp, synthetic construct
  misc_feature 1..23: note = Description of Artificial Sequence: Syntheticoligonucleotide
  source 1..23: mol_type = other DNA
ctggactctttaaagagtccagc

SEQ ID NO: 6606 - DNA, 23 bp, synthetic construct
  misc_feature 1..23: note = Description of Artificial Sequence: Syntheticoligonucleotide
  source 1..23: mol_type = other DNA
gaggactctttaaagagtcctcg

SEQ ID NO: 6607 - DNA, 23 bp, synthetic construct
  misc_feature 1..23: note = Description of Artificial Sequence: Syntheticoligonucleotide
  source 1..23: mol_type = other DNA
gtggactctttaaagagtccacg

SEQ ID NO: 6608 - DNA, 23 bp, synthetic construct
  misc_feature 1..23: note = Description of Artificial Sequence: Syntheticoligonucleotide
  source 1..23: mol_type = other DNA
accgactctttaaagagtcggtg

SEQ ID NO: 6609 - DNA, 23 bp, synthetic construct
  misc_feature 1..23: note = Description of Artificial Sequence: Syntheticoligonucleotide
  source 1..23: mol_type = other DNA
tccgactctttaaagagtcggag

SEQ ID NO: 6610 - DNA, 23 bp, synthetic construct
  misc_feature 1..23: note = Description of Artificial Sequence: Syntheticoligonucleotide
  source 1..23: mol_type = other DNA
cgggactctttaaagagtcccgc

SEQ ID NO: 6611 - DNA, 23 bp, synthetic construct
  misc_feature 1..23: note = Description of Artificial Sequence: Syntheticoligonucleotide
  source 1..23: mol_type = other DNA
agggactctttaaagagtccctc

SEQ ID NO: 6612 - DNA, 23 bp, synthetic construct
  misc_feature 1..23: note = Description of Artificial Sequence: Syntheticoligonucleotide
  source 1..23: mol_type = other DNA
tgggactctttaaagagtcccac

SEQ ID NO: 6613 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcttgcaagagtcnnnn

SEQ ID NO: 6614 - DNA, 23 bp, synthetic construct
  misc_feature 1..23: note = Description of Artificial Sequence: Syntheticoligonucleotide
  source 1..23: mol_type = other DNA
gcggactcttgcaagagtccgcc

SEQ ID NO: 6615 - DNA, 23 bp, synthetic construct
  misc_feature 1..23: note = Description of Artificial Sequence: Syntheticoligonucleotide
  source 1..23: mol_type = other DNA
gcggactcttgcaagagtccgct

SEQ ID NO: 6616 - DNA, 23 bp, synthetic construct
  misc_feature 1..23: note = Description of Artificial Sequence: Syntheticoligonucleotide
  source 1..23: mol_type = other DNA
acggactcttgcaagagtccgtc

SEQ ID NO: 6617 - DNA, 23 bp, synthetic construct
  misc_feature 1..23: note = Description of Artificial Sequence: Syntheticoligonucleotide
  source 1..23: mol_type = other DNA
gaggactcttgcaagagtcctcc

SEQ ID NO: 6618 - DNA, 23 bp, synthetic construct
  misc_feature 1..23: note = Description of Artificial Sequence: Syntheticoligonucleotide
  source 1..23: mol_type = other DNA
gcagactcttgcaagagtctgcc

SEQ ID NO: 6619 - DNA, 23 bp, synthetic construct
  misc_feature 1..23: note = Description of Artificial Sequence: Syntheticoligonucleotide
  source 1..23: mol_type = other DNA
gcggactcttgcaagagtccgca

SEQ ID NO: 6620 - DNA, 23 bp, synthetic construct
  misc_feature 1..23: note = Description of Artificial Sequence: Syntheticoligonucleotide
  source 1..23: mol_type = other DNA
tcggactcttgcaagagtccgac

SEQ ID NO: 6621 - DNA, 23 bp, synthetic construct
  misc_feature 1..23: note = Description of Artificial Sequence: Syntheticoligonucleotide
  source 1..23: mol_type = other DNA
gtggactcttgcaagagtccacc

SEQ ID NO: 6622 - DNA, 23 bp, synthetic construct
  misc_feature 1..23: note = Description of Artificial Sequence: Syntheticoligonucleotide
  source 1..23: mol_type = other DNA
gctgactcttgcaagagtcagcc

SEQ ID NO: 6623 - DNA, 23 bp, synthetic construct
  misc_feature 1..23: note = Description of Artificial Sequence: Syntheticoligonucleotide
  source 1..23: mol_type = other DNA
cccgactcttgcaagagtcgggc

SEQ ID NO: 6624 - DNA, 23 bp, synthetic construct
  misc_feature 1..23: note = Description of Artificial Sequence: Syntheticoligonucleotide
  source 1..23: mol_type = other DNA
cccgactcttgcaagagtcgggt

SEQ ID NO: 6625 - DNA, 23 bp, synthetic construct
  misc_feature 1..23: note = Description of Artificial Sequence: Syntheticoligonucleotide
  source 1..23: mol_type = other DNA
accgactcttgcaagagtcggtc

SEQ ID NO: 6626 - DNA, 23 bp, synthetic construct
  misc_feature 1..23: note = Description of Artificial Sequence: Syntheticoligonucleotide
  source 1..23: mol_type = other DNA
cacgactcttgcaagagtcgtgc

SEQ ID NO: 6627 - DNA, 23 bp, synthetic construct
  misc_feature 1..23: note = Description of Artificial Sequence: Syntheticoligonucleotide
  source 1..23: mol_type = other DNA
ccagactcttgcaagagtctggc

SEQ ID NO: 6628 - DNA, 23 bp, synthetic construct
  misc_feature 1..23: note = Description of Artificial Sequence: Syntheticoligonucleotide
  source 1..23: mol_type = other DNA
cccgactcttgcaagagtcggga

SEQ ID NO: 6629 - DNA, 23 bp, synthetic construct
  misc_feature 1..23: note = Description of Artificial Sequence: Syntheticoligonucleotide
  source 1..23: mol_type = other DNA
tccgactcttgcaagagtcggac

SEQ ID NO: 6630 - DNA, 23 bp, synthetic construct
  misc_feature 1..23: note = Description of Artificial Sequence: Syntheticoligonucleotide
  source 1..23: mol_type = other DNA
cctgactcttgcaagagtcaggc

SEQ ID NO: 6631 - DNA, 23 bp, synthetic construct
  misc_feature 1..23: note = Description of Artificial Sequence: Syntheticoligonucleotide
  source 1..23: mol_type = other DNA
ggcgactcttgcaagagtcgccc

SEQ ID NO: 6632 - DNA, 23 bp, synthetic construct
  misc_feature 1..23: note = Description of Artificial Sequence: Syntheticoligonucleotide
  source 1..23: mol_type = other DNA
ggcgactcttgcaagagtcgcct

SEQ ID NO: 6633 - DNA, 23 bp, synthetic construct
  misc_feature 1..23: note = Description of Artificial Sequence: Syntheticoligonucleotide
  source 1..23: mol_type = other DNA
agcgactcttgcaagagtcgctc

SEQ ID NO: 6634 - DNA, 23 bp, synthetic construct
  misc_feature 1..23: note = Description of Artificial Sequence: Syntheticoligonucleotide
  source 1..23: mol_type = other DNA
gacgactcttgcaagagtcgtcc

SEQ ID NO: 6635 - DNA, 23 bp, synthetic construct
  misc_feature 1..23: note = Description of Artificial Sequence: Syntheticoligonucleotide
  source 1..23: mol_type = other DNA
ggagactcttgcaagagtctccc

SEQ ID NO: 6636 - DNA, 23 bp, synthetic construct
  misc_feature 1..23: note = Description of Artificial Sequence: Syntheticoligonucleotide
  source 1..23: mol_type = other DNA
ggcgactcttgcaagagtcgcca

SEQ ID NO: 6637 - DNA, 23 bp, synthetic construct
  misc_feature 1..23: note = Description of Artificial Sequence: Syntheticoligonucleotide
  source 1..23: mol_type = other DNA
tgcgactcttgcaagagtcgcac

SEQ ID NO: 6638 - DNA, 23 bp, synthetic construct
  misc_feature 1..23: note = Description of Artificial Sequence: Syntheticoligonucleotide
  source 1..23: mol_type = other DNA
ggtgactcttgcaagagtcaccc

SEQ ID NO: 6639 - DNA, 23 bp, synthetic construct
  misc_feature 1..23: note = Description of Artificial Sequence: Syntheticoligonucleotide
  source 1..23: mol_type = other DNA
cgggactcttgcaagagtcccgt

SEQ ID NO: 6640 - DNA, 23 bp, synthetic construct
  misc_feature 1..23: note = Description of Artificial Sequence: Syntheticoligonucleotide
  source 1..23: mol_type = other DNA
agggactcttgcaagagtccctg

SEQ ID NO: 6641 - DNA, 23 bp, synthetic construct
  misc_feature 1..23: note = Description of Artificial Sequence: Syntheticoligonucleotide
  source 1..23: mol_type = other DNA
caggactcttgcaagagtcctgg

SEQ ID NO: 6642 - DNA, 23 bp, synthetic construct
  misc_feature 1..23: note = Description of Artificial Sequence: Syntheticoligonucleotide
  source 1..23: mol_type = other DNA
cgagactcttgcaagagtctcgg

SEQ ID NO: 6643 - DNA, 23 bp, synthetic construct
  misc_feature 1..23: note = Description of Artificial Sequence: Syntheticoligonucleotide
  source 1..23: mol_type = other DNA
cgggactcttgcaagagtcccga

SEQ ID NO: 6644 - DNA, 23 bp, synthetic construct
  misc_feature 1..23: note = Description of Artificial Sequence: Syntheticoligonucleotide
  source 1..23: mol_type = other DNA
tgggactcttgcaagagtcccag

SEQ ID NO: 6645 - DNA, 23 bp, synthetic construct
  misc_feature 1..23: note = Description of Artificial Sequence: Syntheticoligonucleotide
  source 1..23: mol_type = other DNA
ctggactcttgcaagagtccagg

SEQ ID NO: 6646 - DNA, 23 bp, synthetic construct
  misc_feature 1..23: note = Description of Artificial Sequence: Syntheticoligonucleotide
  source 1..23: mol_type = other DNA
cgtgactcttgcaagagtcacgg

SEQ ID NO: 6647 - DNA, 23 bp, synthetic construct
  misc_feature 1..23: note = Description of Artificial Sequence: Syntheticoligonucleotide
  source 1..23: mol_type = other DNA
ggcgactcttgcaagagtcgccg

SEQ ID NO: 6648 - DNA, 23 bp, synthetic construct
  misc_feature 1..23: note = Description of Artificial Sequence: Syntheticoligonucleotide
  source 1..23: mol_type = other DNA
agcgactcttgcaagagtcgctg

SEQ ID NO: 6649 - DNA, 23 bp, synthetic construct
  misc_feature 1..23: note = Description of Artificial Sequence: Syntheticoligonucleotide
  source 1..23: mol_type = other DNA
gacgactcttgcaagagtcgtcg

SEQ ID NO: 6650 - DNA, 23 bp, synthetic construct
  misc_feature 1..23: note = Description of Artificial Sequence: Syntheticoligonucleotide
  source 1..23: mol_type = other DNA
ggagactcttgcaagagtctccg

SEQ ID NO: 6651 - DNA, 23 bp, synthetic construct
  misc_feature 1..23: note = Description of Artificial Sequence: Syntheticoligonucleotide
  source 1..23: mol_type = other DNA
tgcgactcttgcaagagtcgcag

SEQ ID NO: 6652 - DNA, 23 bp, synthetic construct
  misc_feature 1..23: note = Description of Artificial Sequence: Syntheticoligonucleotide
  source 1..23: mol_type = other DNA
ggtgactcttgcaagagtcaccg

SEQ ID NO: 6653 - DNA, 23 bp, synthetic construct
  misc_feature 1..23: note = Description of Artificial Sequence: Syntheticoligonucleotide
  source 1..23: mol_type = other DNA
acggactcttgcaagagtccgtg

SEQ ID NO: 6654 - DNA, 23 bp, synthetic construct
  misc_feature 1..23: note = Description of Artificial Sequence: Syntheticoligonucleotide
  source 1..23: mol_type = other DNA
ccagactcttgcaagagtctggg

SEQ ID NO: 6655 - DNA, 23 bp, synthetic construct
  misc_feature 1..23: note = Description of Artificial Sequence: Syntheticoligonucleotide
  source 1..23: mol_type = other DNA
tcggactcttgcaagagtccgag

SEQ ID NO: 6656 - DNA, 23 bp, synthetic construct
  misc_feature 1..23: note = Description of Artificial Sequence: Syntheticoligonucleotide
  source 1..23: mol_type = other DNA
cctgactcttgcaagagtcaggg

SEQ ID NO: 6657 - DNA, 23 bp, synthetic construct
  misc_feature 1..23: note = Description of Artificial Sequence: Syntheticoligonucleotide
  source 1..23: mol_type = other DNA
cacgactcttgcaagagtcgtgg

SEQ ID NO: 6658 - DNA, 23 bp, synthetic construct
  misc_feature 1..23: note = Description of Artificial Sequence: Syntheticoligonucleotide
  source 1..23: mol_type = other DNA
gccgactcttgcaagagtcggct

SEQ ID NO: 6659 - DNA, 23 bp, synthetic construct
  misc_feature 1..23: note = Description of Artificial Sequence: Syntheticoligonucleotide
  source 1..23: mol_type = other DNA
gccgactcttgcaagagtcggca

SEQ ID NO: 6660 - DNA, 23 bp, synthetic construct
  misc_feature 1..23: note = Description of Artificial Sequence: Syntheticoligonucleotide
  source 1..23: mol_type = other DNA
cgagactcttgcaagagtctcgc

SEQ ID NO: 6661 - DNA, 23 bp, synthetic construct
  misc_feature 1..23: note = Description of Artificial Sequence: Syntheticoligonucleotide
  source 1..23: mol_type = other DNA
cgtgactcttgcaagagtcacgc

SEQ ID NO: 6662 - DNA, 23 bp, synthetic construct
  misc_feature 1..23: note = Description of Artificial Sequence: Syntheticoligonucleotide
  source 1..23: mol_type = other DNA
caggactcttgcaagagtcctgc

SEQ ID NO: 6663 - DNA, 23 bp, synthetic construct
  misc_feature 1..23: note = Description of Artificial Sequence: Syntheticoligonucleotide
  source 1..23: mol_type = other DNA
ctggactcttgcaagagtccagc

SEQ ID NO: 6664 - DNA, 23 bp, synthetic construct
  misc_feature 1..23: note = Description of Artificial Sequence: Syntheticoligonucleotide
  source 1..23: mol_type = other DNA
gaggactcttgcaagagtcctcg

SEQ ID NO: 6665 - DNA, 23 bp, synthetic construct
  misc_feature 1..23: note = Description of Artificial Sequence: Syntheticoligonucleotide
  source 1..23: mol_type = other DNA
gtggactcttgcaagagtccacg

SEQ ID NO: 6666 - DNA, 23 bp, synthetic construct
  misc_feature 1..23: note = Description of Artificial Sequence: Syntheticoligonucleotide
  source 1..23: mol_type = other DNA
accgactcttgcaagagtcggtg

SEQ ID NO: 6667 - DNA, 23 bp, synthetic construct
  misc_feature 1..23: note = Description of Artificial Sequence: Syntheticoligonucleotide
  source 1..23: mol_type = other DNA
tccgactcttgcaagagtcggag

SEQ ID NO: 6668 - DNA, 23 bp, synthetic construct
  misc_feature 1..23: note = Description of Artificial Sequence: Syntheticoligonucleotide
  source 1..23: mol_type = other DNA
cgggactcttgcaagagtcccgc

SEQ ID NO: 6669 - DNA, 23 bp, synthetic construct
  misc_feature 1..23: note = Description of Artificial Sequence: Syntheticoligonucleotide
  source 1..23: mol_type = other DNA
agggactcttgcaagagtccctc

SEQ ID NO: 6670 - DNA, 23 bp, synthetic construct
  misc_feature 1..23: note = Description of Artificial Sequence: Syntheticoligonucleotide
  source 1..23: mol_type = other DNA
tgggactcttgcaagagtcccac

SEQ ID NO: 6671 - DNA, 23 bp, synthetic construct
  misc_feature 1..23: note = Description of Artificial Sequence: Syntheticoligonucleotide
  misc_difference 1..3: note = a, c, t, or g
  misc_difference 20..23: note = a, c, t, or g
  source 1..23: mol_type = other DNA
nnngactcttcgaagagtcnnnn

SEQ ID NO: 6672 - DNA, 23 bp, synthetic construct
  misc_feature 1..23: note = Description of Artificial Sequence: Syntheticoligonucleotide
  source 1..23: mol_type = other DNA
gcggactcttcgaagagtccgcc

SEQ ID NO: 6673 - DNA, 23 bp, synthetic construct
  misc_feature 1..23: note = Description of Artificial Sequence: Syntheticoligonucleotide
  source 1..23: mol_type = other DNA
gcggactcttcgaagagtccgct

SEQ ID NO: 6674 - DNA, 23 bp, synthetic construct
  misc_feature 1..23: note = Description of Artificial Sequence: Syntheticoligonucleotide
  source 1..23: mol_type = other DNA
acggactcttcgaagagtccgtc

SEQ ID NO: 6675 - DNA, 23 bp, synthetic construct
  misc_feature 1..23: note = Description of Artificial Sequence: Syntheticoligonucleotide
  source 1..23: mol_type = other DNA
gaggactcttcgaagagtcctcc

SEQ ID NO: 6676 - DNA, 23 bp, synthetic construct
  misc_feature 1..23: note = Description of Artificial Sequence: Syntheticoligonucleotide
  source 1..23: mol_type = other DNA
gcagactcttcgaagagtctgcc

SEQ ID NO: 6677 - DNA, 23 bp, synthetic construct
  misc_feature 1..23: note = Description of Artificial Sequence: Syntheticoligonucleotide
  source 1..23: mol_type = other DNA
gcggactcttcgaagagtccgca

SEQ ID NO: 6678 - DNA, 23 bp, synthetic construct
  misc_feature 1..23: note = Description of Artificial Sequence: Syntheticoligonucleotide
  source 1..23: mol_type = other DNA
tcggactcttcgaagagtccgac

SEQ ID NO: 6679 - DNA, 23 bp, synthetic construct
  misc_feature 1..23: note = Description of Artificial Sequence: Syntheticoligonucleotide
  source 1..23: mol_type = other DNA
gtggactcttcgaagagtccacc

SEQ ID NO: 6680 - DNA, 23 bp, synthetic construct
  misc_feature 1..23: note = Description of Artificial Sequence: Syntheticoligonucleotide
  source 1..23: mol_type = other DNA
gctgactcttcgaagagtcagcc

SEQ ID NO: 6681 - DNA, 23 bp, synthetic construct
  misc_feature 1..23: note = Description of Artificial Sequence: Syntheticoligonucleotide
  source 1..23: mol_type = other DNA
cccgactcttcgaagagtcgggc

SEQ ID NO: 6682 - DNA, 23 bp, synthetic construct
  misc_feature 1..23: note = Description of Artificial Sequence: Syntheticoligonucleotide
  source 1..23: mol_type = other DNA
cccgactcttcgaagagtcgggt

SEQ ID NO: 6683 - DNA, 23 bp, synthetic construct
  misc_feature 1..23: note = Description of Artificial Sequence: Syntheticoligonucleotide
  source 1..23: mol_type = other DNA
accgactcttcgaagagtcggtc

SEQ ID NO: 6684 - DNA, 23 bp, synthetic construct
  misc_feature 1..23: note = Description of Artificial Sequence: Syntheticoligonucleotide
  source 1..23: mol_type = other DNA
cacgactcttcgaagagtcgtgc

SEQ ID NO: 6685 - DNA, 23 bp, synthetic construct
  misc_feature 1..23: note = Description of Artificial Sequence: Syntheticoligonucleotide
  source 1..23: mol_type = other DNA
ccagactcttcgaagagtctggc

SEQ ID NO: 6686 - DNA, 23 bp, synthetic construct
  misc_feature 1..23: note = Description of Artificial Sequence: Syntheticoligonucleotide
  source 1..23: mol_type = other DNA
cccgactcttcgaagagtcggga

SEQ ID NO: 6687 - DNA, 23 bp, synthetic construct
  misc_feature 1..23: note = Description of Artificial Sequence: Syntheticoligonucleotide
  source 1..23: mol_type = other DNA
tccgactcttcgaagagtcggac

SEQ ID NO: 6688 - DNA, 23 bp, synthetic construct
  misc_feature 1..23: note = Description of Artificial Sequence: Syntheticoligonucleotide
  source 1..23: mol_type = other DNA
cctgactcttcgaagagtcaggc

SEQ ID NO: 6689 - DNA, 23 bp, synthetic construct
  misc_feature 1..23: note = Description of Artificial Sequence: Syntheticoligonucleotide
  source 1..23: mol_type = other DNA
ggcgactcttcgaagagtcgccc

SEQ ID NO: 6690 - DNA, 23 bp, synthetic construct
  misc_feature 1..23: note = Description of Artificial Sequence: Syntheticoligonucleotide
  source 1..23: mol_type = other DNA
ggcgactcttcgaagagtcgcct

SEQ ID NO: 6691 - DNA, 23 bp, synthetic construct
  misc_feature 1..23: note = Description of Artificial Sequence: Syntheticoligonucleotide
  source 1..23: mol_type = other DNA
agcgactcttcgaagagtcgctc

SEQ ID NO: 6692 - DNA, 23 bp, synthetic construct
  misc_feature 1..23: note = Description of Artificial Sequence: Syntheticoligonucleotide
  source 1..23: mol_type = other DNA
gacgactcttcgaagagtcgtcc

SEQ ID NO: 6693 - DNA, 23 bp, synthetic construct
  misc_feature 1..23: note = Description of Artificial Sequence: Syntheticoligonucleotide
  source 1..23: mol_type = other DNA
ggagactcttcgaagagtctccc

SEQ ID NO: 6694 - DNA, 23 bp, synthetic construct
  misc_feature 1..23: note = Description of Artificial Sequence: Syntheticoligonucleotide
  source 1..23: mol_type = other DNA
ggcgactcttcgaagagtcgcca

SEQ ID NO: 6695 - DNA, 23 bp, synthetic construct
  misc_feature 1..23: note = Description of Artificial Sequence: Syntheticoligonucleotide
  source 1..23: mol_type = other DNA
tgcgactcttcgaagagtcgcac

SEQ ID NO: 6696 - DNA, 23 bp, synthetic construct
  misc_feature 1..23: note = Description of Artificial Sequence: Syntheticoligonucleotide
  source 1..23: mol_type = other DNA
ggtgactcttcgaagagtcaccc

SEQ ID NO: 6697 - DNA, 23 bp, synthetic construct
  misc_feature 1..23: note = Description of Artificial Sequence: Syntheticoligonucleotide
  source 1..23: mol_type = other DNA
cgggactcttcgaagagtcccgt

SEQ ID NO: 6698 - DNA, 23 bp, synthetic construct
  misc_feature 1..23: note = Description of Artificial Sequence: Syntheticoligonucleotide
  source 1..23: mol_type = other DNA
agggactcttcgaagagtccctg

SEQ ID NO: 6699 - DNA, 23 bp, synthetic construct
  misc_feature 1..23: note = Description of Artificial Sequence: Syntheticoligonucleotide
  source 1..23: mol_type = other DNA
caggactcttcgaagagtcctgg

SEQ ID NO: 6700 - DNA, 23 bp, synthetic construct
  misc_feature 1..23: note = Description of Artificial Sequence: Syntheticoligonucleotide
  source 1..23: mol_type = other DNA
cgagactcttcgaagagtctcgg

SEQ ID NO: 6701 - DNA, 23 bp, synthetic construct
  misc_feature 1..23: note = Description of Artificial Sequence: Syntheticoligonucleotide
  source 1..23: mol_type = other DNA
cgggactcttcgaagagtcccga

SEQ ID NO: 6702 - DNA, 23 bp, synthetic construct
  misc_feature 1..23: note = Description of Artificial Sequence: Syntheticoligonucleotide
  source 1..23: mol_type = other DNA
tgggactcttcgaagagtcccag

SEQ ID NO: 6703 - DNA, 23 bp, synthetic construct
  misc_feature 1..23: note = Description of Artificial Sequence: Syntheticoligonucleotide
  source 1..23: mol_type = other DNA
ctggactcttcgaagagtccagg

SEQ ID NO: 6704 - DNA, 23 bp, synthetic construct
  misc_feature 1..23: note = Description of Artificial Sequence: Syntheticoligonucleotide
  source 1..23: mol_type = other DNA
cgtgactcttcgaagagtcacgg

SEQ ID NO: 6705 - DNA, 23 bp, synthetic construct
  misc_feature 1..23: note = Description of Artificial Sequence: Syntheticoligonucleotide
  source 1..23: mol_type = other DNA
ggcgactcttcgaagagtcgccg

SEQ ID NO: 6706 - DNA, 23 bp, synthetic construct
  misc_feature 1..23: note = Description of Artificial Sequence: Syntheticoligonucleotide
  source 1..23: mol_type = other DNA
agcgactcttcgaagagtcgctg

SEQ ID NO: 6707 - DNA, 23 bp, synthetic construct
  misc_feature 1..23: note = Description of Artificial Sequence: Syntheticoligonucleotide
  source 1..23: mol_type = other DNA
gacgactcttcgaagagtcgtcg

SEQ ID NO: 6708 - DNA, 23 bp, synthetic construct
  misc_feature 1..23: note = Description of Artificial Sequence: Syntheticoligonucleotide
  source 1..23: mol_type = other DNA
ggagactcttcgaagagtctccg

SEQ ID NO: 6709 - DNA, 23 bp, synthetic construct
  misc_feature 1..23: note = Description of Artificial Sequence: Syntheticoligonucleotide
  source 1..23: mol_type = other DNA
tgcgactcttcgaagagtcgcag

SEQ ID NO: 6710 - DNA, 23 bp, synthetic construct
  misc_feature 1..23: note = Description of Artificial Sequence: Syntheticoligonucleotide
  source 1..23: mol_type = other DNA
ggtgactcttcgaagagtcaccg

SEQ ID NO: 6711 - DNA, 23 bp, synthetic construct
  misc_feature 1..23: note = Description of Artificial Sequence: Syntheticoligonucleotide
  source 1..23: mol_type = other DNA
acggactcttcgaagagtccgtg

SEQ ID NO: 6712 - DNA, 23 bp, synthetic construct
  misc_feature 1..23: note = Description of Artificial Sequence: Syntheticoligonucleotide
  source 1..23: mol_type = other DNA
ccagactcttcgaagagtctggg

SEQ ID NO: 6713 - DNA, 23 bp, synthetic construct
  misc_feature 1..23: note = Description of Artificial Sequence: Syntheticoligonucleotide
  source 1..23: mol_type = other DNA
tcggactcttcgaagagtccgag

SEQ ID NO: 6714 - DNA, 23 bp, synthetic construct
  misc_feature 1..23: note = Description of Artificial Sequence: Syntheticoligonucleotide
  source 1..23: mol_type = other DNA
cctgactcttcgaagagtcaggg

SEQ ID NO: 6715 - DNA, 23 bp, synthetic construct
  misc_feature 1..23: note = Description of Artificial Sequence: Syntheticoligonucleotide
  source 1..23: mol_type = other DNA
cacgactcttcgaagagtcgtgg

SEQ ID NO: 6716 - DNA, 23 bp, synthetic construct
  misc_feature 1..23: note = Description of Artificial Sequence: Syntheticoligonucleotide
  source 1..23: mol_type = other DNA
gccgactcttcgaagagtcggct

SEQ ID NO: 6717 - DNA, 23 bp, synthetic construct
  misc_feature 1..23: note = Description of Artificial Sequence: Syntheticoligonucleotide
  source 1..23: mol_type = other DNA
gccgactcttcgaagagtcggca

SEQ ID NO: 6718 - DNA, 23 bp, synthetic construct
  misc_feature 1..23: note = Description of Artificial Sequence: Syntheticoligonucleotide
  source 1..23: mol_type = other DNA
cgagactcttcgaagagtctcgc

SEQ ID NO: 6719 - DNA, 23 bp, synthetic construct
  misc_feature 1..23: note = Description of Artificial Sequence: Syntheticoligonucleotide
  source 1..23: mol_type = other DNA
cgtgactcttcgaagagtcacgc

SEQ ID NO: 6720 - DNA, 23 bp, synthetic construct
  misc_feature 1..23: note = Description of Artificial Sequence: Syntheticoligonucleotide
  source 1..23: mol_type = other DNA
caggactcttcgaagagtcctgc

SEQ ID NO: 6721 - DNA, 23 bp, synthetic construct
  misc_feature 1..23: note = Description of Artificial Sequence: Syntheticoligonucleotide
  source 1..23: mol_type = other DNA
ctggactcttcgaagagtccagc

SEQ ID NO: 6722 - DNA, 23 bp, synthetic construct
  misc_feature 1..23: note = Description of Artificial Sequence: Syntheticoligonucleotide
  source 1..23: mol_type = other DNA
gaggactcttcgaagagtcctcg

SEQ ID NO: 6723 - DNA, 23 bp, synthetic construct
  misc_feature 1..23: note = Description of Artificial Sequence: Syntheticoligonucleotide
  source 1..23: mol_type = other DNA
gtggactcttcgaagagtccacg

SEQ ID NO: 6724 - DNA, 23 bp, synthetic construct
  misc_feature 1..23: note = Description of Artificial Sequence: Syntheticoligonucleotide
  source 1..23: mol_type = other DNA
accgactcttcgaagagtcggtg

SEQ ID NO: 6725 - DNA, 23 bp, synthetic construct
  misc_feature 1..23: note = Description of Artificial Sequence: Syntheticoligonucleotide
  source 1..23: mol_type = other DNA
tccgactcttcgaagagtcggag

SEQ ID NO: 6726 - DNA, 23 bp, synthetic construct
  misc_feature 1..23: note = Description of Artificial Sequence: Syntheticoligonucleotide
  source 1..23: mol_type = other DNA
cgggactcttcgaagagtcccgc

SEQ ID NO: 6727 - DNA, 23 bp, synthetic construct
  misc_feature 1..23: note = Description of Artificial Sequence: Syntheticoligonucleotide
  source 1..23: mol_type = other DNA
agggactcttcgaagagtccctc

SEQ ID NO: 6728 - DNA, 23 bp, synthetic construct
  misc_feature 1..23: note = Description of Artificial Sequence: Syntheticoligonucleotide
  source 1..23: mol_type = other DNA
tgggactcttcgaagagtcccac

SEQ ID NO: 6729 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactccgatcggagtcnnnn

SEQ ID NO: 6730 - DNA, 22 bp, synthetic construct
  misc_feature 1..22: note = Description of Artificial Sequence: Syntheticoligonucleotide
  source 1..22: mol_type = other DNA
cggactccgatcggagtccgcc

SEQ ID NO: 6731 - DNA, 22 bp, synthetic construct
  misc_feature 1..22: note = Description of Artificial Sequence: Syntheticoligonucleotide
  source 1..22: mol_type = other DNA
cggactccgatcggagtccgct

SEQ ID NO: 6732 - DNA, 22 bp, synthetic construct
  misc_feature 1..22: note = Description of Artificial Sequence: Syntheticoligonucleotide
  source 1..22: mol_type = other DNA
cggactccgatcggagtccgtc

SEQ ID NO: 6733 - DNA, 22 bp, synthetic construct
  misc_feature 1..22: note = Description of Artificial Sequence: Syntheticoligonucleotide
  source 1..22: mol_type = other DNA
aggactccgatcggagtcctcc

SEQ ID NO: 6734 - DNA, 22 bp, synthetic construct
  misc_feature 1..22: note = Description of Artificial Sequence: Syntheticoligonucleotide
  source 1..22: mol_type = other DNA
cagactccgatcggagtctgcc

SEQ ID NO: 6735 - DNA, 22 bp, synthetic construct
  misc_feature 1..22: note = Description of Artificial Sequence: Syntheticoligonucleotide
  source 1..22: mol_type = other DNA
cggactccgatcggagtccgca

SEQ ID NO: 6736 - DNA, 22 bp, synthetic construct
  misc_feature 1..22: note = Description of Artificial Sequence: Syntheticoligonucleotide
  source 1..22: mol_type = other DNA
cggactccgatcggagtccgac

SEQ ID NO: 6737 - DNA, 22 bp, synthetic construct
  misc_feature 1..22: note = Description of Artificial Sequence: Syntheticoligonucleotide
  source 1..22: mol_type = other DNA
tggactccgatcggagtccacc

SEQ ID NO: 6738 - DNA, 22 bp, synthetic construct
  misc_feature 1..22: note = Description of Artificial Sequence: Syntheticoligonucleotide
  source 1..22: mol_type = other DNA
ctgactccgatcggagtcagcc

SEQ ID NO: 6739 - DNA, 22 bp, synthetic construct
  misc_feature 1..22: note = Description of Artificial Sequence: Syntheticoligonucleotide
  source 1..22: mol_type = other DNA
ccgactccgatcggagtcgggc

SEQ ID NO: 6740 - DNA, 22 bp, synthetic construct
  misc_feature 1..22: note = Description of Artificial Sequence: Syntheticoligonucleotide
  source 1..22: mol_type = other DNA
ccgactccgatcggagtcgggt

SEQ ID NO: 6741 - DNA, 22 bp, synthetic construct
  misc_feature 1..22: note = Description of Artificial Sequence: Syntheticoligonucleotide
  source 1..22: mol_type = other DNA
ccgactccgatcggagtcggtc

SEQ ID NO: 6742 - DNA, 22 bp, synthetic construct
  misc_feature 1..22: note = Description of Artificial Sequence: Syntheticoligonucleotide
  source 1..22: mol_type = other DNA
acgactccgatcggagtcgtgc

SEQ ID NO: 6743 - DNA, 22 bp, synthetic construct
  misc_feature 1..22: note = Description of Artificial Sequence: Syntheticoligonucleotide
  source 1..22: mol_type = other DNA
cagactccgatcggagtctggc

SEQ ID NO: 6744 - DNA, 22 bp, synthetic construct
  misc_feature 1..22: note = Description of Artificial Sequence: Syntheticoligonucleotide
  source 1..22: mol_type = other DNA
ccgactccgatcggagtcggga

SEQ ID NO: 6745 - DNA, 22 bp, synthetic construct
  misc_feature 1..22: note = Description of Artificial Sequence: Syntheticoligonucleotide
  source 1..22: mol_type = other DNA
ccgactccgatcggagtcggac

SEQ ID NO: 6746 - DNA, 22 bp, synthetic construct
  misc_feature 1..22: note = Description of Artificial Sequence: Syntheticoligonucleotide
  source 1..22: mol_type = other DNA
ctgactccgatcggagtcaggc

SEQ ID NO: 6747 - DNA, 22 bp, synthetic construct
  misc_feature 1..22: note = Description of Artificial Sequence: Syntheticoligonucleotide
  source 1..22: mol_type = other DNA
gcgactccgatcggagtcgccc

SEQ ID NO: 6748 - DNA, 22 bp, synthetic construct
  misc_feature 1..22: note = Description of Artificial Sequence: Syntheticoligonucleotide
  source 1..22: mol_type = other DNA
gcgactccgatcggagtcgcct

SEQ ID NO: 6749 - DNA, 22 bp, synthetic construct
  misc_feature 1..22: note = Description of Artificial Sequence: Syntheticoligonucleotide
  source 1..22: mol_type = other DNA
gcgactccgatcggagtcgctc

SEQ ID NO: 6750 - DNA, 22 bp, synthetic construct
  misc_feature 1..22: note = Description of Artificial Sequence: Syntheticoligonucleotide
  source 1..22: mol_type = other DNA
acgactccgatcggagtcgtcc

SEQ ID NO: 6751 - DNA, 22 bp, synthetic construct
  misc_feature 1..22: note = Description of Artificial Sequence: Syntheticoligonucleotide
  source 1..22: mol_type = other DNA
gagactccgatcggagtctccc

SEQ ID NO: 6752 - DNA, 22 bp, synthetic construct
  misc_feature 1..22: note = Description of Artificial Sequence: Syntheticoligonucleotide
  source 1..22: mol_type = other DNA
gcgactccgatcggagtcgcca

SEQ ID NO: 6753 - DNA, 22 bp, synthetic construct
  misc_feature 1..22: note = Description of Artificial Sequence: Syntheticoligonucleotide
  source 1..22: mol_type = other DNA
gcgactccgatcggagtcgcac

SEQ ID NO: 6754 - DNA, 22 bp, synthetic construct
  misc_feature 1..22: note = Description of Artificial Sequence: Syntheticoligonucleotide
  source 1..22: mol_type = other DNA
gtgactccgatcggagtcaccc

SEQ ID NO: 6755 - DNA, 22 bp, synthetic construct
  misc_feature 1..22: note = Description of Artificial Sequence: Syntheticoligonucleotide
  source 1..22: mol_type = other DNA
gggactccgatcggagtcccgt

SEQ ID NO: 6756 - DNA, 22 bp, synthetic construct
  misc_feature 1..22: note = Description of Artificial Sequence: Syntheticoligonucleotide
  source 1..22: mol_type = other DNA
gggactccgatcggagtccctg

SEQ ID NO: 6757 - DNA, 22 bp, synthetic construct
  misc_feature 1..22: note = Description of Artificial Sequence: Syntheticoligonucleotide
  source 1..22: mol_type = other DNA
aggactccgatcggagtcctgg

SEQ ID NO: 6758 - DNA, 22 bp, synthetic construct
  misc_feature 1..22: note = Description of Artificial Sequence: Syntheticoligonucleotide
  source 1..22: mol_type = other DNA
gagactccgatcggagtctcgg

SEQ ID NO: 6759 - DNA, 22 bp, synthetic construct
  misc_feature 1..22: note = Description of Artificial Sequence: Syntheticoligonucleotide
  source 1..22: mol_type = other DNA
gggactccgatcggagtcccga

SEQ ID NO: 6760 - DNA, 22 bp, synthetic construct
  misc_feature 1..22: note = Description of Artificial Sequence: Syntheticoligonucleotide
  source 1..22: mol_type = other DNA
gggactccgatcggagtcccag

SEQ ID NO: 6761 - DNA, 22 bp, synthetic construct
  misc_feature 1..22: note = Description of Artificial Sequence: Syntheticoligonucleotide
  source 1..22: mol_type = other DNA
tggactccgatcggagtccagg

SEQ ID NO: 6762 - DNA, 22 bp, synthetic construct
  misc_feature 1..22: note = Description of Artificial Sequence: Syntheticoligonucleotide
  source 1..22: mol_type = other DNA
gtgactccgatcggagtcacgg

SEQ ID NO: 6763 - DNA, 22 bp, synthetic construct
  misc_feature 1..22: note = Description of Artificial Sequence: Syntheticoligonucleotide
  source 1..22: mol_type = other DNA
gcgactccgatcggagtcgccg

SEQ ID NO: 6764 - DNA, 22 bp, synthetic construct
  misc_feature 1..22: note = Description of Artificial Sequence: Syntheticoligonucleotide
  source 1..22: mol_type = other DNA
gcgactccgatcggagtcgctg

SEQ ID NO: 6765 - DNA, 22 bp, synthetic construct
  misc_feature 1..22: note = Description of Artificial Sequence: Syntheticoligonucleotide
  source 1..22: mol_type = other DNA
acgactccgatcggagtcgtcg

SEQ ID NO: 6766 - DNA, 22 bp, synthetic construct
  misc_feature 1..22: note = Description of Artificial Sequence: Syntheticoligonucleotide
  source 1..22: mol_type = other DNA
gagactccgatcggagtctccg

SEQ ID NO: 6767 - DNA, 22 bp, synthetic construct
  misc_feature 1..22: note = Description of Artificial Sequence: Syntheticoligonucleotide
  source 1..22: mol_type = other DNA
gcgactccgatcggagtcgcag

SEQ ID NO: 6768 - DNA, 22 bp, synthetic construct
  misc_feature 1..22: note = Description of Artificial Sequence: Syntheticoligonucleotide
  source 1..22: mol_type = other DNA
gtgactccgatcggagtcaccg

SEQ ID NO: 6769 - DNA, 22 bp, synthetic construct
  misc_feature 1..22: note = Description of Artificial Sequence: Syntheticoligonucleotide
  source 1..22: mol_type = other DNA
cggactccgatcggagtccgtg

SEQ ID NO: 6770 - DNA, 22 bp, synthetic construct
  misc_feature 1..22: note = Description of Artificial Sequence: Syntheticoligonucleotide
  source 1..22: mol_type = other DNA
cagactccgatcggagtctggg

SEQ ID NO: 6771 - DNA, 22 bp, synthetic construct
  misc_feature 1..22: note = Description of Artificial Sequence: Syntheticoligonucleotide
  source 1..22: mol_type = other DNA
cggactccgatcggagtccgag

SEQ ID NO: 6772 - DNA, 22 bp, synthetic construct
  misc_feature 1..22: note = Description of Artificial Sequence: Syntheticoligonucleotide
  source 1..22: mol_type = other DNA
ctgactccgatcggagtcaggg

SEQ ID NO: 6773 - DNA, 22 bp, synthetic construct
  misc_feature 1..22: note = Description of Artificial Sequence: Syntheticoligonucleotide
  source 1..22: mol_type = other DNA
acgactccgatcggagtcgtgg

SEQ ID NO: 6774 - DNA, 22 bp, synthetic construct
  misc_feature 1..22: note = Description of Artificial Sequence: Syntheticoligonucleotide
  source 1..22: mol_type = other DNA
ccgactccgatcggagtcggct

SEQ ID NO: 6775 - DNA, 22 bp, synthetic construct
  misc_feature 1..22: note = Description of Artificial Sequence: Syntheticoligonucleotide
  source 1..22: mol_type = other DNA
ccgactccgatcggagtcggca

SEQ ID NO: 6776 - DNA, 22 bp, synthetic construct
  misc_feature 1..22: note = Description of Artificial Sequence: Syntheticoligonucleotide
  source 1..22: mol_type = other DNA
gagactccgatcggagtctcgc

SEQ ID NO: 6777 - DNA, 22 bp, synthetic construct
  misc_feature 1..22: note = Description of Artificial Sequence: Syntheticoligonucleotide
  source 1..22: mol_type = other DNA
gtgactccgatcggagtcacgc

SEQ ID NO: 6778 - DNA, 22 bp, synthetic construct
  misc_feature 1..22: note = Description of Artificial Sequence: Syntheticoligonucleotide
  source 1..22: mol_type = other DNA
aggactccgatcggagtcctgc

SEQ ID NO: 6779 - DNA, 22 bp, synthetic construct
  misc_feature 1..22: note = Description of Artificial Sequence: Syntheticoligonucleotide
  source 1..22: mol_type = other DNA
tggactccgatcggagtccagc

SEQ ID NO: 6780 - DNA, 22 bp, synthetic construct
  misc_feature 1..22: note = Description of Artificial Sequence: Syntheticoligonucleotide
  source 1..22: mol_type = other DNA
aggactccgatcggagtcctcg

SEQ ID NO: 6781 - DNA, 22 bp, synthetic construct
  misc_feature 1..22: note = Description of Artificial Sequence: Syntheticoligonucleotide
  source 1..22: mol_type = other DNA
tggactccgatcggagtccacg

SEQ ID NO: 6782 - DNA, 22 bp, synthetic construct
  misc_feature 1..22: note = Description of Artificial Sequence: Syntheticoligonucleotide
  source 1..22: mol_type = other DNA
ccgactccgatcggagtcggtg

SEQ ID NO: 6783 - DNA, 22 bp, synthetic construct
  misc_feature 1..22: note = Description of Artificial Sequence: Syntheticoligonucleotide
  source 1..22: mol_type = other DNA
ccgactccgatcggagtcggag

SEQ ID NO: 6784 - DNA, 22 bp, synthetic construct
  misc_feature 1..22: note = Description of Artificial Sequence: Syntheticoligonucleotide
  source 1..22: mol_type = other DNA
gggactccgatcggagtcccgc

SEQ ID NO: 6785 - DNA, 22 bp, synthetic construct
  misc_feature 1..22: note = Description of Artificial Sequence: Syntheticoligonucleotide
  source 1..22: mol_type = other DNA
gggactccgatcggagtccctc

SEQ ID NO: 6786 - DNA, 22 bp, synthetic construct
  misc_feature 1..22: note = Description of Artificial Sequence: Syntheticoligonucleotide
  source 1..22: mol_type = other DNA
gggactccgatcggagtcccac

SEQ ID NO: 6787 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactccgtacggagtcnnnn

SEQ ID NO: 6788 - DNA, 22 bp, synthetic construct
  misc_feature 1..22: note = Description of Artificial Sequence: Syntheticoligonucleotide
  source 1..22: mol_type = other DNA
cggactccgtacggagtccgcc

SEQ ID NO: 6789 - DNA, 22 bp, synthetic construct
  misc_feature 1..22: note = Description of Artificial Sequence: Syntheticoligonucleotide
  source 1..22: mol_type = other DNA
cggactccgtacggagtccgct

SEQ ID NO: 6790 - DNA, 22 bp, synthetic construct
  misc_feature 1..22: note = Description of Artificial Sequence: Syntheticoligonucleotide
  source 1..22: mol_type = other DNA
cggactccgtacggagtccgtc

SEQ ID NO: 6791 - DNA, 22 bp, synthetic construct
  misc_feature 1..22: note = Description of Artificial Sequence: Syntheticoligonucleotide
  source 1..22: mol_type = other DNA
aggactccgtacggagtcctcc

SEQ ID NO: 6792 - DNA, 22 bp, synthetic construct
  misc_feature 1..22: note = Description of Artificial Sequence: Syntheticoligonucleotide
  source 1..22: mol_type = other DNA
cagactccgtacggagtctgcc

SEQ ID NO: 6793 - DNA, 22 bp, synthetic construct
  misc_feature 1..22: note = Description of Artificial Sequence: Syntheticoligonucleotide
  source 1..22: mol_type = other DNA
cggactccgtacggagtccgca

SEQ ID NO: 6794 - DNA, 22 bp, synthetic construct
  misc_feature 1..22: note = Description of Artificial Sequence: Syntheticoligonucleotide
  source 1..22: mol_type = other DNA
cggactccgtacggagtccgac

SEQ ID NO: 6795 - DNA, 22 bp, synthetic construct
  misc_feature 1..22: note = Description of Artificial Sequence: Syntheticoligonucleotide
  source 1..22: mol_type = other DNA
tggactccgtacggagtccacc

SEQ ID NO: 6796 - DNA, 22 bp, synthetic construct
  misc_feature 1..22: note = Description of Artificial Sequence: Syntheticoligonucleotide
  source 1..22: mol_type = other DNA
ctgactccgtacggagtcagcc

SEQ ID NO: 6797 - DNA, 22 bp, synthetic construct
  misc_feature 1..22: note = Description of Artificial Sequence: Syntheticoligonucleotide
  source 1..22: mol_type = other DNA
ccgactccgtacggagtcgggc

SEQ ID NO: 6798 - DNA, 22 bp, synthetic construct
  misc_feature 1..22: note = Description of Artificial Sequence: Syntheticoligonucleotide
  source 1..22: mol_type = other DNA
ccgactccgtacggagtcgggt

SEQ ID NO: 6799 - DNA, 22 bp, synthetic construct
  misc_feature 1..22: note = Description of Artificial Sequence: Syntheticoligonucleotide
  source 1..22: mol_type = other DNA
ccgactccgtacggagtcggtc

SEQ ID NO: 6800 - DNA, 22 bp, synthetic construct
  misc_feature 1..22: note = Description of Artificial Sequence: Syntheticoligonucleotide
  source 1..22: mol_type = other DNA
acgactccgtacggagtcgtgc

SEQ ID NO: 6801 - DNA, 22 bp, synthetic construct
  misc_feature 1..22: note = Description of Artificial Sequence: Syntheticoligonucleotide
  source 1..22: mol_type = other DNA
cagactccgtacggagtctggc

SEQ ID NO: 6802 - DNA, 22 bp, synthetic construct
  misc_feature 1..22: note = Description of Artificial Sequence: Syntheticoligonucleotide
  source 1..22: mol_type = other DNA
ccgactccgtacggagtcggga

SEQ ID NO: 6803 - DNA, 22 bp, synthetic construct
  misc_feature 1..22: note = Description of Artificial Sequence: Syntheticoligonucleotide
  source 1..22: mol_type = other DNA
ccgactccgtacggagtcggac

SEQ ID NO: 6804 - DNA, 22 bp, synthetic construct
  misc_feature 1..22: note = Description of Artificial Sequence: Syntheticoligonucleotide
  source 1..22: mol_type = other DNA
ctgactccgtacggagtcaggc

SEQ ID NO: 6805 - DNA, 22 bp, synthetic construct
  misc_feature 1..22: note = Description of Artificial Sequence: Syntheticoligonucleotide
  source 1..22: mol_type = other DNA
gcgactccgtacggagtcgccc

SEQ ID NO: 6806 - DNA, 22 bp, synthetic construct
  misc_feature 1..22: note = Description of Artificial Sequence: Syntheticoligonucleotide
  source 1..22: mol_type = other DNA
gcgactccgtacggagtcgcct

SEQ ID NO: 6807 - DNA, 22 bp, synthetic construct
  misc_feature 1..22: note = Description of Artificial Sequence: Syntheticoligonucleotide
  source 1..22: mol_type = other DNA
gcgactccgtacggagtcgctc

SEQ ID NO: 6808 - DNA, 22 bp, synthetic construct
  misc_feature 1..22: note = Description of Artificial Sequence: Syntheticoligonucleotide
  source 1..22: mol_type = other DNA
acgactccgtacggagtcgtcc

SEQ ID NO: 6809 - DNA, 22 bp, synthetic construct
  misc_feature 1..22: note = Description of Artificial Sequence: Syntheticoligonucleotide
  source 1..22: mol_type = other DNA
gagactccgtacggagtctccc

SEQ ID NO: 6810 - DNA, 22 bp, synthetic construct
  misc_feature 1..22: note = Description of Artificial Sequence: Syntheticoligonucleotide
  source 1..22: mol_type = other DNA
gcgactccgtacggagtcgcca

SEQ ID NO: 6811 - DNA, 22 bp, synthetic construct
  misc_feature 1..22: note = Description of Artificial Sequence: Syntheticoligonucleotide
  source 1..22: mol_type = other DNA
gcgactccgtacggagtcgcac

SEQ ID NO: 6812 - DNA, 22 bp, synthetic construct
  misc_feature 1..22: note = Description of Artificial Sequence: Syntheticoligonucleotide
  source 1..22: mol_type = other DNA
gtgactccgtacggagtcaccc

SEQ ID NO: 6813 - DNA, 22 bp, synthetic construct
  misc_feature 1..22: note = Description of Artificial Sequence: Syntheticoligonucleotide
  source 1..22: mol_type = other DNA
gggactccgtacggagtcccgt

SEQ ID NO: 6814 - DNA, 22 bp, synthetic construct
  misc_feature 1..22: note = Description of Artificial Sequence: Syntheticoligonucleotide
  source 1..22: mol_type = other DNA
gggactccgtacggagtccctg

SEQ ID NO: 6815 - DNA, 22 bp, synthetic construct
  misc_feature 1..22: note = Description of Artificial Sequence: Syntheticoligonucleotide
  source 1..22: mol_type = other DNA
aggactccgtacggagtcctgg

SEQ ID NO: 6816 - DNA, 22 bp, synthetic construct
  misc_feature 1..22: note = Description of Artificial Sequence: Syntheticoligonucleotide
  source 1..22: mol_type = other DNA
gagactccgtacggagtctcgg

SEQ ID NO: 6817 - DNA, 22 bp, synthetic construct
  misc_feature 1..22: note = Description of Artificial Sequence: Syntheticoligonucleotide
  source 1..22: mol_type = other DNA
gggactccgtacggagtcccga

SEQ ID NO: 6818 - DNA, 22 bp, synthetic construct
  misc_feature 1..22: note = Description of Artificial Sequence: Syntheticoligonucleotide
  source 1..22: mol_type = other DNA
gggactccgtacggagtcccag

SEQ ID NO: 6819 - DNA, 22 bp, synthetic construct
  misc_feature 1..22: note = Description of Artificial Sequence: Syntheticoligonucleotide
  source 1..22: mol_type = other DNA
tggactccgtacggagtccagg

SEQ ID NO: 6820 - DNA, 22 bp, synthetic construct
  misc_feature 1..22: note = Description of Artificial Sequence: Syntheticoligonucleotide
  source 1..22: mol_type = other DNA
gtgactccgtacggagtcacgg

SEQ ID NO: 6821 - DNA, 22 bp, synthetic construct
  misc_feature 1..22: note = Description of Artificial Sequence: Syntheticoligonucleotide
  source 1..22: mol_type = other DNA
gcgactccgtacggagtcgccg

SEQ ID NO: 6822 - DNA, 22 bp, synthetic construct
  misc_feature 1..22: note = Description of Artificial Sequence: Syntheticoligonucleotide
  source 1..22: mol_type = other DNA
gcgactccgtacggagtcgctg

SEQ ID NO: 6823 - DNA, 22 bp, synthetic construct
  misc_feature 1..22: note = Description of Artificial Sequence: Syntheticoligonucleotide
  source 1..22: mol_type = other DNA
acgactccgtacggagtcgtcg

SEQ ID NO: 6824 - DNA, 22 bp, synthetic construct
  misc_feature 1..22: note = Description of Artificial Sequence: Syntheticoligonucleotide
  source 1..22: mol_type = other DNA
gagactccgtacggagtctccg

SEQ ID NO: 6825 - DNA, 22 bp, synthetic construct
  misc_feature 1..22: note = Description of Artificial Sequence: Syntheticoligonucleotide
  source 1..22: mol_type = other DNA
gcgactccgtacggagtcgcag

SEQ ID NO: 6826 - DNA, 22 bp, synthetic construct
  misc_feature 1..22: note = Description of Artificial Sequence: Syntheticoligonucleotide
  source 1..22: mol_type = other DNA
gtgactccgtacggagtcaccg

SEQ ID NO: 6827 - DNA, 22 bp, synthetic construct
  misc_feature 1..22: note = Description of Artificial Sequence: Syntheticoligonucleotide
  source 1..22: mol_type = other DNA
cggactccgtacggagtccgtg

SEQ ID NO: 6828 - DNA, 22 bp, synthetic construct
  misc_feature 1..22: note = Description of Artificial Sequence: Syntheticoligonucleotide
  source 1..22: mol_type = other DNA
cagactccgtacggagtctggg

SEQ ID NO: 6829 - DNA, 22 bp, synthetic construct
  misc_feature 1..22: note = Description of Artificial Sequence: Syntheticoligonucleotide
  source 1..22: mol_type = other DNA
cggactccgtacggagtccgag

SEQ ID NO: 6830 - DNA, 22 bp, synthetic construct
  misc_feature 1..22: note = Description of Artificial Sequence: Syntheticoligonucleotide
  source 1..22: mol_type = other DNA
ctgactccgtacggagtcaggg

SEQ ID NO: 6831 - DNA, 22 bp, synthetic construct
  misc_feature 1..22: note = Description of Artificial Sequence: Syntheticoligonucleotide
  source 1..22: mol_type = other DNA
acgactccgtacggagtcgtgg

SEQ ID NO: 6832 - DNA, 22 bp, synthetic construct
  misc_feature 1..22: note = Description of Artificial Sequence: Syntheticoligonucleotide
  source 1..22: mol_type = other DNA
ccgactccgtacggagtcggct

SEQ ID NO: 6833 - DNA, 22 bp, synthetic construct
  misc_feature 1..22: note = Description of Artificial Sequence: Syntheticoligonucleotide
  source 1..22: mol_type = other DNA
ccgactccgtacggagtcggca

SEQ ID NO: 6834 - DNA, 22 bp, synthetic construct
  misc_feature 1..22: note = Description of Artificial Sequence: Syntheticoligonucleotide
  source 1..22: mol_type = other DNA
gagactccgtacggagtctcgc

SEQ ID NO: 6835 - DNA, 22 bp, synthetic construct
  misc_feature 1..22: note = Description of Artificial Sequence: Syntheticoligonucleotide
  source 1..22: mol_type = other DNA
gtgactccgtacggagtcacgc

SEQ ID NO: 6836 - DNA, 22 bp, synthetic construct
  misc_feature 1..22: note = Description of Artificial Sequence: Syntheticoligonucleotide
  source 1..22: mol_type = other DNA
aggactccgtacggagtcctgc

SEQ ID NO: 6837 - DNA, 22 bp, synthetic construct
  misc_feature 1..22: note = Description of Artificial Sequence: Syntheticoligonucleotide
  source 1..22: mol_type = other DNA
tggactccgtacggagtccagc

SEQ ID NO: 6838 - DNA, 22 bp, synthetic construct
  misc_feature 1..22: note = Description of Artificial Sequence: Syntheticoligonucleotide
  source 1..22: mol_type = other DNA
aggactccgtacggagtcctcg

SEQ ID NO: 6839 - DNA, 22 bp, synthetic construct
  misc_feature 1..22: note = Description of Artificial Sequence: Syntheticoligonucleotide
  source 1..22: mol_type = other DNA
tggactccgtacggagtccacg

SEQ ID NO: 6840 - DNA, 22 bp, synthetic construct
  misc_feature 1..22: note = Description of Artificial Sequence: Syntheticoligonucleotide
  source 1..22: mol_type = other DNA
ccgactccgtacggagtcggtg

SEQ ID NO: 6841 - DNA, 22 bp, synthetic construct
  misc_feature 1..22: note = Description of Artificial Sequence: Syntheticoligonucleotide
  source 1..22: mol_type = other DNA
ccgactccgtacggagtcggag

SEQ ID NO: 6842 - DNA, 22 bp, synthetic construct
  misc_feature 1..22: note = Description of Artificial Sequence: Syntheticoligonucleotide
  source 1..22: mol_type = other DNA
gggactccgtacggagtcccgc

SEQ ID NO: 6843 - DNA, 22 bp, synthetic construct
  misc_feature 1..22: note = Description of Artificial Sequence: Syntheticoligonucleotide
  source 1..22: mol_type = other DNA
gggactccgtacggagtccctc

SEQ ID NO: 6844 - DNA, 22 bp, synthetic construct
  misc_feature 1..22: note = Description of Artificial Sequence: Syntheticoligonucleotide
  source 1..22: mol_type = other DNA
gggactccgtacggagtcccac

SEQ ID NO: 6845 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactccggccggagtcnnnn

SEQ ID NO: 6846 - DNA, 22 bp, synthetic construct
  misc_feature 1..22: note = Description of Artificial Sequence: Syntheticoligonucleotide
  source 1..22: mol_type = other DNA
cggactccggccggagtccgcc

SEQ ID NO: 6847 - DNA, 22 bp, synthetic construct
  misc_feature 1..22: note = Description of Artificial Sequence: Syntheticoligonucleotide
  source 1..22: mol_type = other DNA
cggactccggccggagtccgct

SEQ ID NO: 6848 - DNA, 22 bp, synthetic construct
  misc_feature 1..22: note = Description of Artificial Sequence: Syntheticoligonucleotide
  source 1..22: mol_type = other DNA
cggactccggccggagtccgtc

SEQ ID NO: 6849 - DNA, 22 bp, synthetic construct
  misc_feature 1..22: note = Description of Artificial Sequence: Syntheticoligonucleotide
  source 1..22: mol_type = other DNA
aggactccggccggagtcctcc

SEQ ID NO: 6850 - DNA, 22 bp, synthetic construct
  misc_feature 1..22: note = Description of Artificial Sequence: Syntheticoligonucleotide
  source 1..22: mol_type = other DNA
cagactccggccggagtctgcc

SEQ ID NO: 6851 - DNA, 22 bp, synthetic construct
  misc_feature 1..22: note = Description of Artificial Sequence: Syntheticoligonucleotide
  source 1..22: mol_type = other DNA
cggactccggccggagtccgca

SEQ ID NO: 6852 - DNA, 22 bp, synthetic construct
  misc_feature 1..22: note = Description of Artificial Sequence: Syntheticoligonucleotide
  source 1..22: mol_type = other DNA
cggactccggccggagtccgac

SEQ ID NO: 6853 - DNA, 22 bp, synthetic construct
  misc_feature 1..22: note = Description of Artificial Sequence: Syntheticoligonucleotide
  source 1..22: mol_type = other DNA
tggactccggccggagtccacc

SEQ ID NO: 6854 - DNA, 22 bp, synthetic construct
  misc_feature 1..22: note = Description of Artificial Sequence: Syntheticoligonucleotide
  source 1..22: mol_type = other DNA
ctgactccggccggagtcagcc

SEQ ID NO: 6855 - DNA, 22 bp, synthetic construct
  misc_feature 1..22: note = Description of Artificial Sequence: Syntheticoligonucleotide
  source 1..22: mol_type = other DNA
ccgactccggccggagtcgggc

SEQ ID NO: 6856 - DNA, 22 bp, synthetic construct
  misc_feature 1..22: note = Description of Artificial Sequence: Syntheticoligonucleotide
  source 1..22: mol_type = other DNA
ccgactccggccggagtcgggt

SEQ ID NO: 6857 - DNA, 22 bp, synthetic construct
  misc_feature 1..22: note = Description of Artificial Sequence: Syntheticoligonucleotide
  source 1..22: mol_type = other DNA
ccgactccggccggagtcggtc

SEQ ID NO: 6858 - DNA, 22 bp, synthetic construct
  misc_feature 1..22: note = Description of Artificial Sequence: Syntheticoligonucleotide
  source 1..22: mol_type = other DNA
acgactccggccggagtcgtgc

SEQ ID NO: 6859 - DNA, 22 bp, synthetic construct
  misc_feature 1..22: note = Description of Artificial Sequence: Syntheticoligonucleotide
  source 1..22: mol_type = other DNA
cagactccggccggagtctggc

SEQ ID NO: 6860 - DNA, 22 bp, synthetic construct
  misc_feature 1..22: note = Description of Artificial Sequence: Syntheticoligonucleotide
  source 1..22: mol_type = other DNA
ccgactccggccggagtcggga

SEQ ID NO: 6861 - DNA, 22 bp, synthetic construct
  misc_feature 1..22: note = Description of Artificial Sequence: Syntheticoligonucleotide
  source 1..22: mol_type = other DNA
ccgactccggccggagtcggac

SEQ ID NO: 6862 - DNA, 22 bp, synthetic construct
  misc_feature 1..22: note = Description of Artificial Sequence: Syntheticoligonucleotide
  source 1..22: mol_type = other DNA
ctgactccggccggagtcaggc

SEQ ID NO: 6863 - DNA, 22 bp, synthetic construct
  misc_feature 1..22: note = Description of Artificial Sequence: Syntheticoligonucleotide
  source 1..22: mol_type = other DNA
gcgactccggccggagtcgccc

SEQ ID NO: 6864 - DNA, 22 bp, synthetic construct
  misc_feature 1..22: note = Description of Artificial Sequence: Syntheticoligonucleotide
  source 1..22: mol_type = other DNA
gcgactccggccggagtcgcct

SEQ ID NO: 6865 - DNA, 22 bp, synthetic construct
  misc_feature 1..22: note = Description of Artificial Sequence: Syntheticoligonucleotide
  source 1..22: mol_type = other DNA
gcgactccggccggagtcgctc

SEQ ID NO: 6866 - DNA, 22 bp, synthetic construct
  misc_feature 1..22: note = Description of Artificial Sequence: Syntheticoligonucleotide
  source 1..22: mol_type = other DNA
acgactccggccggagtcgtcc

SEQ ID NO: 6867 - DNA, 22 bp, synthetic construct
  misc_feature 1..22: note = Description of Artificial Sequence: Syntheticoligonucleotide
  source 1..22: mol_type = other DNA
gagactccggccggagtctccc

SEQ ID NO: 6868 - DNA, 22 bp, synthetic construct
  misc_feature 1..22: note = Description of Artificial Sequence: Syntheticoligonucleotide
  source 1..22: mol_type = other DNA
gcgactccggccggagtcgcca

SEQ ID NO: 6869 - DNA, 22 bp, synthetic construct
  misc_feature 1..22: note = Description of Artificial Sequence: Syntheticoligonucleotide
  source 1..22: mol_type = other DNA
gcgactccggccggagtcgcac

SEQ ID NO: 6870 - DNA, 22 bp, synthetic construct
  misc_feature 1..22: note = Description of Artificial Sequence: Syntheticoligonucleotide
  source 1..22: mol_type = other DNA
gtgactccggccggagtcaccc

SEQ ID NO: 6871 - DNA, 22 bp, synthetic construct
  misc_feature 1..22: note = Description of Artificial Sequence: Syntheticoligonucleotide
  source 1..22: mol_type = other DNA
gggactccggccggagtcccgt

SEQ ID NO: 6872 - DNA, 22 bp, synthetic construct
  misc_feature 1..22: note = Description of Artificial Sequence: Syntheticoligonucleotide
  source 1..22: mol_type = other DNA
gggactccggccggagtccctg

SEQ ID NO: 6873 - DNA, 22 bp, synthetic construct
  misc_feature 1..22: note = Description of Artificial Sequence: Syntheticoligonucleotide
  source 1..22: mol_type = other DNA
aggactccggccggagtcctgg

SEQ ID NO: 6874 - DNA, 22 bp, synthetic construct
  misc_feature 1..22: note = Description of Artificial Sequence: Syntheticoligonucleotide
  source 1..22: mol_type = other DNA
gagactccggccggagtctcgg

SEQ ID NO: 6875 - DNA, 22 bp, synthetic construct
  misc_feature 1..22: note = Description of Artificial Sequence: Syntheticoligonucleotide
  source 1..22: mol_type = other DNA
gggactccggccggagtcccga

SEQ ID NO: 6876 - DNA, 22 bp, synthetic construct
  misc_feature 1..22: note = Description of Artificial Sequence: Syntheticoligonucleotide
  source 1..22: mol_type = other DNA
gggactccggccggagtcccag

SEQ ID NO: 6877 - DNA, 22 bp, synthetic construct
  misc_feature 1..22: note = Description of Artificial Sequence: Syntheticoligonucleotide
  source 1..22: mol_type = other DNA
tggactccggccggagtccagg

SEQ ID NO: 6878 - DNA, 22 bp, synthetic construct
  misc_feature 1..22: note = Description of Artificial Sequence: Syntheticoligonucleotide
  source 1..22: mol_type = other DNA
gtgactccggccggagtcacgg

SEQ ID NO: 6879 - DNA, 22 bp, synthetic construct
  misc_feature 1..22: note = Description of Artificial Sequence: Syntheticoligonucleotide
  source 1..22: mol_type = other DNA
gcgactccggccggagtcgccg

SEQ ID NO: 6880 - DNA, 22 bp, synthetic construct
  misc_feature 1..22: note = Description of Artificial Sequence: Syntheticoligonucleotide
  source 1..22: mol_type = other DNA
gcgactccggccggagtcgctg

SEQ ID NO: 6881 - DNA, 22 bp, synthetic construct
  misc_feature 1..22: note = Description of Artificial Sequence: Syntheticoligonucleotide
  source 1..22: mol_type = other DNA
acgactccggccggagtcgtcg

SEQ ID NO: 6882 - DNA, 22 bp, synthetic construct
  misc_feature 1..22: note = Description of Artificial Sequence: Syntheticoligonucleotide
  source 1..22: mol_type = other DNA
gagactccggccggagtctccg

SEQ ID NO: 6883 - DNA, 22 bp, synthetic construct
  misc_feature 1..22: note = Description of Artificial Sequence: Syntheticoligonucleotide
  source 1..22: mol_type = other DNA
gcgactccggccggagtcgcag

SEQ ID NO: 6884 - DNA, 22 bp, synthetic construct
  misc_feature 1..22: note = Description of Artificial Sequence: Syntheticoligonucleotide
  source 1..22: mol_type = other DNA
gtgactccggccggagtcaccg

SEQ ID NO: 6885 - DNA, 22 bp, synthetic construct
  misc_feature 1..22: note = Description of Artificial Sequence: Syntheticoligonucleotide
  source 1..22: mol_type = other DNA
cggactccggccggagtccgtg

SEQ ID NO: 6886 - DNA, 22 bp, synthetic construct
  misc_feature 1..22: note = Description of Artificial Sequence: Syntheticoligonucleotide
  source 1..22: mol_type = other DNA
cagactccggccggagtctggg

SEQ ID NO: 6887 - DNA, 22 bp, synthetic construct
  misc_feature 1..22: note = Description of Artificial Sequence: Syntheticoligonucleotide
  source 1..22: mol_type = other DNA
cggactccggccggagtccgag

SEQ ID NO: 6888 - DNA, 22 bp, synthetic construct
  misc_feature 1..22: note = Description of Artificial Sequence: Syntheticoligonucleotide
  source 1..22: mol_type = other DNA
ctgactccggccggagtcaggg

SEQ ID NO: 6889 - DNA, 22 bp, synthetic construct
  misc_feature 1..22: note = Description of Artificial Sequence: Syntheticoligonucleotide
  source 1..22: mol_type = other DNA
acgactccggccggagtcgtgg

SEQ ID NO: 6890 - DNA, 22 bp, synthetic construct
  misc_feature 1..22: note = Description of Artificial Sequence: Syntheticoligonucleotide
  source 1..22: mol_type = other DNA
ccgactccggccggagtcggct

SEQ ID NO: 6891 - DNA, 22 bp, synthetic construct
  misc_feature 1..22: note = Description of Artificial Sequence: Syntheticoligonucleotide
  source 1..22: mol_type = other DNA
ccgactccggccggagtcggca

SEQ ID NO: 6892 - DNA, 22 bp, synthetic construct
  misc_feature 1..22: note = Description of Artificial Sequence: Syntheticoligonucleotide
  source 1..22: mol_type = other DNA
gagactccggccggagtctcgc

SEQ ID NO: 6893 - DNA, 22 bp, synthetic construct
  misc_feature 1..22: note = Description of Artificial Sequence: Syntheticoligonucleotide
  source 1..22: mol_type = other DNA
gtgactccggccggagtcacgc

SEQ ID NO: 6894 - DNA, 22 bp, synthetic construct
  misc_feature 1..22: note = Description of Artificial Sequence: Syntheticoligonucleotide
  source 1..22: mol_type = other DNA
aggactccggccggagtcctgc

SEQ ID NO: 6895 - DNA, 22 bp, synthetic construct
  misc_feature 1..22: note = Description of Artificial Sequence: Syntheticoligonucleotide
  source 1..22: mol_type = other DNA
tggactccggccggagtccagc

SEQ ID NO: 6896 - DNA, 22 bp, synthetic construct
  misc_feature 1..22: note = Description of Artificial Sequence: Syntheticoligonucleotide
  source 1..22: mol_type = other DNA
aggactccggccggagtcctcg

SEQ ID NO: 6897 - DNA, 22 bp, synthetic construct
  misc_feature 1..22: note = Description of Artificial Sequence: Syntheticoligonucleotide
  source 1..22: mol_type = other DNA
tggactccggccggagtccacg

SEQ ID NO: 6898 - DNA, 22 bp, synthetic construct
  misc_feature 1..22: note = Description of Artificial Sequence: Syntheticoligonucleotide
  source 1..22: mol_type = other DNA
ccgactccggccggagtcggtg

SEQ ID NO: 6899 - DNA, 22 bp, synthetic construct
  misc_feature 1..22: note = Description of Artificial Sequence: Syntheticoligonucleotide
  source 1..22: mol_type = other DNA
ccgactccggccggagtcggag

SEQ ID NO: 6900 - DNA, 22 bp, synthetic construct
  misc_feature 1..22: note = Description of Artificial Sequence: Syntheticoligonucleotide
  source 1..22: mol_type = other DNA
gggactccggccggagtcccgc

SEQ ID NO: 6901 - DNA, 22 bp, synthetic construct
  misc_feature 1..22: note = Description of Artificial Sequence: Syntheticoligonucleotide
  source 1..22: mol_type = other DNA
gggactccggccggagtccctc

SEQ ID NO: 6902 - DNA, 22 bp, synthetic construct
  misc_feature 1..22: note = Description of Artificial Sequence: Syntheticoligonucleotide
  source 1..22: mol_type = other DNA
gggactccggccggagtcccac

SEQ ID NO: 6903 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactccgcgcggagtcnnnn

SEQ ID NO: 6904 - DNA, 22 bp, synthetic construct
  misc_feature 1..22: note = Description of Artificial Sequence: Syntheticoligonucleotide
  source 1..22: mol_type = other DNA
cggactccgcgcggagtccgcc

SEQ ID NO: 6905 - DNA, 22 bp, synthetic construct
  misc_feature 1..22: note = Description of Artificial Sequence: Syntheticoligonucleotide
  source 1..22: mol_type = other DNA
cggactccgcgcggagtccgct

SEQ ID NO: 6906 - DNA, 22 bp, synthetic construct
  misc_feature 1..22: note = Description of Artificial Sequence: Syntheticoligonucleotide
  source 1..22: mol_type = other DNA
cggactccgcgcggagtccgtc

SEQ ID NO: 6907 - DNA, 22 bp, synthetic construct
  misc_feature 1..22: note = Description of Artificial Sequence: Syntheticoligonucleotide
  source 1..22: mol_type = other DNA
aggactccgcgcggagtcctcc

SEQ ID NO: 6908 - DNA, 22 bp, synthetic construct
  misc_feature 1..22: note = Description of Artificial Sequence: Syntheticoligonucleotide
  source 1..22: mol_type = other DNA
cagactccgcgcggagtctgcc

SEQ ID NO: 6909 - DNA, 22 bp, synthetic construct
  misc_feature 1..22: note = Description of Artificial Sequence: Syntheticoligonucleotide
  source 1..22: mol_type = other DNA
cggactccgcgcggagtccgca

SEQ ID NO: 6910 - DNA, 22 bp, synthetic construct
  misc_feature 1..22: note = Description of Artificial Sequence: Syntheticoligonucleotide
  source 1..22: mol_type = other DNA
cggactccgcgcggagtccgac

SEQ ID NO: 6911 - DNA, 22 bp, synthetic construct
  misc_feature 1..22: note = Description of Artificial Sequence: Syntheticoligonucleotide
  source 1..22: mol_type = other DNA
tggactccgcgcggagtccacc

SEQ ID NO: 6912 - DNA, 22 bp, synthetic construct
  misc_feature 1..22: note = Description of Artificial Sequence: Syntheticoligonucleotide
  source 1..22: mol_type = other DNA
ctgactccgcgcggagtcagcc

SEQ ID NO: 6913 - DNA, 22 bp, synthetic construct
  misc_feature 1..22: note = Description of Artificial Sequence: Syntheticoligonucleotide
  source 1..22: mol_type = other DNA
ccgactccgcgcggagtcgggc

SEQ ID NO: 6914 - DNA, 22 bp, synthetic construct
  misc_feature 1..22: note = Description of Artificial Sequence: Syntheticoligonucleotide
  source 1..22: mol_type = other DNA
ccgactccgcgcggagtcgggt

SEQ ID NO: 6915 - DNA, 22 bp, synthetic construct
  misc_feature 1..22: note = Description of Artificial Sequence: Syntheticoligonucleotide
  source 1..22: mol_type = other DNA
ccgactccgcgcggagtcggtc

SEQ ID NO: 6916 - DNA, 22 bp, synthetic construct
  misc_feature 1..22: note = Description of Artificial Sequence: Syntheticoligonucleotide
  source 1..22: mol_type = other DNA
acgactccgcgcggagtcgtgc

SEQ ID NO: 6917 - DNA, 22 bp, synthetic construct
  misc_feature 1..22: note = Description of Artificial Sequence: Syntheticoligonucleotide
  source 1..22: mol_type = other DNA
cagactccgcgcggagtctggc

SEQ ID NO: 6918 - DNA, 22 bp, synthetic construct
  misc_feature 1..22: note = Description of Artificial Sequence: Syntheticoligonucleotide
  source 1..22: mol_type = other DNA
ccgactccgcgcggagtcggga

SEQ ID NO: 6919 - DNA, 22 bp, synthetic construct
  misc_feature 1..22: note = Description of Artificial Sequence: Syntheticoligonucleotide
  source 1..22: mol_type = other DNA
ccgactccgcgcggagtcggac

SEQ ID NO: 6920 - DNA, 22 bp, synthetic construct
  misc_feature 1..22: note = Description of Artificial Sequence: Syntheticoligonucleotide
  source 1..22: mol_type = other DNA
ctgactccgcgcggagtcaggc

SEQ ID NO: 6921 - DNA, 22 bp, synthetic construct
  misc_feature 1..22: note = Description of Artificial Sequence: Syntheticoligonucleotide
  source 1..22: mol_type = other DNA
gcgactccgcgcggagtcgccc

SEQ ID NO: 6922 - DNA, 22 bp, synthetic construct
  misc_feature 1..22: note = Description of Artificial Sequence: Syntheticoligonucleotide
  source 1..22: mol_type = other DNA
gcgactccgcgcggagtcgcct

SEQ ID NO: 6923 - DNA, 22 bp, synthetic construct
  misc_feature 1..22: note = Description of Artificial Sequence: Syntheticoligonucleotide
  source 1..22: mol_type = other DNA
gcgactccgcgcggagtcgctc

SEQ ID NO: 6924 - DNA, 22 bp, synthetic construct
  misc_feature 1..22: note = Description of Artificial Sequence: Syntheticoligonucleotide
  source 1..22: mol_type = other DNA
acgactccgcgcggagtcgtcc

SEQ ID NO: 6925 - DNA, 22 bp, synthetic construct
  misc_feature 1..22: note = Description of Artificial Sequence: Syntheticoligonucleotide
  source 1..22: mol_type = other DNA
gagactccgcgcggagtctccc

SEQ ID NO: 6926 - DNA, 22 bp, synthetic construct
  misc_feature 1..22: note = Description of Artificial Sequence: Syntheticoligonucleotide
  source 1..22: mol_type = other DNA
gcgactccgcgcggagtcgcca

SEQ ID NO: 6927 - DNA, 22 bp, synthetic construct
  misc_feature 1..22: note = Description of Artificial Sequence: Syntheticoligonucleotide
  source 1..22: mol_type = other DNA
gcgactccgcgcggagtcgcac

SEQ ID NO: 6928 - DNA, 22 bp, synthetic construct
  misc_feature 1..22: note = Description of Artificial Sequence: Syntheticoligonucleotide
  source 1..22: mol_type = other DNA
gtgactccgcgcggagtcaccc

SEQ ID NO: 6929 - DNA, 22 bp, synthetic construct
  misc_feature 1..22: note = Description of Artificial Sequence: Syntheticoligonucleotide
  source 1..22: mol_type = other DNA
gggactccgcgcggagtcccgt

SEQ ID NO: 6930 - DNA, 22 bp, synthetic construct
  misc_feature 1..22: note = Description of Artificial Sequence: Syntheticoligonucleotide
  source 1..22: mol_type = other DNA
gggactccgcgcggagtccctg

SEQ ID NO: 6931 - DNA, 22 bp, synthetic construct
  misc_feature 1..22: note = Description of Artificial Sequence: Syntheticoligonucleotide
  source 1..22: mol_type = other DNA
aggactccgcgcggagtcctgg

SEQ ID NO: 6932 - DNA, 22 bp, synthetic construct
  misc_feature 1..22: note = Description of Artificial Sequence: Syntheticoligonucleotide
  source 1..22: mol_type = other DNA
gagactccgcgcggagtctcgg

SEQ ID NO: 6933 - DNA, 22 bp, synthetic construct
  misc_feature 1..22: note = Description of Artificial Sequence: Syntheticoligonucleotide
  source 1..22: mol_type = other DNA
gggactccgcgcggagtcccga

SEQ ID NO: 6934 - DNA, 22 bp, synthetic construct
  misc_feature 1..22: note = Description of Artificial Sequence: Syntheticoligonucleotide
  source 1..22: mol_type = other DNA
gggactccgcgcggagtcccag

SEQ ID NO: 6935 - DNA, 22 bp, synthetic construct
  misc_feature 1..22: note = Description of Artificial Sequence: Syntheticoligonucleotide
  source 1..22: mol_type = other DNA
tggactccgcgcggagtccagg

SEQ ID NO: 6936 - DNA, 22 bp, synthetic construct
  misc_feature 1..22: note = Description of Artificial Sequence: Syntheticoligonucleotide
  source 1..22: mol_type = other DNA
gtgactccgcgcggagtcacgg

SEQ ID NO: 6937 - DNA, 22 bp, synthetic construct
  misc_feature 1..22: note = Description of Artificial Sequence: Syntheticoligonucleotide
  source 1..22: mol_type = other DNA
gcgactccgcgcggagtcgccg

SEQ ID NO: 6938 - DNA, 22 bp, synthetic construct
  misc_feature 1..22: note = Description of Artificial Sequence: Syntheticoligonucleotide
  source 1..22: mol_type = other DNA
gcgactccgcgcggagtcgctg

SEQ ID NO: 6939 - DNA, 22 bp, synthetic construct
  misc_feature 1..22: note = Description of Artificial Sequence: Syntheticoligonucleotide
  source 1..22: mol_type = other DNA
acgactccgcgcggagtcgtcg

SEQ ID NO: 6940 - DNA, 22 bp, synthetic construct
  misc_feature 1..22: note = Description of Artificial Sequence: Syntheticoligonucleotide
  source 1..22: mol_type = other DNA
gagactccgcgcggagtctccg

SEQ ID NO: 6941 - DNA, 22 bp, synthetic construct
  misc_feature 1..22: note = Description of Artificial Sequence: Syntheticoligonucleotide
  source 1..22: mol_type = other DNA
gcgactccgcgcggagtcgcag

SEQ ID NO: 6942 - DNA, 22 bp, synthetic construct
  misc_feature 1..22: note = Description of Artificial Sequence: Syntheticoligonucleotide
  source 1..22: mol_type = other DNA
gtgactccgcgcggagtcaccg

SEQ ID NO: 6943 - DNA, 22 bp, synthetic construct
  misc_feature 1..22: note = Description of Artificial Sequence: Syntheticoligonucleotide
  source 1..22: mol_type = other DNA
cggactccgcgcggagtccgtg

SEQ ID NO: 6944 - DNA, 22 bp, synthetic construct
  misc_feature 1..22: note = Description of Artificial Sequence: Syntheticoligonucleotide
  source 1..22: mol_type = other DNA
cagactccgcgcggagtctggg

SEQ ID NO: 6945 - DNA, 22 bp, synthetic construct
  misc_feature 1..22: note = Description of Artificial Sequence: Syntheticoligonucleotide
  source 1..22: mol_type = other DNA
cggactccgcgcggagtccgag

SEQ ID NO: 6946 - DNA, 22 bp, synthetic construct
  misc_feature 1..22: note = Description of Artificial Sequence: Syntheticoligonucleotide
  source 1..22: mol_type = other DNA
ctgactccgcgcggagtcaggg

SEQ ID NO: 6947 - DNA, 22 bp, synthetic construct
  misc_feature 1..22: note = Description of Artificial Sequence: Syntheticoligonucleotide
  source 1..22: mol_type = other DNA
acgactccgcgcggagtcgtgg

SEQ ID NO: 6948 - DNA, 22 bp, synthetic construct
  misc_feature 1..22: note = Description of Artificial Sequence: Syntheticoligonucleotide
  source 1..22: mol_type = other DNA
ccgactccgcgcggagtcggct

SEQ ID NO: 6949 - DNA, 22 bp, synthetic construct
  misc_feature 1..22: note = Description of Artificial Sequence: Syntheticoligonucleotide
  source 1..22: mol_type = other DNA
ccgactccgcgcggagtcggca

SEQ ID NO: 6950 - DNA, 22 bp, synthetic construct
  misc_feature 1..22: note = Description of Artificial Sequence: Syntheticoligonucleotide
  source 1..22: mol_type = other DNA
gagactccgcgcggagtctcgc

SEQ ID NO: 6951 - DNA, 22 bp, synthetic construct
  misc_feature 1..22: note = Description of Artificial Sequence: Syntheticoligonucleotide
  source 1..22: mol_type = other DNA
gtgactccgcgcggagtcacgc

SEQ ID NO: 6952 - DNA, 22 bp, synthetic construct
  misc_feature 1..22: note = Description of Artificial Sequence: Syntheticoligonucleotide
  source 1..22: mol_type = other DNA
aggactccgcgcggagtcctgc

SEQ ID NO: 6953 - DNA, 22 bp, synthetic construct
  misc_feature 1..22: note = Description of Artificial Sequence: Syntheticoligonucleotide
  source 1..22: mol_type = other DNA
tggactccgcgcggagtccagc

SEQ ID NO: 6954 - DNA, 22 bp, synthetic construct
  misc_feature 1..22: note = Description of Artificial Sequence: Syntheticoligonucleotide
  source 1..22: mol_type = other DNA
aggactccgcgcggagtcctcg

SEQ ID NO: 6955 - DNA, 22 bp, synthetic construct
  misc_feature 1..22: note = Description of Artificial Sequence: Syntheticoligonucleotide
  source 1..22: mol_type = other DNA
tggactccgcgcggagtccacg

SEQ ID NO: 6956 - DNA, 22 bp, synthetic construct
  misc_feature 1..22: note = Description of Artificial Sequence: Syntheticoligonucleotide
  source 1..22: mol_type = other DNA
ccgactccgcgcggagtcggtg

SEQ ID NO: 6957 - DNA, 22 bp, synthetic construct
  misc_feature 1..22: note = Description of Artificial Sequence: Syntheticoligonucleotide
  source 1..22: mol_type = other DNA
ccgactccgcgcggagtcggag

SEQ ID NO: 6958 - DNA, 22 bp, synthetic construct
  misc_feature 1..22: note = Description of Artificial Sequence: Syntheticoligonucleotide
  source 1..22: mol_type = other DNA
gggactccgcgcggagtcccgc

SEQ ID NO: 6959 - DNA, 22 bp, synthetic construct
  misc_feature 1..22: note = Description of Artificial Sequence: Syntheticoligonucleotide
  source 1..22: mol_type = other DNA
gggactccgcgcggagtccctc

SEQ ID NO: 6960 - DNA, 22 bp, synthetic construct
  misc_feature 1..22: note = Description of Artificial Sequence: Syntheticoligonucleotide
  source 1..22: mol_type = other DNA
gggactccgcgcggagtcccac

SEQ ID NO: 6961 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactctgatcagagtcnnnn

SEQ ID NO: 6962 - DNA, 22 bp, synthetic construct
  misc_feature 1..22: note = Description of Artificial Sequence: Syntheticoligonucleotide
  source 1..22: mol_type = other DNA
cggactctgatcagagtccgcc

SEQ ID NO: 6963 - DNA, 22 bp, synthetic construct
  misc_feature 1..22: note = Description of Artificial Sequence: Syntheticoligonucleotide
  source 1..22: mol_type = other DNA
cggactctgatcagagtccgct

SEQ ID NO: 6964 - DNA, 22 bp, synthetic construct
  misc_feature 1..22: note = Description of Artificial Sequence: Syntheticoligonucleotide
  source 1..22: mol_type = other DNA
cggactctgatcagagtccgtc

SEQ ID NO: 6965 - DNA, 22 bp, synthetic construct
  misc_feature 1..22: note = Description of Artificial Sequence: Syntheticoligonucleotide
  source 1..22: mol_type = other DNA
aggactctgatcagagtcctcc

SEQ ID NO: 6966 - DNA, 22 bp, synthetic construct
  misc_feature 1..22: note = Description of Artificial Sequence: Syntheticoligonucleotide
  source 1..22: mol_type = other DNA
cagactctgatcagagtctgcc

SEQ ID NO: 6967 - DNA, 22 bp, synthetic construct
  misc_feature 1..22: note = Description of Artificial Sequence: Syntheticoligonucleotide
  source 1..22: mol_type = other DNA
cggactctgatcagagtccgca

SEQ ID NO: 6968 - DNA, 22 bp, synthetic construct
  misc_feature 1..22: note = Description of Artificial Sequence: Syntheticoligonucleotide
  source 1..22: mol_type = other DNA
cggactctgatcagagtccgac

SEQ ID NO: 6969 - DNA, 22 bp, synthetic construct
  misc_feature 1..22: note = Description of Artificial Sequence: Syntheticoligonucleotide
  source 1..22: mol_type = other DNA
tggactctgatcagagtccacc

SEQ ID NO: 6970 - DNA, 22 bp, synthetic construct
  misc_feature 1..22: note = Description of Artificial Sequence: Syntheticoligonucleotide
  source 1..22: mol_type = other DNA
ctgactctgatcagagtcagcc

SEQ ID NO: 6971 - DNA, 22 bp, synthetic construct
  misc_feature 1..22: note = Description of Artificial Sequence: Syntheticoligonucleotide
  source 1..22: mol_type = other DNA
ccgactctgatcagagtcgggc

SEQ ID NO: 6972 - DNA, 22 bp, synthetic construct
  misc_feature 1..22: note = Description of Artificial Sequence: Syntheticoligonucleotide
  source 1..22: mol_type = other DNA
ccgactctgatcagagtcgggt

SEQ ID NO: 6973 - DNA, 22 bp, synthetic construct
  misc_feature 1..22: note = Description of Artificial Sequence: Syntheticoligonucleotide
  source 1..22: mol_type = other DNA
ccgactctgatcagagtcggtc

SEQ ID NO: 6974 - DNA, 22 bp, synthetic construct
  misc_feature 1..22: note = Description of Artificial Sequence: Syntheticoligonucleotide
  source 1..22: mol_type = other DNA
acgactctgatcagagtcgtgc

SEQ ID NO: 6975 - DNA, 22 bp, synthetic construct
  misc_feature 1..22: note = Description of Artificial Sequence: Syntheticoligonucleotide
  source 1..22: mol_type = other DNA
cagactctgatcagagtctggc

SEQ ID NO: 6976 - DNA, 22 bp, synthetic construct
  misc_feature 1..22: note = Description of Artificial Sequence: Syntheticoligonucleotide
  source 1..22: mol_type = other DNA
ccgactctgatcagagtcggga

SEQ ID NO: 6977 - DNA, 22 bp, synthetic construct
  misc_feature 1..22: note = Description of Artificial Sequence: Syntheticoligonucleotide
  source 1..22: mol_type = other DNA
ccgactctgatcagagtcggac

SEQ ID NO: 6978 - DNA, 22 bp, synthetic construct
  misc_feature 1..22: note = Description of Artificial Sequence: Syntheticoligonucleotide
  source 1..22: mol_type = other DNA
ctgactctgatcagagtcaggc

SEQ ID NO: 6979 - DNA, 22 bp, synthetic construct
  misc_feature 1..22: note = Description of Artificial Sequence: Syntheticoligonucleotide
  source 1..22: mol_type = other DNA
gcgactctgatcagagtcgccc

SEQ ID NO: 6980 - DNA, 22 bp, synthetic construct
  misc_feature 1..22: note = Description of Artificial Sequence: Syntheticoligonucleotide
  source 1..22: mol_type = other DNA
gcgactctgatcagagtcgcct

SEQ ID NO: 6981 - DNA, 22 bp, synthetic construct
  misc_feature 1..22: note = Description of Artificial Sequence: Syntheticoligonucleotide
  source 1..22: mol_type = other DNA
gcgactctgatcagagtcgctc

SEQ ID NO: 6982 - DNA, 22 bp, synthetic construct
  misc_feature 1..22: note = Description of Artificial Sequence: Syntheticoligonucleotide
  source 1..22: mol_type = other DNA
acgactctgatcagagtcgtcc

SEQ ID NO: 6983 - DNA, 22 bp, synthetic construct
  misc_feature 1..22: note = Description of Artificial Sequence: Syntheticoligonucleotide
  source 1..22: mol_type = other DNA
gagactctgatcagagtctccc

SEQ ID NO: 6984 - DNA, 22 bp, synthetic construct
  misc_feature 1..22: note = Description of Artificial Sequence: Syntheticoligonucleotide
  source 1..22: mol_type = other DNA
gcgactctgatcagagtcgcca

SEQ ID NO: 6985 - DNA, 22 bp, synthetic construct
  misc_feature 1..22: note = Description of Artificial Sequence: Syntheticoligonucleotide
  source 1..22: mol_type = other DNA
gcgactctgatcagagtcgcac

SEQ ID NO: 6986 - DNA, 22 bp, synthetic construct
  misc_feature 1..22: note = Description of Artificial Sequence: Syntheticoligonucleotide
  source 1..22: mol_type = other DNA
gtgactctgatcagagtcaccc

SEQ ID NO: 6987 - DNA, 22 bp, synthetic construct
  misc_feature 1..22: note = Description of Artificial Sequence: Syntheticoligonucleotide
  source 1..22: mol_type = other DNA
gggactctgatcagagtcccgt

SEQ ID NO: 6988 - DNA, 22 bp, synthetic construct
  misc_feature 1..22: note = Description of Artificial Sequence: Syntheticoligonucleotide
  source 1..22: mol_type = other DNA
gggactctgatcagagtccctg

SEQ ID NO: 6989 - DNA, 22 bp, synthetic construct
  misc_feature 1..22: note = Description of Artificial Sequence: Syntheticoligonucleotide
  source 1..22: mol_type = other DNA
aggactctgatcagagtcctgg

SEQ ID NO: 6990 - DNA, 22 bp, synthetic construct
  misc_feature 1..22: note = Description of Artificial Sequence: Syntheticoligonucleotide
  source 1..22: mol_type = other DNA
gagactctgatcagagtctcgg

SEQ ID NO: 6991 - DNA, 22 bp, synthetic construct
  misc_feature 1..22: note = Description of Artificial Sequence: Syntheticoligonucleotide
  source 1..22: mol_type = other DNA
gggactctgatcagagtcccga

SEQ ID NO: 6992 - DNA, 22 bp, synthetic construct
  misc_feature 1..22: note = Description of Artificial Sequence: Syntheticoligonucleotide
  source 1..22: mol_type = other DNA
gggactctgatcagagtcccag

SEQ ID NO: 6993 - DNA, 22 bp, synthetic construct
  misc_feature 1..22: note = Description of Artificial Sequence: Syntheticoligonucleotide
  source 1..22: mol_type = other DNA
tggactctgatcagagtccagg

SEQ ID NO: 6994 - DNA, 22 bp, synthetic construct
  misc_feature 1..22: note = Description of Artificial Sequence: Syntheticoligonucleotide
  source 1..22: mol_type = other DNA
gtgactctgatcagagtcacgg

SEQ ID NO: 6995 - DNA, 22 bp, synthetic construct
  misc_feature 1..22: note = Description of Artificial Sequence: Syntheticoligonucleotide
  source 1..22: mol_type = other DNA
gcgactctgatcagagtcgccg

SEQ ID NO: 6996 - DNA, 22 bp, synthetic construct
  misc_feature 1..22: note = Description of Artificial Sequence: Syntheticoligonucleotide
  source 1..22: mol_type = other DNA
gcgactctgatcagagtcgctg

SEQ ID NO: 6997 - DNA, 22 bp, synthetic construct
  misc_feature 1..22: note = Description of Artificial Sequence: Syntheticoligonucleotide
  source 1..22: mol_type = other DNA
acgactctgatcagagtcgtcg

SEQ ID NO: 6998 - DNA, 22 bp, synthetic construct
  misc_feature 1..22: note = Description of Artificial Sequence: Syntheticoligonucleotide
  source 1..22: mol_type = other DNA
gagactctgatcagagtctccg

SEQ ID NO: 6999 - DNA, 22 bp, synthetic construct
  misc_feature 1..22: note = Description of Artificial Sequence: Syntheticoligonucleotide
  source 1..22: mol_type = other DNA
gcgactctgatcagagtcgcag

SEQ ID NO: 7000 - DNA, 22 bp, synthetic construct
  misc_feature 1..22: note = Description of Artificial Sequence: Syntheticoligonucleotide
  source 1..22: mol_type = other DNA
gtgactctgatcagagtcaccg

SEQ ID NO: 7001 - DNA, 22 bp, synthetic construct
  misc_feature 1..22: note = Description of Artificial Sequence: Syntheticoligonucleotide
  source 1..22: mol_type = other DNA
cggactctgatcagagtccgtg

SEQ ID NO: 7002 - DNA, 22 bp, synthetic construct
  misc_feature 1..22: note = Description of Artificial Sequence: Syntheticoligonucleotide
  source 1..22: mol_type = other DNA
cagactctgatcagagtctggg

SEQ ID NO: 7003 - DNA, 22 bp, synthetic construct
  misc_feature 1..22: note = Description of Artificial Sequence: Syntheticoligonucleotide
  source 1..22: mol_type = other DNA
cggactctgatcagagtccgag

SEQ ID NO: 7004 - DNA, 22 bp, synthetic construct
  misc_feature 1..22: note = Description of Artificial Sequence: Syntheticoligonucleotide
  source 1..22: mol_type = other DNA
ctgactctgatcagagtcaggg

SEQ ID NO: 7005 - DNA, 22 bp, synthetic construct
  misc_feature 1..22: note = Description of Artificial Sequence: Syntheticoligonucleotide
  source 1..22: mol_type = other DNA
acgactctgatcagagtcgtgg

SEQ ID NO: 7006 - DNA, 22 bp, synthetic construct
  misc_feature 1..22: note = Description of Artificial Sequence: Syntheticoligonucleotide
  source 1..22: mol_type = other DNA
ccgactctgatcagagtcggct

SEQ ID NO: 7007 - DNA, 22 bp, synthetic construct
  misc_feature 1..22: note = Description of Artificial Sequence: Syntheticoligonucleotide
  source 1..22: mol_type = other DNA
ccgactctgatcagagtcggca

SEQ ID NO: 7008 - DNA, 22 bp, synthetic construct
  misc_feature 1..22: note = Description of Artificial Sequence: Syntheticoligonucleotide
  source 1..22: mol_type = other DNA
gagactctgatcagagtctcgc

SEQ ID NO: 7009 - DNA, 22 bp, synthetic construct
  misc_feature 1..22: note = Description of Artificial Sequence: Syntheticoligonucleotide
  source 1..22: mol_type = other DNA
gtgactctgatcagagtcacgc

SEQ ID NO: 7010 - DNA, 22 bp, synthetic construct
  misc_feature 1..22: note = Description of Artificial Sequence: Syntheticoligonucleotide
  source 1..22: mol_type = other DNA
aggactctgatcagagtcctgc

SEQ ID NO: 7011 - DNA, 22 bp, synthetic construct
  misc_feature 1..22: note = Description of Artificial Sequence: Syntheticoligonucleotide
  source 1..22: mol_type = other DNA
tggactctgatcagagtccagc

SEQ ID NO: 7012 - DNA, 22 bp, synthetic construct
  misc_feature 1..22: note = Description of Artificial Sequence: Syntheticoligonucleotide
  source 1..22: mol_type = other DNA
aggactctgatcagagtcctcg

SEQ ID NO: 7013 - DNA, 22 bp, synthetic construct
  misc_feature 1..22: note = Description of Artificial Sequence: Syntheticoligonucleotide
  source 1..22: mol_type = other DNA
tggactctgatcagagtccacg

SEQ ID NO: 7014 - DNA, 22 bp, synthetic construct
  misc_feature 1..22: note = Description of Artificial Sequence: Syntheticoligonucleotide
  source 1..22: mol_type = other DNA
ccgactctgatcagagtcggtg

SEQ ID NO: 7015 - DNA, 22 bp, synthetic construct
  misc_feature 1..22: note = Description of Artificial Sequence: Syntheticoligonucleotide
  source 1..22: mol_type = other DNA
ccgactctgatcagagtcggag

SEQ ID NO: 7016 - DNA, 22 bp, synthetic construct
  misc_feature 1..22: note = Description of Artificial Sequence: Syntheticoligonucleotide
  source 1..22: mol_type = other DNA
gggactctgatcagagtcccgc

SEQ ID NO: 7017 - DNA, 22 bp, synthetic construct
  misc_feature 1..22: note = Description of Artificial Sequence: Syntheticoligonucleotide
  source 1..22: mol_type = other DNA
gggactctgatcagagtccctc

SEQ ID NO: 7018 - DNA, 22 bp, synthetic construct
  misc_feature 1..22: note = Description of Artificial Sequence: Syntheticoligonucleotide
  source 1..22: mol_type = other DNA
gggactctgatcagagtcccac

SEQ ID NO: 7019 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactctgtacagagtcnnnn

SEQ ID NO: 7020 - DNA, 22 bp, synthetic construct
  misc_feature 1..22: note = Description of Artificial Sequence: Syntheticoligonucleotide
  source 1..22: mol_type = other DNA
cggactctgtacagagtccgcc

SEQ ID NO: 7021 - DNA, 22 bp, synthetic construct
  misc_feature 1..22: note = Description of Artificial Sequence: Syntheticoligonucleotide
  source 1..22: mol_type = other DNA
cggactctgtacagagtccgct

SEQ ID NO: 7022 - DNA, 22 bp, synthetic construct
  misc_feature 1..22: note = Description of Artificial Sequence: Syntheticoligonucleotide
  source 1..22: mol_type = other DNA
cggactctgtacagagtccgtc

SEQ ID NO: 7023 - DNA, 22 bp, synthetic construct
  misc_feature 1..22: note = Description of Artificial Sequence: Syntheticoligonucleotide
  source 1..22: mol_type = other DNA
aggactctgtacagagtcctcc

SEQ ID NO: 7024 - DNA, 22 bp, synthetic construct
  misc_feature 1..22: note = Description of Artificial Sequence: Syntheticoligonucleotide
  source 1..22: mol_type = other DNA
cagactctgtacagagtctgcc

SEQ ID NO: 7025 - DNA, 22 bp, synthetic construct
  misc_feature 1..22: note = Description of Artificial Sequence: Syntheticoligonucleotide
  source 1..22: mol_type = other DNA
cggactctgtacagagtccgca

SEQ ID NO: 7026 - DNA, 22 bp, synthetic construct
  misc_feature 1..22: note = Description of Artificial Sequence: Syntheticoligonucleotide
  source 1..22: mol_type = other DNA
cggactctgtacagagtccgac

SEQ ID NO: 7027 - DNA, 22 bp, synthetic construct
  misc_feature 1..22: note = Description of Artificial Sequence: Syntheticoligonucleotide
  source 1..22: mol_type = other DNA
tggactctgtacagagtccacc

SEQ ID NO: 7028 - DNA, 22 bp, synthetic construct
  misc_feature 1..22: note = Description of Artificial Sequence: Syntheticoligonucleotide
  source 1..22: mol_type = other DNA
ctgactctgtacagagtcagcc

SEQ ID NO: 7029 - DNA, 22 bp, synthetic construct
  misc_feature 1..22: note = Description of Artificial Sequence: Syntheticoligonucleotide
  source 1..22: mol_type = other DNA
ccgactctgtacagagtcgggc

SEQ ID NO: 7030 - DNA, 22 bp, synthetic construct
  misc_feature 1..22: note = Description of Artificial Sequence: Syntheticoligonucleotide
  source 1..22: mol_type = other DNA
ccgactctgtacagagtcgggt

SEQ ID NO: 7031 - DNA, 22 bp, synthetic construct
  misc_feature 1..22: note = Description of Artificial Sequence: Syntheticoligonucleotide
  source 1..22: mol_type = other DNA
ccgactctgtacagagtcggtc

SEQ ID NO: 7032 - DNA, 22 bp, synthetic construct
  misc_feature 1..22: note = Description of Artificial Sequence: Syntheticoligonucleotide
  source 1..22: mol_type = other DNA
acgactctgtacagagtcgtgc

SEQ ID NO: 7033 - DNA, 22 bp, synthetic construct
  misc_feature 1..22: note = Description of Artificial Sequence: Syntheticoligonucleotide
  source 1..22: mol_type = other DNA
cagactctgtacagagtctggc

SEQ ID NO: 7034 - DNA, 22 bp, synthetic construct
  misc_feature 1..22: note = Description of Artificial Sequence: Syntheticoligonucleotide
  source 1..22: mol_type = other DNA
ccgactctgtacagagtcggga

SEQ ID NO: 7035 - DNA, 22 bp, synthetic construct
  misc_feature 1..22: note = Description of Artificial Sequence: Syntheticoligonucleotide
  source 1..22: mol_type = other DNA
ccgactctgtacagagtcggac

SEQ ID NO: 7036 - DNA, 22 bp, synthetic construct
  misc_feature 1..22: note = Description of Artificial Sequence: Syntheticoligonucleotide
  source 1..22: mol_type = other DNA
ctgactctgtacagagtcaggc

SEQ ID NO: 7037 - DNA, 22 bp, synthetic construct
  misc_feature 1..22: note = Description of Artificial Sequence: Syntheticoligonucleotide
  source 1..22: mol_type = other DNA
gcgactctgtacagagtcgccc

SEQ ID NO: 7038 - DNA, 22 bp, synthetic construct
  misc_feature 1..22: note = Description of Artificial Sequence: Syntheticoligonucleotide
  source 1..22: mol_type = other DNA
gcgactctgtacagagtcgcct

SEQ ID NO: 7039 - DNA, 22 bp, synthetic construct
  misc_feature 1..22: note = Description of Artificial Sequence: Syntheticoligonucleotide
  source 1..22: mol_type = other DNA
gcgactctgtacagagtcgctc

SEQ ID NO: 7040 - DNA, 22 bp, synthetic construct
  misc_feature 1..22: note = Description of Artificial Sequence: Syntheticoligonucleotide
  source 1..22: mol_type = other DNA
acgactctgtacagagtcgtcc

SEQ ID NO: 7041 - DNA, 22 bp, synthetic construct
  misc_feature 1..22: note = Description of Artificial Sequence: Syntheticoligonucleotide
  source 1..22: mol_type = other DNA
gagactctgtacagagtctccc

SEQ ID NO: 7042 - DNA, 22 bp, synthetic construct
  misc_feature 1..22: note = Description of Artificial Sequence: Syntheticoligonucleotide
  source 1..22: mol_type = other DNA
gcgactctgtacagagtcgcca

SEQ ID NO: 7043 - DNA, 22 bp, synthetic construct
  misc_feature 1..22: note = Description of Artificial Sequence: Syntheticoligonucleotide
  source 1..22: mol_type = other DNA
gcgactctgtacagagtcgcac

SEQ ID NO: 7044 - DNA, 22 bp, synthetic construct
  misc_feature 1..22: note = Description of Artificial Sequence: Syntheticoligonucleotide
  source 1..22: mol_type = other DNA
gtgactctgtacagagtcaccc

SEQ ID NO: 7045 - DNA, 22 bp, synthetic construct
  misc_feature 1..22: note = Description of Artificial Sequence: Syntheticoligonucleotide
  source 1..22: mol_type = other DNA
gggactctgtacagagtcccgt

SEQ ID NO: 7046 - DNA, 22 bp, synthetic construct
  misc_feature 1..22: note = Description of Artificial Sequence: Syntheticoligonucleotide
  source 1..22: mol_type = other DNA
gggactctgtacagagtccctg

SEQ ID NO: 7047 - DNA, 22 bp, synthetic construct
  misc_feature 1..22: note = Description of Artificial Sequence: Syntheticoligonucleotide
  source 1..22: mol_type = other DNA
aggactctgtacagagtcctgg

SEQ ID NO: 7048 - DNA, 22 bp, synthetic construct
  misc_feature 1..22: note = Description of Artificial Sequence: Syntheticoligonucleotide
  source 1..22: mol_type = other DNA
gagactctgtacagagtctcgg

SEQ ID NO: 7049 - DNA, 22 bp, synthetic construct
  misc_feature 1..22: note = Description of Artificial Sequence: Syntheticoligonucleotide
  source 1..22: mol_type = other DNA
gggactctgtacagagtcccga

SEQ ID NO: 7050 - DNA, 22 bp, synthetic construct
  misc_feature 1..22: note = Description of Artificial Sequence: Syntheticoligonucleotide
  source 1..22: mol_type = other DNA
gggactctgtacagagtcccag

SEQ ID NO: 7051 - DNA, 22 bp, synthetic construct
  misc_feature 1..22: note = Description of Artificial Sequence: Syntheticoligonucleotide
  source 1..22: mol_type = other DNA
tggactctgtacagagtccagg

SEQ ID NO: 7052 - DNA, 22 bp, synthetic construct
  misc_feature 1..22: note = Description of Artificial Sequence: Syntheticoligonucleotide
  source 1..22: mol_type = other DNA
gtgactctgtacagagtcacgg

SEQ ID NO: 7053 - DNA, 22 bp, synthetic construct
  misc_feature 1..22: note = Description of Artificial Sequence: Syntheticoligonucleotide
  source 1..22: mol_type = other DNA
gcgactctgtacagagtcgccg

SEQ ID NO: 7054 - DNA, 22 bp, synthetic construct
  misc_feature 1..22: note = Description of Artificial Sequence: Syntheticoligonucleotide
  source 1..22: mol_type = other DNA
gcgactctgtacagagtcgctg

SEQ ID NO: 7055 - DNA, 22 bp, synthetic construct
  misc_feature 1..22: note = Description of Artificial Sequence: Syntheticoligonucleotide
  source 1..22: mol_type = other DNA
acgactctgtacagagtcgtcg

SEQ ID NO: 7056 - DNA, 22 bp, synthetic construct
  misc_feature 1..22: note = Description of Artificial Sequence: Syntheticoligonucleotide
  source 1..22: mol_type = other DNA
gagactctgtacagagtctccg

SEQ ID NO: 7057 - DNA, 22 bp, synthetic construct
  misc_feature 1..22: note = Description of Artificial Sequence: Syntheticoligonucleotide
  source 1..22: mol_type = other DNA
gcgactctgtacagagtcgcag

SEQ ID NO: 7058 - DNA, 22 bp, synthetic construct
  misc_feature 1..22: note = Description of Artificial Sequence: Syntheticoligonucleotide
  source 1..22: mol_type = other DNA
gtgactctgtacagagtcaccg

SEQ ID NO: 7059 - DNA, 22 bp, synthetic construct
  misc_feature 1..22: note = Description of Artificial Sequence: Syntheticoligonucleotide
  source 1..22: mol_type = other DNA
cggactctgtacagagtccgtg

SEQ ID NO: 7060 - DNA, 22 bp, synthetic construct
  misc_feature 1..22: note = Description of Artificial Sequence: Syntheticoligonucleotide
  source 1..22: mol_type = other DNA
cagactctgtacagagtctggg

SEQ ID NO: 7061 - DNA, 22 bp, synthetic construct
  misc_feature 1..22: note = Description of Artificial Sequence: Syntheticoligonucleotide
  source 1..22: mol_type = other DNA
cggactctgtacagagtccgag

SEQ ID NO: 7062 - DNA, 22 bp, synthetic construct
  misc_feature 1..22: note = Description of Artificial Sequence: Syntheticoligonucleotide
  source 1..22: mol_type = other DNA
ctgactctgtacagagtcaggg

SEQ ID NO: 7063 - DNA, 22 bp, synthetic construct
  misc_feature 1..22: note = Description of Artificial Sequence: Syntheticoligonucleotide
  source 1..22: mol_type = other DNA
acgactctgtacagagtcgtgg

SEQ ID NO: 7064 - DNA, 22 bp, synthetic construct
  misc_feature 1..22: note = Description of Artificial Sequence: Syntheticoligonucleotide
  source 1..22: mol_type = other DNA
ccgactctgtacagagtcggct

SEQ ID NO: 7065 - DNA, 22 bp, synthetic construct
  misc_feature 1..22: note = Description of Artificial Sequence: Syntheticoligonucleotide
  source 1..22: mol_type = other DNA
ccgactctgtacagagtcggca

SEQ ID NO: 7066 - DNA, 22 bp, synthetic construct
  misc_feature 1..22: note = Description of Artificial Sequence: Syntheticoligonucleotide
  source 1..22: mol_type = other DNA
gagactctgtacagagtctcgc

SEQ ID NO: 7067 - DNA, 22 bp, synthetic construct
  misc_feature 1..22: note = Description of Artificial Sequence: Syntheticoligonucleotide
  source 1..22: mol_type = other DNA
gtgactctgtacagagtcacgc

SEQ ID NO: 7068 - DNA, 22 bp, synthetic construct
  misc_feature 1..22: note = Description of Artificial Sequence: Syntheticoligonucleotide
  source 1..22: mol_type = other DNA
aggactctgtacagagtcctgc

SEQ ID NO: 7069 - DNA, 22 bp, synthetic construct
  misc_feature 1..22: note = Description of Artificial Sequence: Syntheticoligonucleotide
  source 1..22: mol_type = other DNA
tggactctgtacagagtccagc

SEQ ID NO: 7070 - DNA, 22 bp, synthetic construct
  misc_feature 1..22: note = Description of Artificial Sequence: Syntheticoligonucleotide
  source 1..22: mol_type = other DNA
aggactctgtacagagtcctcg

SEQ ID NO: 7071 - DNA, 22 bp, synthetic construct
  misc_feature 1..22: note = Description of Artificial Sequence: Syntheticoligonucleotide
  source 1..22: mol_type = other DNA
tggactctgtacagagtccacg

SEQ ID NO: 7072 - DNA, 22 bp, synthetic construct
  misc_feature 1..22: note = Description of Artificial Sequence: Syntheticoligonucleotide
  source 1..22: mol_type = other DNA
ccgactctgtacagagtcggtg

SEQ ID NO: 7073 - DNA, 22 bp, synthetic construct
  misc_feature 1..22: note = Description of Artificial Sequence: Syntheticoligonucleotide
  source 1..22: mol_type = other DNA
ccgactctgtacagagtcggag

SEQ ID NO: 7074 - DNA, 22 bp, synthetic construct
  misc_feature 1..22: note = Description of Artificial Sequence: Syntheticoligonucleotide
  source 1..22: mol_type = other DNA
gggactctgtacagagtcccgc

SEQ ID NO: 7075 - DNA, 22 bp, synthetic construct
  misc_feature 1..22: note = Description of Artificial Sequence: Syntheticoligonucleotide
  source 1..22: mol_type = other DNA
gggactctgtacagagtccctc

SEQ ID NO: 7076 - DNA, 22 bp, synthetic construct
  misc_feature 1..22: note = Description of Artificial Sequence: Syntheticoligonucleotide
  source 1..22: mol_type = other DNA
gggactctgtacagagtcccac

SEQ ID NO: 7077 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactctggccagagtcnnnn

SEQ ID NO: 7078 - DNA, 22 bp, synthetic construct
  misc_feature 1..22: note = Description of Artificial Sequence: Syntheticoligonucleotide
  source 1..22: mol_type = other DNA
cggactctggccagagtccgcc

SEQ ID NO: 7079 - DNA, 22 bp, synthetic construct
  misc_feature 1..22: note = Description of Artificial Sequence: Syntheticoligonucleotide
  source 1..22: mol_type = other DNA
cggactctggccagagtccgct

SEQ ID NO: 7080 - DNA, 22 bp, synthetic construct
  misc_feature 1..22: note = Description of Artificial Sequence: Syntheticoligonucleotide
  source 1..22: mol_type = other DNA
cggactctggccagagtccgtc

SEQ ID NO: 7081 - DNA, 22 bp, synthetic construct
  misc_feature 1..22: note = Description of Artificial Sequence: Syntheticoligonucleotide
  source 1..22: mol_type = other DNA
aggactctggccagagtcctcc

SEQ ID NO: 7082 - DNA, 22 bp, synthetic construct
  misc_feature 1..22: note = Description of Artificial Sequence: Syntheticoligonucleotide
  source 1..22: mol_type = other DNA
cagactctggccagagtctgcc

SEQ ID NO: 7083 - DNA, 22 bp, synthetic construct
  misc_feature 1..22: note = Description of Artificial Sequence: Syntheticoligonucleotide
  source 1..22: mol_type = other DNA
cggactctggccagagtccgca

SEQ ID NO: 7084 - DNA, 22 bp, synthetic construct
  misc_feature 1..22: note = Description of Artificial Sequence: Syntheticoligonucleotide
  source 1..22: mol_type = other DNA
cggactctggccagagtccgac

SEQ ID NO: 7085 - DNA, 22 bp, synthetic construct
  misc_feature 1..22: note = Description of Artificial Sequence: Syntheticoligonucleotide
  source 1..22: mol_type = other DNA
tggactctggccagagtccacc

SEQ ID NO: 7086 - DNA, 22 bp, synthetic construct
  misc_feature 1..22: note = Description of Artificial Sequence: Syntheticoligonucleotide
  source 1..22: mol_type = other DNA
ctgactctggccagagtcagcc

SEQ ID NO: 7087 - DNA, 22 bp, synthetic construct
  misc_feature 1..22: note = Description of Artificial Sequence: Syntheticoligonucleotide
  source 1..22: mol_type = other DNA
ccgactctggccagagtcgggc

SEQ ID NO: 7088 - DNA, 22 bp, synthetic construct
  misc_feature 1..22: note = Description of Artificial Sequence: Syntheticoligonucleotide
  source 1..22: mol_type = other DNA
ccgactctggccagagtcgggt

SEQ ID NO: 7089 - DNA, 22 bp, synthetic construct
  misc_feature 1..22: note = Description of Artificial Sequence: Syntheticoligonucleotide
  source 1..22: mol_type = other DNA
ccgactctggccagagtcggtc

SEQ ID NO: 7090 - DNA, 22 bp, synthetic construct
  misc_feature 1..22: note = Description of Artificial Sequence: Syntheticoligonucleotide
  source 1..22: mol_type = other DNA
acgactctggccagagtcgtgc

SEQ ID NO: 7091 - DNA, 22 bp, synthetic construct
  misc_feature 1..22: note = Description of Artificial Sequence: Syntheticoligonucleotide
  source 1..22: mol_type = other DNA
cagactctggccagagtctggc

SEQ ID NO: 7092 - DNA, 22 bp, synthetic construct
  misc_feature 1..22: note = Description of Artificial Sequence: Syntheticoligonucleotide
  source 1..22: mol_type = other DNA
ccgactctggccagagtcggga

SEQ ID NO: 7093 - DNA, 22 bp, synthetic construct
  misc_feature 1..22: note = Description of Artificial Sequence: Syntheticoligonucleotide
  source 1..22: mol_type = other DNA
ccgactctggccagagtcggac

SEQ ID NO: 7094 - DNA, 22 bp, synthetic construct
  misc_feature 1..22: note = Description of Artificial Sequence: Syntheticoligonucleotide
  source 1..22: mol_type = other DNA
ctgactctggccagagtcaggc

SEQ ID NO: 7095 - DNA, 22 bp, synthetic construct
  misc_feature 1..22: note = Description of Artificial Sequence: Syntheticoligonucleotide
  source 1..22: mol_type = other DNA
gcgactctggccagagtcgccc

SEQ ID NO: 7096 - DNA, 22 bp, synthetic construct
  misc_feature 1..22: note = Description of Artificial Sequence: Syntheticoligonucleotide
  source 1..22: mol_type = other DNA
gcgactctggccagagtcgcct

SEQ ID NO: 7097 - DNA, 22 bp, synthetic construct
  misc_feature 1..22: note = Description of Artificial Sequence: Syntheticoligonucleotide
  source 1..22: mol_type = other DNA
gcgactctggccagagtcgctc

SEQ ID NO: 7098 - DNA, 22 bp, synthetic construct
  misc_feature 1..22: note = Description of Artificial Sequence: Syntheticoligonucleotide
  source 1..22: mol_type = other DNA
acgactctggccagagtcgtcc

SEQ ID NO: 7099 - DNA, 22 bp, synthetic construct
  misc_feature 1..22: note = Description of Artificial Sequence: Syntheticoligonucleotide
  source 1..22: mol_type = other DNA
gagactctggccagagtctccc

SEQ ID NO: 7100 - DNA, 22 bp, synthetic construct
  misc_feature 1..22: note = Description of Artificial Sequence: Syntheticoligonucleotide
  source 1..22: mol_type = other DNA
gcgactctggccagagtcgcca

SEQ ID NO: 7101 - DNA, 22 bp, synthetic construct
  misc_feature 1..22: note = Description of Artificial Sequence: Syntheticoligonucleotide
  source 1..22: mol_type = other DNA
gcgactctggccagagtcgcac

SEQ ID NO: 7102 - DNA, 22 bp, synthetic construct
  misc_feature 1..22: note = Description of Artificial Sequence: Syntheticoligonucleotide
  source 1..22: mol_type = other DNA
gtgactctggccagagtcaccc

SEQ ID NO: 7103 - DNA, 22 bp, synthetic construct
  misc_feature 1..22: note = Description of Artificial Sequence: Syntheticoligonucleotide
  source 1..22: mol_type = other DNA
gggactctggccagagtcccgt

SEQ ID NO: 7104 - DNA, 22 bp, synthetic construct
  misc_feature 1..22: note = Description of Artificial Sequence: Syntheticoligonucleotide
  source 1..22: mol_type = other DNA
gggactctggccagagtccctg

SEQ ID NO: 7105 - DNA, 22 bp, synthetic construct
  misc_feature 1..22: note = Description of Artificial Sequence: Syntheticoligonucleotide
  source 1..22: mol_type = other DNA
aggactctggccagagtcctgg

SEQ ID NO: 7106 - DNA, 22 bp, synthetic construct
  misc_feature 1..22: note = Description of Artificial Sequence: Syntheticoligonucleotide
  source 1..22: mol_type = other DNA
gagactctggccagagtctcgg

SEQ ID NO: 7107 - DNA, 22 bp, synthetic construct
  misc_feature 1..22: note = Description of Artificial Sequence: Syntheticoligonucleotide
  source 1..22: mol_type = other DNA
gggactctggccagagtcccga

SEQ ID NO: 7108 - DNA, 22 bp, synthetic construct
  misc_feature 1..22: note = Description of Artificial Sequence: Syntheticoligonucleotide
  source 1..22: mol_type = other DNA
gggactctggccagagtcccag

SEQ ID NO: 7109 - DNA, 22 bp, synthetic construct
  misc_feature 1..22: note = Description of Artificial Sequence: Syntheticoligonucleotide
  source 1..22: mol_type = other DNA
tggactctggccagagtccagg

SEQ ID NO: 7110 - DNA, 22 bp, synthetic construct
  misc_feature 1..22: note = Description of Artificial Sequence: Syntheticoligonucleotide
  source 1..22: mol_type = other DNA
gtgactctggccagagtcacgg

SEQ ID NO: 7111 - DNA, 22 bp, synthetic construct
  misc_feature 1..22: note = Description of Artificial Sequence: Syntheticoligonucleotide
  source 1..22: mol_type = other DNA
gcgactctggccagagtcgccg

SEQ ID NO: 7112 - DNA, 22 bp, synthetic construct
  misc_feature 1..22: note = Description of Artificial Sequence: Syntheticoligonucleotide
  source 1..22: mol_type = other DNA
gcgactctggccagagtcgctg

SEQ ID NO: 7113 - DNA, 22 bp, synthetic construct
  misc_feature 1..22: note = Description of Artificial Sequence: Syntheticoligonucleotide
  source 1..22: mol_type = other DNA
acgactctggccagagtcgtcg

SEQ ID NO: 7114 - DNA, 22 bp, synthetic construct
  misc_feature 1..22: note = Description of Artificial Sequence: Syntheticoligonucleotide
  source 1..22: mol_type = other DNA
gagactctggccagagtctccg

SEQ ID NO: 7115 - DNA, 22 bp, synthetic construct
  misc_feature 1..22: note = Description of Artificial Sequence: Syntheticoligonucleotide
  source 1..22: mol_type = other DNA
gcgactctggccagagtcgcag

SEQ ID NO: 7116 - DNA, 22 bp, synthetic construct
  misc_feature 1..22: note = Description of Artificial Sequence: Syntheticoligonucleotide
  source 1..22: mol_type = other DNA
gtgactctggccagagtcaccg

SEQ ID NO: 7117 - DNA, 22 bp, synthetic construct
  misc_feature 1..22: note = Description of Artificial Sequence: Syntheticoligonucleotide
  source 1..22: mol_type = other DNA
cggactctggccagagtccgtg

SEQ ID NO: 7118 - DNA, 22 bp, synthetic construct
  misc_feature 1..22: note = Description of Artificial Sequence: Syntheticoligonucleotide
  source 1..22: mol_type = other DNA
cagactctggccagagtctggg

SEQ ID NO: 7119 - DNA, 22 bp, synthetic construct
  misc_feature 1..22: note = Description of Artificial Sequence: Syntheticoligonucleotide
  source 1..22: mol_type = other DNA
cggactctggccagagtccgag

SEQ ID NO: 7120 - DNA, 22 bp, synthetic construct
  misc_feature 1..22: note = Description of Artificial Sequence: Syntheticoligonucleotide
  source 1..22: mol_type = other DNA
ctgactctggccagagtcaggg

SEQ ID NO: 7121 - DNA, 22 bp, synthetic construct
  misc_feature 1..22: note = Description of Artificial Sequence: Syntheticoligonucleotide
  source 1..22: mol_type = other DNA
acgactctggccagagtcgtgg

SEQ ID NO: 7122 - DNA, 22 bp, synthetic construct
  misc_feature 1..22: note = Description of Artificial Sequence: Syntheticoligonucleotide
  source 1..22: mol_type = other DNA
ccgactctggccagagtcggct

SEQ ID NO: 7123 - DNA, 22 bp, synthetic construct
  misc_feature 1..22: note = Description of Artificial Sequence: Syntheticoligonucleotide
  source 1..22: mol_type = other DNA
ccgactctggccagagtcggca

SEQ ID NO: 7124 - DNA, 22 bp, synthetic construct
  misc_feature 1..22: note = Description of Artificial Sequence: Syntheticoligonucleotide
  source 1..22: mol_type = other DNA
gagactctggccagagtctcgc

SEQ ID NO: 7125 - DNA, 22 bp, synthetic construct
  misc_feature 1..22: note = Description of Artificial Sequence: Syntheticoligonucleotide
  source 1..22: mol_type = other DNA
gtgactctggccagagtcacgc

SEQ ID NO: 7126 - DNA, 22 bp, synthetic construct
  misc_feature 1..22: note = Description of Artificial Sequence: Syntheticoligonucleotide
  source 1..22: mol_type = other DNA
aggactctggccagagtcctgc

SEQ ID NO: 7127 - DNA, 22 bp, synthetic construct
  misc_feature 1..22: note = Description of Artificial Sequence: Syntheticoligonucleotide
  source 1..22: mol_type = other DNA
tggactctggccagagtccagc

SEQ ID NO: 7128 - DNA, 22 bp, synthetic construct
  misc_feature 1..22: note = Description of Artificial Sequence: Syntheticoligonucleotide
  source 1..22: mol_type = other DNA
aggactctggccagagtcctcg

SEQ ID NO: 7129 - DNA, 22 bp, synthetic construct
  misc_feature 1..22: note = Description of Artificial Sequence: Syntheticoligonucleotide
  source 1..22: mol_type = other DNA
tggactctggccagagtccacg

SEQ ID NO: 7130 - DNA, 22 bp, synthetic construct
  misc_feature 1..22: note = Description of Artificial Sequence: Syntheticoligonucleotide
  source 1..22: mol_type = other DNA
ccgactctggccagagtcggtg

SEQ ID NO: 7131 - DNA, 22 bp, synthetic construct
  misc_feature 1..22: note = Description of Artificial Sequence: Syntheticoligonucleotide
  source 1..22: mol_type = other DNA
ccgactctggccagagtcggag

SEQ ID NO: 7132 - DNA, 22 bp, synthetic construct
  misc_feature 1..22: note = Description of Artificial Sequence: Syntheticoligonucleotide
  source 1..22: mol_type = other DNA
gggactctggccagagtcccgc

SEQ ID NO: 7133 - DNA, 22 bp, synthetic construct
  misc_feature 1..22: note = Description of Artificial Sequence: Syntheticoligonucleotide
  source 1..22: mol_type = other DNA
gggactctggccagagtccctc

SEQ ID NO: 7134 - DNA, 22 bp, synthetic construct
  misc_feature 1..22: note = Description of Artificial Sequence: Syntheticoligonucleotide
  source 1..22: mol_type = other DNA
gggactctggccagagtcccac

SEQ ID NO: 7135 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactctgcgcagagtcnnnn

SEQ ID NO: 7136 - DNA, 22 bp, synthetic construct
  misc_feature 1..22: note = Description of Artificial Sequence: Syntheticoligonucleotide
  source 1..22: mol_type = other DNA
cggactctgcgcagagtccgcc

SEQ ID NO: 7137 - DNA, 22 bp, synthetic construct
  misc_feature 1..22: note = Description of Artificial Sequence: Syntheticoligonucleotide
  source 1..22: mol_type = other DNA
cggactctgcgcagagtccgct

SEQ ID NO: 7138 - DNA, 22 bp, synthetic construct
  misc_feature 1..22: note = Description of Artificial Sequence: Syntheticoligonucleotide
  source 1..22: mol_type = other DNA
cggactctgcgcagagtccgtc

SEQ ID NO: 7139 - DNA, 22 bp, synthetic construct
  misc_feature 1..22: note = Description of Artificial Sequence: Syntheticoligonucleotide
  source 1..22: mol_type = other DNA
aggactctgcgcagagtcctcc

SEQ ID NO: 7140 - DNA, 22 bp, synthetic construct
  misc_feature 1..22: note = Description of Artificial Sequence: Syntheticoligonucleotide
  source 1..22: mol_type = other DNA
cagactctgcgcagagtctgcc

SEQ ID NO: 7141 - DNA, 22 bp, synthetic construct
  misc_feature 1..22: note = Description of Artificial Sequence: Syntheticoligonucleotide
  source 1..22: mol_type = other DNA
cggactctgcgcagagtccgca

SEQ ID NO: 7142 - DNA, 22 bp, synthetic construct
  misc_feature 1..22: note = Description of Artificial Sequence: Syntheticoligonucleotide
  source 1..22: mol_type = other DNA
cggactctgcgcagagtccgac

SEQ ID NO: 7143 - DNA, 22 bp, synthetic construct
  misc_feature 1..22: note = Description of Artificial Sequence: Syntheticoligonucleotide
  source 1..22: mol_type = other DNA
tggactctgcgcagagtccacc

SEQ ID NO: 7144 - DNA, 22 bp, synthetic construct
  misc_feature 1..22: note = Description of Artificial Sequence: Syntheticoligonucleotide
  source 1..22: mol_type = other DNA
ctgactctgcgcagagtcagcc

SEQ ID NO: 7145 - DNA, 22 bp, synthetic construct
  misc_feature 1..22: note = Description of Artificial Sequence: Syntheticoligonucleotide
  source 1..22: mol_type = other DNA
ccgactctgcgcagagtcgggc

SEQ ID NO: 7146 - DNA, 22 bp, synthetic construct
  misc_feature 1..22: note = Description of Artificial Sequence: Syntheticoligonucleotide
  source 1..22: mol_type = other DNA
ccgactctgcgcagagtcgggt

SEQ ID NO: 7147 - DNA, 22 bp, synthetic construct
  misc_feature 1..22: note = Description of Artificial Sequence: Syntheticoligonucleotide
  source 1..22: mol_type = other DNA
ccgactctgcgcagagtcggtc

SEQ ID NO: 7148 - DNA, 22 bp, synthetic construct
  misc_feature 1..22: note = Description of Artificial Sequence: Syntheticoligonucleotide
  source 1..22: mol_type = other DNA
acgactctgcgcagagtcgtgc

SEQ ID NO: 7149 - DNA, 22 bp, synthetic construct
  misc_feature 1..22: note = Description of Artificial Sequence: Syntheticoligonucleotide
  source 1..22: mol_type = other DNA
cagactctgcgcagagtctggc

SEQ ID NO: 7150 - DNA, 22 bp, synthetic construct
  misc_feature 1..22: note = Description of Artificial Sequence: Syntheticoligonucleotide
  source 1..22: mol_type = other DNA
ccgactctgcgcagagtcggga

SEQ ID NO: 7151 - DNA, 22 bp, synthetic construct
  misc_feature 1..22: note = Description of Artificial Sequence: Syntheticoligonucleotide
  source 1..22: mol_type = other DNA
ccgactctgcgcagagtcggac

SEQ ID NO: 7152 - DNA, 22 bp, synthetic construct
  misc_feature 1..22: note = Description of Artificial Sequence: Syntheticoligonucleotide
  source 1..22: mol_type = other DNA
ctgactctgcgcagagtcaggc

SEQ ID NO: 7153 - DNA, 22 bp, synthetic construct
  misc_feature 1..22: note = Description of Artificial Sequence: Syntheticoligonucleotide
  source 1..22: mol_type = other DNA
gcgactctgcgcagagtcgccc

SEQ ID NO: 7154 - DNA, 22 bp, synthetic construct
  misc_feature 1..22: note = Description of Artificial Sequence: Syntheticoligonucleotide
  source 1..22: mol_type = other DNA
gcgactctgcgcagagtcgcct

SEQ ID NO: 7155 - DNA, 22 bp, synthetic construct
  misc_feature 1..22: note = Description of Artificial Sequence: Syntheticoligonucleotide
  source 1..22: mol_type = other DNA
gcgactctgcgcagagtcgctc

SEQ ID NO: 7156 - DNA, 22 bp, synthetic construct
  misc_feature 1..22: note = Description of Artificial Sequence: Syntheticoligonucleotide
  source 1..22: mol_type = other DNA
acgactctgcgcagagtcgtcc

SEQ ID NO: 7157 - DNA, 22 bp, synthetic construct
  misc_feature 1..22: note = Description of Artificial Sequence: Syntheticoligonucleotide
  source 1..22: mol_type = other DNA
gagactctgcgcagagtctccc

SEQ ID NO: 7158 - DNA, 22 bp, synthetic construct
  misc_feature 1..22: note = Description of Artificial Sequence: Syntheticoligonucleotide
  source 1..22: mol_type = other DNA
gcgactctgcgcagagtcgcca

SEQ ID NO: 7159 - DNA, 22 bp, synthetic construct
  misc_feature 1..22: note = Description of Artificial Sequence: Syntheticoligonucleotide
  source 1..22: mol_type = other DNA
gcgactctgcgcagagtcgcac

SEQ ID NO: 7160 - DNA, 22 bp, synthetic construct
  misc_feature 1..22: note = Description of Artificial Sequence: Syntheticoligonucleotide
  source 1..22: mol_type = other DNA
gtgactctgcgcagagtcaccc

SEQ ID NO: 7161 - DNA, 22 bp, synthetic construct
  misc_feature 1..22: note = Description of Artificial Sequence: Syntheticoligonucleotide
  source 1..22: mol_type = other DNA
gggactctgcgcagagtcccgt

SEQ ID NO: 7162 - DNA, 22 bp, synthetic construct
  misc_feature 1..22: note = Description of Artificial Sequence: Syntheticoligonucleotide
  source 1..22: mol_type = other DNA
gggactctgcgcagagtccctg

SEQ ID NO: 7163 - DNA, 22 bp, synthetic construct
  misc_feature 1..22: note = Description of Artificial Sequence: Syntheticoligonucleotide
  source 1..22: mol_type = other DNA
aggactctgcgcagagtcctgg

SEQ ID NO: 7164 - DNA, 22 bp, synthetic construct
  misc_feature 1..22: note = Description of Artificial Sequence: Syntheticoligonucleotide
  source 1..22: mol_type = other DNA
gagactctgcgcagagtctcgg

SEQ ID NO: 7165 - DNA, 22 bp, synthetic construct
  misc_feature 1..22: note = Description of Artificial Sequence: Syntheticoligonucleotide
  source 1..22: mol_type = other DNA
gggactctgcgcagagtcccga

SEQ ID NO: 7166 - DNA, 22 bp, synthetic construct
  misc_feature 1..22: note = Description of Artificial Sequence: Syntheticoligonucleotide
  source 1..22: mol_type = other DNA
gggactctgcgcagagtcccag

SEQ ID NO: 7167 - DNA, 22 bp, synthetic construct
  misc_feature 1..22: note = Description of Artificial Sequence: Syntheticoligonucleotide
  source 1..22: mol_type = other DNA
tggactctgcgcagagtccagg

SEQ ID NO: 7168 - DNA, 22 bp, synthetic construct
  misc_feature 1..22: note = Description of Artificial Sequence: Syntheticoligonucleotide
  source 1..22: mol_type = other DNA
gtgactctgcgcagagtcacgg

SEQ ID NO: 7169 - DNA, 22 bp, synthetic construct
  misc_feature 1..22: note = Description of Artificial Sequence: Syntheticoligonucleotide
  source 1..22: mol_type = other DNA
gcgactctgcgcagagtcgccg

SEQ ID NO: 7170 - DNA, 22 bp, synthetic construct
  misc_feature 1..22: note = Description of Artificial Sequence: Syntheticoligonucleotide
  source 1..22: mol_type = other DNA
gcgactctgcgcagagtcgctg

SEQ ID NO: 7171 - DNA, 22 bp, synthetic construct
  misc_feature 1..22: note = Description of Artificial Sequence: Syntheticoligonucleotide
  source 1..22: mol_type = other DNA
acgactctgcgcagagtcgtcg

SEQ ID NO: 7172 - DNA, 22 bp, synthetic construct
  misc_feature 1..22: note = Description of Artificial Sequence: Syntheticoligonucleotide
  source 1..22: mol_type = other DNA
gagactctgcgcagagtctccg

SEQ ID NO: 7173 - DNA, 22 bp, synthetic construct
  misc_feature 1..22: note = Description of Artificial Sequence: Syntheticoligonucleotide
  source 1..22: mol_type = other DNA
gcgactctgcgcagagtcgcag

SEQ ID NO: 7174 - DNA, 22 bp, synthetic construct
  misc_feature 1..22: note = Description of Artificial Sequence: Syntheticoligonucleotide
  source 1..22: mol_type = other DNA
gtgactctgcgcagagtcaccg

SEQ ID NO: 7175 - DNA, 22 bp, synthetic construct
  misc_feature 1..22: note = Description of Artificial Sequence: Syntheticoligonucleotide
  source 1..22: mol_type = other DNA
cggactctgcgcagagtccgtg

SEQ ID NO: 7176 - DNA, 22 bp, synthetic construct
  misc_feature 1..22: note = Description of Artificial Sequence: Syntheticoligonucleotide
  source 1..22: mol_type = other DNA
cagactctgcgcagagtctggg

SEQ ID NO: 7177 - DNA, 22 bp, synthetic construct
  misc_feature 1..22: note = Description of Artificial Sequence: Syntheticoligonucleotide
  source 1..22: mol_type = other DNA
cggactctgcgcagagtccgag

SEQ ID NO: 7178 - DNA, 22 bp, synthetic construct
  misc_feature 1..22: note = Description of Artificial Sequence: Syntheticoligonucleotide
  source 1..22: mol_type = other DNA
ctgactctgcgcagagtcaggg

SEQ ID NO: 7179 - DNA, 22 bp, synthetic construct
  misc_feature 1..22: note = Description of Artificial Sequence: Syntheticoligonucleotide
  source 1..22: mol_type = other DNA
acgactctgcgcagagtcgtgg

SEQ ID NO: 7180 - DNA, 22 bp, synthetic construct
  misc_feature 1..22: note = Description of Artificial Sequence: Syntheticoligonucleotide
  source 1..22: mol_type = other DNA
ccgactctgcgcagagtcggct

SEQ ID NO: 7181 - DNA, 22 bp, synthetic construct
  misc_feature 1..22: note = Description of Artificial Sequence: Syntheticoligonucleotide
  source 1..22: mol_type = other DNA
ccgactctgcgcagagtcggca

SEQ ID NO: 7182 - DNA, 22 bp, synthetic construct
  misc_feature 1..22: note = Description of Artificial Sequence: Syntheticoligonucleotide
  source 1..22: mol_type = other DNA
gagactctgcgcagagtctcgc

SEQ ID NO: 7183 - DNA, 22 bp, synthetic construct
  misc_feature 1..22: note = Description of Artificial Sequence: Syntheticoligonucleotide
  source 1..22: mol_type = other DNA
gtgactctgcgcagagtcacgc

SEQ ID NO: 7184 - DNA, 22 bp, synthetic construct
  misc_feature 1..22: note = Description of Artificial Sequence: Syntheticoligonucleotide
  source 1..22: mol_type = other DNA
aggactctgcgcagagtcctgc

SEQ ID NO: 7185 - DNA, 22 bp, synthetic construct
  misc_feature 1..22: note = Description of Artificial Sequence: Syntheticoligonucleotide
  source 1..22: mol_type = other DNA
tggactctgcgcagagtccagc

SEQ ID NO: 7186 - DNA, 22 bp, synthetic construct
  misc_feature 1..22: note = Description of Artificial Sequence: Syntheticoligonucleotide
  source 1..22: mol_type = other DNA
aggactctgcgcagagtcctcg

SEQ ID NO: 7187 - DNA, 22 bp, synthetic construct
  misc_feature 1..22: note = Description of Artificial Sequence: Syntheticoligonucleotide
  source 1..22: mol_type = other DNA
tggactctgcgcagagtccacg

SEQ ID NO: 7188 - DNA, 22 bp, synthetic construct
  misc_feature 1..22: note = Description of Artificial Sequence: Syntheticoligonucleotide
  source 1..22: mol_type = other DNA
ccgactctgcgcagagtcggtg

SEQ ID NO: 7189 - DNA, 22 bp, synthetic construct
  misc_feature 1..22: note = Description of Artificial Sequence: Syntheticoligonucleotide
  source 1..22: mol_type = other DNA
ccgactctgcgcagagtcggag

SEQ ID NO: 7190 - DNA, 22 bp, synthetic construct
  misc_feature 1..22: note = Description of Artificial Sequence: Syntheticoligonucleotide
  source 1..22: mol_type = other DNA
gggactctgcgcagagtcccgc

SEQ ID NO: 7191 - DNA, 22 bp, synthetic construct
  misc_feature 1..22: note = Description of Artificial Sequence: Syntheticoligonucleotide
  source 1..22: mol_type = other DNA
gggactctgcgcagagtccctc

SEQ ID NO: 7192 - DNA, 22 bp, synthetic construct
  misc_feature 1..22: note = Description of Artificial Sequence: Syntheticoligonucleotide
  source 1..22: mol_type = other DNA
gggactctgcgcagagtcccac

SEQ ID NO: 7193 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcgcatgcgagtcnnnn

SEQ ID NO: 7194 - DNA, 22 bp, synthetic construct
  misc_feature 1..22: note = Description of Artificial Sequence: Syntheticoligonucleotide
  source 1..22: mol_type = other DNA
cggactcgcatgcgagtccgcc

SEQ ID NO: 7195 - DNA, 22 bp, synthetic construct
  misc_feature 1..22: note = Description of Artificial Sequence: Syntheticoligonucleotide
  source 1..22: mol_type = other DNA
cggactcgcatgcgagtccgct

SEQ ID NO: 7196 - DNA, 22 bp, synthetic construct
  misc_feature 1..22: note = Description of Artificial Sequence: Syntheticoligonucleotide
  source 1..22: mol_type = other DNA
cggactcgcatgcgagtccgtc

SEQ ID NO: 7197 - DNA, 22 bp, synthetic construct
  misc_feature 1..22: note = Description of Artificial Sequence: Syntheticoligonucleotide
  source 1..22: mol_type = other DNA
aggactcgcatgcgagtcctcc

SEQ ID NO: 7198 - DNA, 22 bp, synthetic construct
  misc_feature 1..22: note = Description of Artificial Sequence: Syntheticoligonucleotide
  source 1..22: mol_type = other DNA
cagactcgcatgcgagtctgcc

SEQ ID NO: 7199 - DNA, 22 bp, synthetic construct
  misc_feature 1..22: note = Description of Artificial Sequence: Syntheticoligonucleotide
  source 1..22: mol_type = other DNA
cggactcgcatgcgagtccgca

SEQ ID NO: 7200 - DNA, 22 bp, synthetic construct
  misc_feature 1..22: note = Description of Artificial Sequence: Syntheticoligonucleotide
  source 1..22: mol_type = other DNA
cggactcgcatgcgagtccgac

SEQ ID NO: 7201 - DNA, 22 bp, synthetic construct
  misc_feature 1..22: note = Description of Artificial Sequence: Syntheticoligonucleotide
  source 1..22: mol_type = other DNA
tggactcgcatgcgagtccacc

SEQ ID NO: 7202 - DNA, 22 bp, synthetic construct
  misc_feature 1..22: note = Description of Artificial Sequence: Syntheticoligonucleotide
  source 1..22: mol_type = other DNA
ctgactcgcatgcgagtcagcc

SEQ ID NO: 7203 - DNA, 22 bp, synthetic construct
  misc_feature 1..22: note = Description of Artificial Sequence: Syntheticoligonucleotide
  source 1..22: mol_type = other DNA
ccgactcgcatgcgagtcgggc

SEQ ID NO: 7204 - DNA, 22 bp, synthetic construct
  misc_feature 1..22: note = Description of Artificial Sequence: Syntheticoligonucleotide
  source 1..22: mol_type = other DNA
ccgactcgcatgcgagtcgggt

SEQ ID NO: 7205 - DNA, 22 bp, synthetic construct
  misc_feature 1..22: note = Description of Artificial Sequence: Syntheticoligonucleotide
  source 1..22: mol_type = other DNA
ccgactcgcatgcgagtcggtc

SEQ ID NO: 7206 - DNA, 22 bp, synthetic construct
  misc_feature 1..22: note = Description of Artificial Sequence: Syntheticoligonucleotide
  source 1..22: mol_type = other DNA
acgactcgcatgcgagtcgtgc

SEQ ID NO: 7207 - DNA, 22 bp, synthetic construct
  misc_feature 1..22: note = Description of Artificial Sequence: Syntheticoligonucleotide
  source 1..22: mol_type = other DNA
cagactcgcatgcgagtctggc

SEQ ID NO: 7208 - DNA, 22 bp, synthetic construct
  misc_feature 1..22: note = Description of Artificial Sequence: Syntheticoligonucleotide
  source 1..22: mol_type = other DNA
ccgactcgcatgcgagtcggga

SEQ ID NO: 7209 - DNA, 22 bp, synthetic construct
  misc_feature 1..22: note = Description of Artificial Sequence: Syntheticoligonucleotide
  source 1..22: mol_type = other DNA
ccgactcgcatgcgagtcggac

SEQ ID NO: 7210 - DNA, 22 bp, synthetic construct
  misc_feature 1..22: note = Description of Artificial Sequence: Syntheticoligonucleotide
  source 1..22: mol_type = other DNA
ctgactcgcatgcgagtcaggc

SEQ ID NO: 7211 - DNA, 22 bp, synthetic construct
  misc_feature 1..22: note = Description of Artificial Sequence: Syntheticoligonucleotide
  source 1..22: mol_type = other DNA
gcgactcgcatgcgagtcgccc

SEQ ID NO: 7212 - DNA, 22 bp, synthetic construct
  misc_feature 1..22: note = Description of Artificial Sequence: Syntheticoligonucleotide
  source 1..22: mol_type = other DNA
gcgactcgcatgcgagtcgcct

SEQ ID NO: 7213 - DNA, 22 bp, synthetic construct
  misc_feature 1..22: note = Description of Artificial Sequence: Syntheticoligonucleotide
  source 1..22: mol_type = other DNA
gcgactcgcatgcgagtcgctc

SEQ ID NO: 7214 - DNA, 22 bp, synthetic construct
  misc_feature 1..22: note = Description of Artificial Sequence: Syntheticoligonucleotide
  source 1..22: mol_type = other DNA
acgactcgcatgcgagtcgtcc

SEQ ID NO: 7215 - DNA, 22 bp, synthetic construct
  misc_feature 1..22: note = Description of Artificial Sequence: Syntheticoligonucleotide
  source 1..22: mol_type = other DNA
gagactcgcatgcgagtctccc

SEQ ID NO: 7216 - DNA, 22 bp, synthetic construct
  misc_feature 1..22: note = Description of Artificial Sequence: Syntheticoligonucleotide
  source 1..22: mol_type = other DNA
gcgactcgcatgcgagtcgcca

SEQ ID NO: 7217 - DNA, 22 bp, synthetic construct
  misc_feature 1..22: note = Description of Artificial Sequence: Syntheticoligonucleotide
  source 1..22: mol_type = other DNA
gcgactcgcatgcgagtcgcac

SEQ ID NO: 7218 - DNA, 22 bp, synthetic construct
  misc_feature 1..22: note = Description of Artificial Sequence: Syntheticoligonucleotide
  source 1..22: mol_type = other DNA
gtgactcgcatgcgagtcaccc

SEQ ID NO: 7219 - DNA, 22 bp, synthetic construct
  misc_feature 1..22: note = Description of Artificial Sequence: Syntheticoligonucleotide
  source 1..22: mol_type = other DNA
gggactcgcatgcgagtcccgt

SEQ ID NO: 7220 - DNA, 22 bp, synthetic construct
  misc_feature 1..22: note = Description of Artificial Sequence: Syntheticoligonucleotide
  source 1..22: mol_type = other DNA
gggactcgcatgcgagtccctg

SEQ ID NO: 7221 - DNA, 22 bp, synthetic construct
  misc_feature 1..22: note = Description of Artificial Sequence: Syntheticoligonucleotide
  source 1..22: mol_type = other DNA
aggactcgcatgcgagtcctgg

SEQ ID NO: 7222 - DNA, 22 bp, synthetic construct
  misc_feature 1..22: note = Description of Artificial Sequence: Syntheticoligonucleotide
  source 1..22: mol_type = other DNA
gagactcgcatgcgagtctcgg

SEQ ID NO: 7223 - DNA, 22 bp, synthetic construct
  misc_feature 1..22: note = Description of Artificial Sequence: Syntheticoligonucleotide
  source 1..22: mol_type = other DNA
gggactcgcatgcgagtcccga

SEQ ID NO: 7224 - DNA, 22 bp, synthetic construct
  misc_feature 1..22: note = Description of Artificial Sequence: Syntheticoligonucleotide
  source 1..22: mol_type = other DNA
gggactcgcatgcgagtcccag

SEQ ID NO: 7225 - DNA, 22 bp, synthetic construct
  misc_feature 1..22: note = Description of Artificial Sequence: Syntheticoligonucleotide
  source 1..22: mol_type = other DNA
tggactcgcatgcgagtccagg

SEQ ID NO: 7226 - DNA, 22 bp, synthetic construct
  misc_feature 1..22: note = Description of Artificial Sequence: Syntheticoligonucleotide
  source 1..22: mol_type = other DNA
gtgactcgcatgcgagtcacgg

SEQ ID NO: 7227 - DNA, 22 bp, synthetic construct
  misc_feature 1..22: note = Description of Artificial Sequence: Syntheticoligonucleotide
  source 1..22: mol_type = other DNA
gcgactcgcatgcgagtcgccg

SEQ ID NO: 7228 - DNA, 22 bp, synthetic construct
  misc_feature 1..22: note = Description of Artificial Sequence: Syntheticoligonucleotide
  source 1..22: mol_type = other DNA
gcgactcgcatgcgagtcgctg

SEQ ID NO: 7229 - DNA, 22 bp, synthetic construct
  misc_feature 1..22: note = Description of Artificial Sequence: Syntheticoligonucleotide
  source 1..22: mol_type = other DNA
acgactcgcatgcgagtcgtcg

SEQ ID NO: 7230 - DNA, 22 bp, synthetic construct
  misc_feature 1..22: note = Description of Artificial Sequence: Syntheticoligonucleotide
  source 1..22: mol_type = other DNA
gagactcgcatgcgagtctccg

SEQ ID NO: 7231 - DNA, 22 bp, synthetic construct
  misc_feature 1..22: note = Description of Artificial Sequence: Syntheticoligonucleotide
  source 1..22: mol_type = other DNA
gcgactcgcatgcgagtcgcag

SEQ ID NO: 7232 - DNA, 22 bp, synthetic construct
  misc_feature 1..22: note = Description of Artificial Sequence: Syntheticoligonucleotide
  source 1..22: mol_type = other DNA
gtgactcgcatgcgagtcaccg

SEQ ID NO: 7233 - DNA, 22 bp, synthetic construct
  misc_feature 1..22: note = Description of Artificial Sequence: Syntheticoligonucleotide
  source 1..22: mol_type = other DNA
cggactcgcatgcgagtccgtg

SEQ ID NO: 7234 - DNA, 22 bp, synthetic construct
  misc_feature 1..22: note = Description of Artificial Sequence: Syntheticoligonucleotide
  source 1..22: mol_type = other DNA
cagactcgcatgcgagtctggg

SEQ ID NO: 7235 - DNA, 22 bp, synthetic construct
  misc_feature 1..22: note = Description of Artificial Sequence: Syntheticoligonucleotide
  source 1..22: mol_type = other DNA
cggactcgcatgcgagtccgag

SEQ ID NO: 7236 - DNA, 22 bp, synthetic construct
  misc_feature 1..22: note = Description of Artificial Sequence: Syntheticoligonucleotide
  source 1..22: mol_type = other DNA
ctgactcgcatgcgagtcaggg

SEQ ID NO: 7237 - DNA, 22 bp, synthetic construct
  misc_feature 1..22: note = Description of Artificial Sequence: Syntheticoligonucleotide
  source 1..22: mol_type = other DNA
acgactcgcatgcgagtcgtgg

SEQ ID NO: 7238 - DNA, 22 bp, synthetic construct
  misc_feature 1..22: note = Description of Artificial Sequence: Syntheticoligonucleotide
  source 1..22: mol_type = other DNA
ccgactcgcatgcgagtcggct

SEQ ID NO: 7239 - DNA, 22 bp, synthetic construct
  misc_feature 1..22: note = Description of Artificial Sequence: Syntheticoligonucleotide
  source 1..22: mol_type = other DNA
ccgactcgcatgcgagtcggca

SEQ ID NO: 7240 - DNA, 22 bp, synthetic construct
  misc_feature 1..22: note = Description of Artificial Sequence: Syntheticoligonucleotide
  source 1..22: mol_type = other DNA
gagactcgcatgcgagtctcgc

SEQ ID NO: 7241 - DNA, 22 bp, synthetic construct
  misc_feature 1..22: note = Description of Artificial Sequence: Syntheticoligonucleotide
  source 1..22: mol_type = other DNA
gtgactcgcatgcgagtcacgc

SEQ ID NO: 7242 - DNA, 22 bp, synthetic construct
  misc_feature 1..22: note = Description of Artificial Sequence: Syntheticoligonucleotide
  source 1..22: mol_type = other DNA
aggactcgcatgcgagtcctgc

SEQ ID NO: 7243 - DNA, 22 bp, synthetic construct
  misc_feature 1..22: note = Description of Artificial Sequence: Syntheticoligonucleotide
  source 1..22: mol_type = other DNA
tggactcgcatgcgagtccagc

SEQ ID NO: 7244 - DNA, 22 bp, synthetic construct
  misc_feature 1..22: note = Description of Artificial Sequence: Syntheticoligonucleotide
  source 1..22: mol_type = other DNA
aggactcgcatgcgagtcctcg

SEQ ID NO: 7245 - DNA, 22 bp, synthetic construct
  misc_feature 1..22: note = Description of Artificial Sequence: Syntheticoligonucleotide
  source 1..22: mol_type = other DNA
tggactcgcatgcgagtccacg

SEQ ID NO: 7246 - DNA, 22 bp, synthetic construct
  misc_feature 1..22: note = Description of Artificial Sequence: Syntheticoligonucleotide
  source 1..22: mol_type = other DNA
ccgactcgcatgcgagtcggtg

SEQ ID NO: 7247 - DNA, 22 bp, synthetic construct
  misc_feature 1..22: note = Description of Artificial Sequence: Syntheticoligonucleotide
  source 1..22: mol_type = other DNA
ccgactcgcatgcgagtcggag

SEQ ID NO: 7248 - DNA, 22 bp, synthetic construct
  misc_feature 1..22: note = Description of Artificial Sequence: Syntheticoligonucleotide
  source 1..22: mol_type = other DNA
gggactcgcatgcgagtcccgc

SEQ ID NO: 7249 - DNA, 22 bp, synthetic construct
  misc_feature 1..22: note = Description of Artificial Sequence: Syntheticoligonucleotide
  source 1..22: mol_type = other DNA
gggactcgcatgcgagtccctc

SEQ ID NO: 7250 - DNA, 22 bp, synthetic construct
  misc_feature 1..22: note = Description of Artificial Sequence: Syntheticoligonucleotide
  source 1..22: mol_type = other DNA
gggactcgcatgcgagtcccac

SEQ ID NO: 7251 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcgctagcgagtcnnnn

SEQ ID NO: 7252 - DNA, 22 bp, synthetic construct
  misc_feature 1..22: note = Description of Artificial Sequence: Syntheticoligonucleotide
  source 1..22: mol_type = other DNA
cggactcgctagcgagtccgcc

SEQ ID NO: 7253 - DNA, 22 bp, synthetic construct
  misc_feature 1..22: note = Description of Artificial Sequence: Syntheticoligonucleotide
  source 1..22: mol_type = other DNA
cggactcgctagcgagtccgct

SEQ ID NO: 7254 - DNA, 22 bp, synthetic construct
  misc_feature 1..22: note = Description of Artificial Sequence: Syntheticoligonucleotide
  source 1..22: mol_type = other DNA
cggactcgctagcgagtccgtc

SEQ ID NO: 7255 - DNA, 22 bp, synthetic construct
  misc_feature 1..22: note = Description of Artificial Sequence: Syntheticoligonucleotide
  source 1..22: mol_type = other DNA
aggactcgctagcgagtcctcc

SEQ ID NO: 7256 - DNA, 22 bp, synthetic construct
  misc_feature 1..22: note = Description of Artificial Sequence: Syntheticoligonucleotide
  source 1..22: mol_type = other DNA
cagactcgctagcgagtctgcc

SEQ ID NO: 7257 - DNA, 22 bp, synthetic construct
  misc_feature 1..22: note = Description of Artificial Sequence: Syntheticoligonucleotide
  source 1..22: mol_type = other DNA
cggactcgctagcgagtccgca

SEQ ID NO: 7258 - DNA, 22 bp, synthetic construct
  misc_feature 1..22: note = Description of Artificial Sequence: Syntheticoligonucleotide
  source 1..22: mol_type = other DNA
cggactcgctagcgagtccgac

SEQ ID NO: 7259 - DNA, 22 bp, synthetic construct
  misc_feature 1..22: note = Description of Artificial Sequence: Syntheticoligonucleotide
  source 1..22: mol_type = other DNA
tggactcgctagcgagtccacc

SEQ ID NO: 7260 - DNA, 22 bp, synthetic construct
  misc_feature 1..22: note = Description of Artificial Sequence: Syntheticoligonucleotide
  source 1..22: mol_type = other DNA
ctgactcgctagcgagtcagcc

SEQ ID NO: 7261 - DNA, 22 bp, synthetic construct
  misc_feature 1..22: note = Description of Artificial Sequence: Syntheticoligonucleotide
  source 1..22: mol_type = other DNA
ccgactcgctagcgagtcgggc

SEQ ID NO: 7262 - DNA, 22 bp, synthetic construct
  misc_feature 1..22: note = Description of Artificial Sequence: Syntheticoligonucleotide
  source 1..22: mol_type = other DNA
ccgactcgctagcgagtcgggt

SEQ ID NO: 7263 - DNA, 22 bp, synthetic construct
  misc_feature 1..22: note = Description of Artificial Sequence: Syntheticoligonucleotide
  source 1..22: mol_type = other DNA
ccgactcgctagcgagtcggtc

SEQ ID NO: 7264 - DNA, 22 bp, synthetic construct
  misc_feature 1..22: note = Description of Artificial Sequence: Syntheticoligonucleotide
  source 1..22: mol_type = other DNA
acgactcgctagcgagtcgtgc

SEQ ID NO: 7265 - DNA, 22 bp, synthetic construct
  misc_feature 1..22: note = Description of Artificial Sequence: Syntheticoligonucleotide
  source 1..22: mol_type = other DNA
cagactcgctagcgagtctggc

SEQ ID NO: 7266 - DNA, 22 bp, synthetic construct
  misc_feature 1..22: note = Description of Artificial Sequence: Syntheticoligonucleotide
  source 1..22: mol_type = other DNA
ccgactcgctagcgagtcggga

SEQ ID NO: 7267 - DNA, 22 bp, synthetic construct
  misc_feature 1..22: note = Description of Artificial Sequence: Syntheticoligonucleotide
  source 1..22: mol_type = other DNA
ccgactcgctagcgagtcggac

SEQ ID NO: 7268 - DNA, 22 bp, synthetic construct
  misc_feature 1..22: note = Description of Artificial Sequence: Syntheticoligonucleotide
  source 1..22: mol_type = other DNA
ctgactcgctagcgagtcaggc

SEQ ID NO: 7269 - DNA, 22 bp, synthetic construct
  misc_feature 1..22: note = Description of Artificial Sequence: Syntheticoligonucleotide
  source 1..22: mol_type = other DNA
gcgactcgctagcgagtcgccc

SEQ ID NO: 7270 - DNA, 22 bp, synthetic construct
  misc_feature 1..22: note = Description of Artificial Sequence: Syntheticoligonucleotide
  source 1..22: mol_type = other DNA
gcgactcgctagcgagtcgcct

SEQ ID NO: 7271 - DNA, 22 bp, synthetic construct
  misc_feature 1..22: note = Description of Artificial Sequence: Syntheticoligonucleotide
  source 1..22: mol_type = other DNA
gcgactcgctagcgagtcgctc

SEQ ID NO: 7272 - DNA, 22 bp, synthetic construct
  misc_feature 1..22: note = Description of Artificial Sequence: Syntheticoligonucleotide
  source 1..22: mol_type = other DNA
acgactcgctagcgagtcgtcc

SEQ ID NO: 7273 - DNA, 22 bp, synthetic construct
  misc_feature 1..22: note = Description of Artificial Sequence: Syntheticoligonucleotide
  source 1..22: mol_type = other DNA
gagactcgctagcgagtctccc

SEQ ID NO: 7274 - DNA, 22 bp, synthetic construct
  misc_feature 1..22: note = Description of Artificial Sequence: Syntheticoligonucleotide
  source 1..22: mol_type = other DNA
gcgactcgctagcgagtcgcca

SEQ ID NO: 7275 - DNA, 22 bp, synthetic construct
  misc_feature 1..22: note = Description of Artificial Sequence: Syntheticoligonucleotide
  source 1..22: mol_type = other DNA
gcgactcgctagcgagtcgcac

SEQ ID NO: 7276 - DNA, 22 bp, synthetic construct
  misc_feature 1..22: note = Description of Artificial Sequence: Syntheticoligonucleotide
  source 1..22: mol_type = other DNA
gtgactcgctagcgagtcaccc

SEQ ID NO: 7277 - DNA, 22 bp, synthetic construct
  misc_feature 1..22: note = Description of Artificial Sequence: Syntheticoligonucleotide
  source 1..22: mol_type = other DNA
gggactcgctagcgagtcccgt

SEQ ID NO: 7278 - DNA, 22 bp, synthetic construct
  misc_feature 1..22: note = Description of Artificial Sequence: Syntheticoligonucleotide
  source 1..22: mol_type = other DNA
gggactcgctagcgagtccctg

SEQ ID NO: 7279 - DNA, 22 bp, synthetic construct
  misc_feature 1..22: note = Description of Artificial Sequence: Syntheticoligonucleotide
  source 1..22: mol_type = other DNA
aggactcgctagcgagtcctgg

SEQ ID NO: 7280 - DNA, 22 bp, synthetic construct
  misc_feature 1..22: note = Description of Artificial Sequence: Syntheticoligonucleotide
  source 1..22: mol_type = other DNA
gagactcgctagcgagtctcgg

SEQ ID NO: 7281 - DNA, 22 bp, synthetic construct
  misc_feature 1..22: note = Description of Artificial Sequence: Syntheticoligonucleotide
  source 1..22: mol_type = other DNA
gggactcgctagcgagtcccga

SEQ ID NO: 7282 - DNA, 22 bp, synthetic construct
  misc_feature 1..22: note = Description of Artificial Sequence: Syntheticoligonucleotide
  source 1..22: mol_type = other DNA
gggactcgctagcgagtcccag

SEQ ID NO: 7283 - DNA, 22 bp, synthetic construct
  misc_feature 1..22: note = Description of Artificial Sequence: Syntheticoligonucleotide
  source 1..22: mol_type = other DNA
tggactcgctagcgagtccagg

SEQ ID NO: 7284 - DNA, 22 bp, synthetic construct
  misc_feature 1..22: note = Description of Artificial Sequence: Syntheticoligonucleotide
  source 1..22: mol_type = other DNA
gtgactcgctagcgagtcacgg

SEQ ID NO: 7285 - DNA, 22 bp, synthetic construct
  misc_feature 1..22: note = Description of Artificial Sequence: Syntheticoligonucleotide
  source 1..22: mol_type = other DNA
gcgactcgctagcgagtcgccg

SEQ ID NO: 7286 - DNA, 22 bp, synthetic construct
  misc_feature 1..22: note = Description of Artificial Sequence: Syntheticoligonucleotide
  source 1..22: mol_type = other DNA
gcgactcgctagcgagtcgctg

SEQ ID NO: 7287 - DNA, 22 bp, synthetic construct
  misc_feature 1..22: note = Description of Artificial Sequence: Syntheticoligonucleotide
  source 1..22: mol_type = other DNA
acgactcgctagcgagtcgtcg

SEQ ID NO: 7288 - DNA, 22 bp, synthetic construct
  misc_feature 1..22: note = Description of Artificial Sequence: Syntheticoligonucleotide
  source 1..22: mol_type = other DNA
gagactcgctagcgagtctccg

SEQ ID NO: 7289 - DNA, 22 bp, synthetic construct
  misc_feature 1..22: note = Description of Artificial Sequence: Syntheticoligonucleotide
  source 1..22: mol_type = other DNA
gcgactcgctagcgagtcgcag

SEQ ID NO: 7290 - DNA, 22 bp, synthetic construct
  misc_feature 1..22: note = Description of Artificial Sequence: Syntheticoligonucleotide
  source 1..22: mol_type = other DNA
gtgactcgctagcgagtcaccg

SEQ ID NO: 7291 - DNA, 22 bp, synthetic construct
  misc_feature 1..22: note = Description of Artificial Sequence: Syntheticoligonucleotide
  source 1..22: mol_type = other DNA
cggactcgctagcgagtccgtg

SEQ ID NO: 7292 - DNA, 22 bp, synthetic construct
  misc_feature 1..22: note = Description of Artificial Sequence: Syntheticoligonucleotide
  source 1..22: mol_type = other DNA
cagactcgctagcgagtctggg

SEQ ID NO: 7293 - DNA, 22 bp, synthetic construct
  misc_feature 1..22: note = Description of Artificial Sequence: Syntheticoligonucleotide
  source 1..22: mol_type = other DNA
cggactcgctagcgagtccgag

SEQ ID NO: 7294 - DNA, 22 bp, synthetic construct
  misc_feature 1..22: note = Description of Artificial Sequence: Syntheticoligonucleotide
  source 1..22: mol_type = other DNA
ctgactcgctagcgagtcaggg

SEQ ID NO: 7295 - DNA, 22 bp, synthetic construct
  misc_feature 1..22: note = Description of Artificial Sequence: Syntheticoligonucleotide
  source 1..22: mol_type = other DNA
acgactcgctagcgagtcgtgg

SEQ ID NO: 7296 - DNA, 22 bp, synthetic construct
  misc_feature 1..22: note = Description of Artificial Sequence: Syntheticoligonucleotide
  source 1..22: mol_type = other DNA
ccgactcgctagcgagtcggct

SEQ ID NO: 7297 - DNA, 22 bp, synthetic construct
  misc_feature 1..22: note = Description of Artificial Sequence: Syntheticoligonucleotide
  source 1..22: mol_type = other DNA
ccgactcgctagcgagtcggca

SEQ ID NO: 7298 - DNA, 22 bp, synthetic construct
  misc_feature 1..22: note = Description of Artificial Sequence: Syntheticoligonucleotide
  source 1..22: mol_type = other DNA
gagactcgctagcgagtctcgc

SEQ ID NO: 7299 - DNA, 22 bp, synthetic construct
  misc_feature 1..22: note = Description of Artificial Sequence: Syntheticoligonucleotide
  source 1..22: mol_type = other DNA
gtgactcgctagcgagtcacgc

SEQ ID NO: 7300 - DNA, 22 bp, synthetic construct
  misc_feature 1..22: note = Description of Artificial Sequence: Syntheticoligonucleotide
  source 1..22: mol_type = other DNA
aggactcgctagcgagtcctgc

SEQ ID NO: 7301 - DNA, 22 bp, synthetic construct
  misc_feature 1..22: note = Description of Artificial Sequence: Syntheticoligonucleotide
  source 1..22: mol_type = other DNA
tggactcgctagcgagtccagc

SEQ ID NO: 7302 - DNA, 22 bp, synthetic construct
  misc_feature 1..22: note = Description of Artificial Sequence: Syntheticoligonucleotide
  source 1..22: mol_type = other DNA
aggactcgctagcgagtcctcg

SEQ ID NO: 7303 - DNA, 22 bp, synthetic construct
  misc_feature 1..22: note = Description of Artificial Sequence: Syntheticoligonucleotide
  source 1..22: mol_type = other DNA
tggactcgctagcgagtccacg

SEQ ID NO: 7304 - DNA, 22 bp, synthetic construct
  misc_feature 1..22: note = Description of Artificial Sequence: Syntheticoligonucleotide
  source 1..22: mol_type = other DNA
ccgactcgctagcgagtcggtg

SEQ ID NO: 7305 - DNA, 22 bp, synthetic construct
  misc_feature 1..22: note = Description of Artificial Sequence: Syntheticoligonucleotide
  source 1..22: mol_type = other DNA
ccgactcgctagcgagtcggag

SEQ ID NO: 7306 - DNA, 22 bp, synthetic construct
  misc_feature 1..22: note = Description of Artificial Sequence: Syntheticoligonucleotide
  source 1..22: mol_type = other DNA
gggactcgctagcgagtcccgc

SEQ ID NO: 7307 - DNA, 22 bp, synthetic construct
  misc_feature 1..22: note = Description of Artificial Sequence: Syntheticoligonucleotide
  source 1..22: mol_type = other DNA
gggactcgctagcgagtccctc

SEQ ID NO: 7308 - DNA, 22 bp, synthetic construct
  misc_feature 1..22: note = Description of Artificial Sequence: Syntheticoligonucleotide
  source 1..22: mol_type = other DNA
gggactcgctagcgagtcccac

SEQ ID NO: 7309 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcgcgcgcgagtcnnnn

SEQ ID NO: 7310 - DNA, 22 bp, synthetic construct
  misc_feature 1..22: note = Description of Artificial Sequence: Syntheticoligonucleotide
  source 1..22: mol_type = other DNA
cggactcgcgcgcgagtccgcc

SEQ ID NO: 7311 - DNA, 22 bp, synthetic construct
  misc_feature 1..22: note = Description of Artificial Sequence: Syntheticoligonucleotide
  source 1..22: mol_type = other DNA
cggactcgcgcgcgagtccgct

SEQ ID NO: 7312 - DNA, 22 bp, synthetic construct
  misc_feature 1..22: note = Description of Artificial Sequence: Syntheticoligonucleotide
  source 1..22: mol_type = other DNA
cggactcgcgcgcgagtccgtc

SEQ ID NO: 7313 - DNA, 22 bp, synthetic construct
  misc_feature 1..22: note = Description of Artificial Sequence: Syntheticoligonucleotide
  source 1..22: mol_type = other DNA
aggactcgcgcgcgagtcctcc

SEQ ID NO: 7314 - DNA, 22 bp, synthetic construct
  misc_feature 1..22: note = Description of Artificial Sequence: Syntheticoligonucleotide
  source 1..22: mol_type = other DNA
cagactcgcgcgcgagtctgcc

SEQ ID NO: 7315 - DNA, 22 bp, synthetic construct
  misc_feature 1..22: note = Description of Artificial Sequence: Syntheticoligonucleotide
  source 1..22: mol_type = other DNA
cggactcgcgcgcgagtccgca

SEQ ID NO: 7316 - DNA, 22 bp, synthetic construct
  misc_feature 1..22: note = Description of Artificial Sequence: Syntheticoligonucleotide
  source 1..22: mol_type = other DNA
cggactcgcgcgcgagtccgac

SEQ ID NO: 7317 - DNA, 22 bp, synthetic construct
  misc_feature 1..22: note = Description of Artificial Sequence: Syntheticoligonucleotide
  source 1..22: mol_type = other DNA
tggactcgcgcgcgagtccacc

SEQ ID NO: 7318 - DNA, 22 bp, synthetic construct
  misc_feature 1..22: note = Description of Artificial Sequence: Syntheticoligonucleotide
  source 1..22: mol_type = other DNA
ctgactcgcgcgcgagtcagcc

SEQ ID NO: 7319 - DNA, 22 bp, synthetic construct
  misc_feature 1..22: note = Description of Artificial Sequence: Syntheticoligonucleotide
  source 1..22: mol_type = other DNA
ccgactcgcgcgcgagtcgggc

SEQ ID NO: 7320 - DNA, 22 bp, synthetic construct
  misc_feature 1..22: note = Description of Artificial Sequence: Syntheticoligonucleotide
  source 1..22: mol_type = other DNA
ccgactcgcgcgcgagtcgggt

SEQ ID NO: 7321 - DNA, 22 bp, synthetic construct
  misc_feature 1..22: note = Description of Artificial Sequence: Syntheticoligonucleotide
  source 1..22: mol_type = other DNA
ccgactcgcgcgcgagtcggtc

SEQ ID NO: 7322 - DNA, 22 bp, synthetic construct
  misc_feature 1..22: note = Description of Artificial Sequence: Syntheticoligonucleotide
  source 1..22: mol_type = other DNA
acgactcgcgcgcgagtcgtgc

SEQ ID NO: 7323 - DNA, 22 bp, synthetic construct
  misc_feature 1..22: note = Description of Artificial Sequence: Syntheticoligonucleotide
  source 1..22: mol_type = other DNA
cagactcgcgcgcgagtctggc

SEQ ID NO: 7324 - DNA, 22 bp, synthetic construct
  misc_feature 1..22: note = Description of Artificial Sequence: Syntheticoligonucleotide
  source 1..22: mol_type = other DNA
ccgactcgcgcgcgagtcggga

SEQ ID NO: 7325 - DNA, 22 bp, synthetic construct
  misc_feature 1..22: note = Description of Artificial Sequence: Syntheticoligonucleotide
  source 1..22: mol_type = other DNA
ccgactcgcgcgcgagtcggac

SEQ ID NO: 7326 - DNA, 22 bp, synthetic construct
  misc_feature 1..22: note = Description of Artificial Sequence: Syntheticoligonucleotide
  source 1..22: mol_type = other DNA
ctgactcgcgcgcgagtcaggc

SEQ ID NO: 7327 - DNA, 22 bp, synthetic construct
  misc_feature 1..22: note = Description of Artificial Sequence: Syntheticoligonucleotide
  source 1..22: mol_type = other DNA
gcgactcgcgcgcgagtcgccc

SEQ ID NO: 7328 - DNA, 22 bp, synthetic construct
  misc_feature 1..22: note = Description of Artificial Sequence: Syntheticoligonucleotide
  source 1..22: mol_type = other DNA
gcgactcgcgcgcgagtcgcct

SEQ ID NO: 7329 - DNA, 22 bp, synthetic construct
  misc_feature 1..22: note = Description of Artificial Sequence: Syntheticoligonucleotide
  source 1..22: mol_type = other DNA
gcgactcgcgcgcgagtcgctc

SEQ ID NO: 7330 - DNA, 22 bp, synthetic construct
  misc_feature 1..22: note = Description of Artificial Sequence: Syntheticoligonucleotide
  source 1..22: mol_type = other DNA
acgactcgcgcgcgagtcgtcc

SEQ ID NO: 7331 - DNA, 22 bp, synthetic construct
  misc_feature 1..22: note = Description of Artificial Sequence: Syntheticoligonucleotide
  source 1..22: mol_type = other DNA
gagactcgcgcgcgagtctccc

SEQ ID NO: 7332 - DNA, 22 bp, synthetic construct
  misc_feature 1..22: note = Description of Artificial Sequence: Syntheticoligonucleotide
  source 1..22: mol_type = other DNA
gcgactcgcgcgcgagtcgcca

SEQ ID NO: 7333 - DNA, 22 bp, synthetic construct
  misc_feature 1..22: note = Description of Artificial Sequence: Syntheticoligonucleotide
  source 1..22: mol_type = other DNA
gcgactcgcgcgcgagtcgcac

SEQ ID NO: 7334 - DNA, 22 bp, synthetic construct
  misc_feature 1..22: note = Description of Artificial Sequence: Syntheticoligonucleotide
  source 1..22: mol_type = other DNA
gtgactcgcgcgcgagtcaccc

SEQ ID NO: 7335 - DNA, 22 bp, synthetic construct
  misc_feature 1..22: note = Description of Artificial Sequence: Syntheticoligonucleotide
  source 1..22: mol_type = other DNA
gggactcgcgcgcgagtcccgt

SEQ ID NO: 7336 - DNA, 22 bp, synthetic construct
  misc_feature 1..22: note = Description of Artificial Sequence: Syntheticoligonucleotide
  source 1..22: mol_type = other DNA
gggactcgcgcgcgagtccctg

SEQ ID NO: 7337 - DNA, 22 bp, synthetic construct
  misc_feature 1..22: note = Description of Artificial Sequence: Syntheticoligonucleotide
  source 1..22: mol_type = other DNA
aggactcgcgcgcgagtcctgg

SEQ ID NO: 7338 - DNA, 22 bp, synthetic construct
  misc_feature 1..22: note = Description of Artificial Sequence: Syntheticoligonucleotide
  source 1..22: mol_type = other DNA
gagactcgcgcgcgagtctcgg

SEQ ID NO: 7339 - DNA, 22 bp, synthetic construct
  misc_feature 1..22: note = Description of Artificial Sequence: Syntheticoligonucleotide
  source 1..22: mol_type = other DNA
gggactcgcgcgcgagtcccga

SEQ ID NO: 7340 - DNA, 22 bp, synthetic construct
  misc_feature 1..22: note = Description of Artificial Sequence: Syntheticoligonucleotide
  source 1..22: mol_type = other DNA
gggactcgcgcgcgagtcccag

SEQ ID NO: 7341 - DNA, 22 bp, synthetic construct
  misc_feature 1..22: note = Description of Artificial Sequence: Syntheticoligonucleotide
  source 1..22: mol_type = other DNA
tggactcgcgcgcgagtccagg

SEQ ID NO: 7342 - DNA, 22 bp, synthetic construct
  misc_feature 1..22: note = Description of Artificial Sequence: Syntheticoligonucleotide
  source 1..22: mol_type = other DNA
gtgactcgcgcgcgagtcacgg

SEQ ID NO: 7343 - DNA, 22 bp, synthetic construct
  misc_feature 1..22: note = Description of Artificial Sequence: Syntheticoligonucleotide
  source 1..22: mol_type = other DNA
gcgactcgcgcgcgagtcgccg

SEQ ID NO: 7344 - DNA, 22 bp, synthetic construct
  misc_feature 1..22: note = Description of Artificial Sequence: Syntheticoligonucleotide
  source 1..22: mol_type = other DNA
gcgactcgcgcgcgagtcgctg

SEQ ID NO: 7345 - DNA, 22 bp, synthetic construct
  misc_feature 1..22: note = Description of Artificial Sequence: Syntheticoligonucleotide
  source 1..22: mol_type = other DNA
acgactcgcgcgcgagtcgtcg

SEQ ID NO: 7346 - DNA, 22 bp, synthetic construct
  misc_feature 1..22: note = Description of Artificial Sequence: Syntheticoligonucleotide
  source 1..22: mol_type = other DNA
gagactcgcgcgcgagtctccg

SEQ ID NO: 7347 - DNA, 22 bp, synthetic construct
  misc_feature 1..22: note = Description of Artificial Sequence: Syntheticoligonucleotide
  source 1..22: mol_type = other DNA
gcgactcgcgcgcgagtcgcag

SEQ ID NO: 7348 - DNA, 22 bp, synthetic construct
  misc_feature 1..22: note = Description of Artificial Sequence: Syntheticoligonucleotide
  source 1..22: mol_type = other DNA
gtgactcgcgcgcgagtcaccg

SEQ ID NO: 7349 - DNA, 22 bp, synthetic construct
  misc_feature 1..22: note = Description of Artificial Sequence: Syntheticoligonucleotide
  source 1..22: mol_type = other DNA
cggactcgcgcgcgagtccgtg

SEQ ID NO: 7350 - DNA, 22 bp, synthetic construct
  misc_feature 1..22: note = Description of Artificial Sequence: Syntheticoligonucleotide
  source 1..22: mol_type = other DNA
cagactcgcgcgcgagtctggg

SEQ ID NO: 7351 - DNA, 22 bp, synthetic construct
  misc_feature 1..22: note = Description of Artificial Sequence: Syntheticoligonucleotide
  source 1..22: mol_type = other DNA
cggactcgcgcgcgagtccgag

SEQ ID NO: 7352 - DNA, 22 bp, synthetic construct
  misc_feature 1..22: note = Description of Artificial Sequence: Syntheticoligonucleotide
  source 1..22: mol_type = other DNA
ctgactcgcgcgcgagtcaggg

SEQ ID NO: 7353 - DNA, 22 bp, synthetic construct
  misc_feature 1..22: note = Description of Artificial Sequence: Syntheticoligonucleotide
  source 1..22: mol_type = other DNA
acgactcgcgcgcgagtcgtgg

SEQ ID NO: 7354 - DNA, 22 bp, synthetic construct
  misc_feature 1..22: note = Description of Artificial Sequence: Syntheticoligonucleotide
  source 1..22: mol_type = other DNA
ccgactcgcgcgcgagtcggct

SEQ ID NO: 7355 - DNA, 22 bp, synthetic construct
  misc_feature 1..22: note = Description of Artificial Sequence: Syntheticoligonucleotide
  source 1..22: mol_type = other DNA
ccgactcgcgcgcgagtcggca

SEQ ID NO: 7356 - DNA, 22 bp, synthetic construct
  misc_feature 1..22: note = Description of Artificial Sequence: Syntheticoligonucleotide
  source 1..22: mol_type = other DNA
gagactcgcgcgcgagtctcgc

SEQ ID NO: 7357 - DNA, 22 bp, synthetic construct
  misc_feature 1..22: note = Description of Artificial Sequence: Syntheticoligonucleotide
  source 1..22: mol_type = other DNA
gtgactcgcgcgcgagtcacgc

SEQ ID NO: 7358 - DNA, 22 bp, synthetic construct
  misc_feature 1..22: note = Description of Artificial Sequence: Syntheticoligonucleotide
  source 1..22: mol_type = other DNA
aggactcgcgcgcgagtcctgc

SEQ ID NO: 7359 - DNA, 22 bp, synthetic construct
  misc_feature 1..22: note = Description of Artificial Sequence: Syntheticoligonucleotide
  source 1..22: mol_type = other DNA
tggactcgcgcgcgagtccagc

SEQ ID NO: 7360 - DNA, 22 bp, synthetic construct
  misc_feature 1..22: note = Description of Artificial Sequence: Syntheticoligonucleotide
  source 1..22: mol_type = other DNA
aggactcgcgcgcgagtcctcg

SEQ ID NO: 7361 - DNA, 22 bp, synthetic construct
  misc_feature 1..22: note = Description of Artificial Sequence: Syntheticoligonucleotide
  source 1..22: mol_type = other DNA
tggactcgcgcgcgagtccacg

SEQ ID NO: 7362 - DNA, 22 bp, synthetic construct
  misc_feature 1..22: note = Description of Artificial Sequence: Syntheticoligonucleotide
  source 1..22: mol_type = other DNA
ccgactcgcgcgcgagtcggtg

SEQ ID NO: 7363 - DNA, 22 bp, synthetic construct
  misc_feature 1..22: note = Description of Artificial Sequence: Syntheticoligonucleotide
  source 1..22: mol_type = other DNA
ccgactcgcgcgcgagtcggag

SEQ ID NO: 7364 - DNA, 22 bp, synthetic construct
  misc_feature 1..22: note = Description of Artificial Sequence: Syntheticoligonucleotide
  source 1..22: mol_type = other DNA
gggactcgcgcgcgagtcccgc

SEQ ID NO: 7365 - DNA, 22 bp, synthetic construct
  misc_feature 1..22: note = Description of Artificial Sequence: Syntheticoligonucleotide
  source 1..22: mol_type = other DNA
gggactcgcgcgcgagtccctc

SEQ ID NO: 7366 - DNA, 22 bp, synthetic construct
  misc_feature 1..22: note = Description of Artificial Sequence: Syntheticoligonucleotide
  source 1..22: mol_type = other DNA
gggactcgcgcgcgagtcccac

SEQ ID NO: 7367 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcgccggcgagtcnnnn

SEQ ID NO: 7368 - DNA, 22 bp, synthetic construct
  misc_feature 1..22: note = Description of Artificial Sequence: Syntheticoligonucleotide
  source 1..22: mol_type = other DNA
cggactcgccggcgagtccgcc

SEQ ID NO: 7369 - DNA, 22 bp, synthetic construct
  misc_feature 1..22: note = Description of Artificial Sequence: Syntheticoligonucleotide
  source 1..22: mol_type = other DNA
cggactcgccggcgagtccgct

SEQ ID NO: 7370 - DNA, 22 bp, synthetic construct
  misc_feature 1..22: note = Description of Artificial Sequence: Syntheticoligonucleotide
  source 1..22: mol_type = other DNA
cggactcgccggcgagtccgtc

SEQ ID NO: 7371 - DNA, 22 bp, synthetic construct
  misc_feature 1..22: note = Description of Artificial Sequence: Syntheticoligonucleotide
  source 1..22: mol_type = other DNA
aggactcgccggcgagtcctcc

SEQ ID NO: 7372 - DNA, 22 bp, synthetic construct
  misc_feature 1..22: note = Description of Artificial Sequence: Syntheticoligonucleotide
  source 1..22: mol_type = other DNA
cagactcgccggcgagtctgcc

SEQ ID NO: 7373 - DNA, 22 bp, synthetic construct
  misc_feature 1..22: note = Description of Artificial Sequence: Syntheticoligonucleotide
  source 1..22: mol_type = other DNA
cggactcgccggcgagtccgca

SEQ ID NO: 7374 - DNA, 22 bp, synthetic construct
  misc_feature 1..22: note = Description of Artificial Sequence: Syntheticoligonucleotide
  source 1..22: mol_type = other DNA
cggactcgccggcgagtccgac

SEQ ID NO: 7375 - DNA, 22 bp, synthetic construct
  misc_feature 1..22: note = Description of Artificial Sequence: Syntheticoligonucleotide
  source 1..22: mol_type = other DNA
tggactcgccggcgagtccacc

SEQ ID NO: 7376 - DNA, 22 bp, synthetic construct
  misc_feature 1..22: note = Description of Artificial Sequence: Syntheticoligonucleotide
  source 1..22: mol_type = other DNA
ctgactcgccggcgagtcagcc

SEQ ID NO: 7377 - DNA, 22 bp, synthetic construct
  misc_feature 1..22: note = Description of Artificial Sequence: Syntheticoligonucleotide
  source 1..22: mol_type = other DNA
ccgactcgccggcgagtcgggc

SEQ ID NO: 7378 - DNA, 22 bp, synthetic construct
  misc_feature 1..22: note = Description of Artificial Sequence: Syntheticoligonucleotide
  source 1..22: mol_type = other DNA
ccgactcgccggcgagtcgggt

SEQ ID NO: 7379 - DNA, 22 bp, synthetic construct
  misc_feature 1..22: note = Description of Artificial Sequence: Syntheticoligonucleotide
  source 1..22: mol_type = other DNA
ccgactcgccggcgagtcggtc

SEQ ID NO: 7380 - DNA, 22 bp, synthetic construct
  misc_feature 1..22: note = Description of Artificial Sequence: Syntheticoligonucleotide
  source 1..22: mol_type = other DNA
acgactcgccggcgagtcgtgc

SEQ ID NO: 7381 - DNA, 22 bp, synthetic construct
  misc_feature 1..22: note = Description of Artificial Sequence: Syntheticoligonucleotide
  source 1..22: mol_type = other DNA
cagactcgccggcgagtctggc

SEQ ID NO: 7382 - DNA, 22 bp, synthetic construct
  misc_feature 1..22: note = Description of Artificial Sequence: Syntheticoligonucleotide
  source 1..22: mol_type = other DNA
ccgactcgccggcgagtcggga

SEQ ID NO: 7383 - DNA, 22 bp, synthetic construct
  misc_feature 1..22: note = Description of Artificial Sequence: Syntheticoligonucleotide
  source 1..22: mol_type = other DNA
ccgactcgccggcgagtcggac

SEQ ID NO: 7384 - DNA, 22 bp, synthetic construct
  misc_feature 1..22: note = Description of Artificial Sequence: Syntheticoligonucleotide
  source 1..22: mol_type = other DNA
ctgactcgccggcgagtcaggc

SEQ ID NO: 7385 - DNA, 22 bp, synthetic construct
  misc_feature 1..22: note = Description of Artificial Sequence: Syntheticoligonucleotide
  source 1..22: mol_type = other DNA
gcgactcgccggcgagtcgccc

SEQ ID NO: 7386 - DNA, 22 bp, synthetic construct
  misc_feature 1..22: note = Description of Artificial Sequence: Syntheticoligonucleotide
  source 1..22: mol_type = other DNA
gcgactcgccggcgagtcgcct

SEQ ID NO: 7387 - DNA, 22 bp, synthetic construct
  misc_feature 1..22: note = Description of Artificial Sequence: Syntheticoligonucleotide
  source 1..22: mol_type = other DNA
gcgactcgccggcgagtcgctc

SEQ ID NO: 7388 - DNA, 22 bp, synthetic construct
  misc_feature 1..22: note = Description of Artificial Sequence: Syntheticoligonucleotide
  source 1..22: mol_type = other DNA
acgactcgccggcgagtcgtcc

SEQ ID NO: 7389 - DNA, 22 bp, synthetic construct
  misc_feature 1..22: note = Description of Artificial Sequence: Syntheticoligonucleotide
  source 1..22: mol_type = other DNA
gagactcgccggcgagtctccc

SEQ ID NO: 7390 - DNA, 22 bp, synthetic construct
  misc_feature 1..22: note = Description of Artificial Sequence: Syntheticoligonucleotide
  source 1..22: mol_type = other DNA
gcgactcgccggcgagtcgcca

SEQ ID NO: 7391 - DNA, 22 bp, synthetic construct
  misc_feature 1..22: note = Description of Artificial Sequence: Syntheticoligonucleotide
  source 1..22: mol_type = other DNA
gcgactcgccggcgagtcgcac

SEQ ID NO: 7392 - DNA, 22 bp, synthetic construct
  misc_feature 1..22: note = Description of Artificial Sequence: Syntheticoligonucleotide
  source 1..22: mol_type = other DNA
gtgactcgccggcgagtcaccc

SEQ ID NO: 7393 - DNA, 22 bp, synthetic construct
  misc_feature 1..22: note = Description of Artificial Sequence: Syntheticoligonucleotide
  source 1..22: mol_type = other DNA
gggactcgccggcgagtcccgt

SEQ ID NO: 7394 - DNA, 22 bp, synthetic construct
  misc_feature 1..22: note = Description of Artificial Sequence: Syntheticoligonucleotide
  source 1..22: mol_type = other DNA
gggactcgccggcgagtccctg

SEQ ID NO: 7395 - DNA, 22 bp, synthetic construct
  misc_feature 1..22: note = Description of Artificial Sequence: Syntheticoligonucleotide
  source 1..22: mol_type = other DNA
aggactcgccggcgagtcctgg

SEQ ID NO: 7396 - DNA, 22 bp, synthetic construct
  misc_feature 1..22: note = Description of Artificial Sequence: Syntheticoligonucleotide
  source 1..22: mol_type = other DNA
gagactcgccggcgagtctcgg

SEQ ID NO: 7397 - DNA, 22 bp, synthetic construct
  misc_feature 1..22: note = Description of Artificial Sequence: Syntheticoligonucleotide
  source 1..22: mol_type = other DNA
gggactcgccggcgagtcccga

SEQ ID NO: 7398 - DNA, 22 bp, synthetic construct
  misc_feature 1..22: note = Description of Artificial Sequence: Syntheticoligonucleotide
  source 1..22: mol_type = other DNA
gggactcgccggcgagtcccag

SEQ ID NO: 7399 - DNA, 22 bp, synthetic construct
  misc_feature 1..22: note = Description of Artificial Sequence: Syntheticoligonucleotide
  source 1..22: mol_type = other DNA
tggactcgccggcgagtccagg

SEQ ID NO: 7400 - DNA, 22 bp, synthetic construct
  misc_feature 1..22: note = Description of Artificial Sequence: Syntheticoligonucleotide
  source 1..22: mol_type = other DNA
gtgactcgccggcgagtcacgg

SEQ ID NO: 7401 - DNA, 22 bp, synthetic construct
  misc_feature 1..22: note = Description of Artificial Sequence: Syntheticoligonucleotide
  source 1..22: mol_type = other DNA
gcgactcgccggcgagtcgccg

SEQ ID NO: 7402 - DNA, 22 bp, synthetic construct
  misc_feature 1..22: note = Description of Artificial Sequence: Syntheticoligonucleotide
  source 1..22: mol_type = other DNA
gcgactcgccggcgagtcgctg

SEQ ID NO: 7403 - DNA, 22 bp, synthetic construct
  misc_feature 1..22: note = Description of Artificial Sequence: Syntheticoligonucleotide
  source 1..22: mol_type = other DNA
acgactcgccggcgagtcgtcg

SEQ ID NO: 7404 - DNA, 22 bp, synthetic construct
  misc_feature 1..22: note = Description of Artificial Sequence: Syntheticoligonucleotide
  source 1..22: mol_type = other DNA
gagactcgccggcgagtctccg

SEQ ID NO: 7405 - DNA, 22 bp, synthetic construct
  misc_feature 1..22: note = Description of Artificial Sequence: Syntheticoligonucleotide
  source 1..22: mol_type = other DNA
gcgactcgccggcgagtcgcag

SEQ ID NO: 7406 - DNA, 22 bp, synthetic construct
  misc_feature 1..22: note = Description of Artificial Sequence: Syntheticoligonucleotide
  source 1..22: mol_type = other DNA
gtgactcgccggcgagtcaccg

SEQ ID NO: 7407 - DNA, 22 bp, synthetic construct
  misc_feature 1..22: note = Description of Artificial Sequence: Syntheticoligonucleotide
  source 1..22: mol_type = other DNA
cggactcgccggcgagtccgtg

SEQ ID NO: 7408 - DNA, 22 bp, synthetic construct
  misc_feature 1..22: note = Description of Artificial Sequence: Syntheticoligonucleotide
  source 1..22: mol_type = other DNA
cagactcgccggcgagtctggg

SEQ ID NO: 7409 - DNA, 22 bp, synthetic construct
  misc_feature 1..22: note = Description of Artificial Sequence: Syntheticoligonucleotide
  source 1..22: mol_type = other DNA
cggactcgccggcgagtccgag

SEQ ID NO: 7410 - DNA, 22 bp, synthetic construct
  misc_feature 1..22: note = Description of Artificial Sequence: Syntheticoligonucleotide
  source 1..22: mol_type = other DNA
ctgactcgccggcgagtcaggg

SEQ ID NO: 7411 - DNA, 22 bp, synthetic construct
  misc_feature 1..22: note = Description of Artificial Sequence: Syntheticoligonucleotide
  source 1..22: mol_type = other DNA
acgactcgccggcgagtcgtgg

SEQ ID NO: 7412 - DNA, 22 bp, synthetic construct
  misc_feature 1..22: note = Description of Artificial Sequence: Syntheticoligonucleotide
  source 1..22: mol_type = other DNA
ccgactcgccggcgagtcggct

SEQ ID NO: 7413 - DNA, 22 bp, synthetic construct
  misc_feature 1..22: note = Description of Artificial Sequence: Syntheticoligonucleotide
  source 1..22: mol_type = other DNA
ccgactcgccggcgagtcggca

SEQ ID NO: 7414 - DNA, 22 bp, synthetic construct
  misc_feature 1..22: note = Description of Artificial Sequence: Syntheticoligonucleotide
  source 1..22: mol_type = other DNA
gagactcgccggcgagtctcgc

SEQ ID NO: 7415 - DNA, 22 bp, synthetic construct
  misc_feature 1..22: note = Description of Artificial Sequence: Syntheticoligonucleotide
  source 1..22: mol_type = other DNA
gtgactcgccggcgagtcacgc

SEQ ID NO: 7416 - DNA, 22 bp, synthetic construct
  misc_feature 1..22: note = Description of Artificial Sequence: Syntheticoligonucleotide
  source 1..22: mol_type = other DNA
aggactcgccggcgagtcctgc

SEQ ID NO: 7417 - DNA, 22 bp, synthetic construct
  misc_feature 1..22: note = Description of Artificial Sequence: Syntheticoligonucleotide
  source 1..22: mol_type = other DNA
tggactcgccggcgagtccagc

SEQ ID NO: 7418 - DNA, 22 bp, synthetic construct
  misc_feature 1..22: note = Description of Artificial Sequence: Syntheticoligonucleotide
  source 1..22: mol_type = other DNA
aggactcgccggcgagtcctcg

SEQ ID NO: 7419 - DNA, 22 bp, synthetic construct
  misc_feature 1..22: note = Description of Artificial Sequence: Syntheticoligonucleotide
  source 1..22: mol_type = other DNA
tggactcgccggcgagtccacg

SEQ ID NO: 7420 - DNA, 22 bp, synthetic construct
  misc_feature 1..22: note = Description of Artificial Sequence: Syntheticoligonucleotide
  source 1..22: mol_type = other DNA
ccgactcgccggcgagtcggtg

SEQ ID NO: 7421 - DNA, 22 bp, synthetic construct
  misc_feature 1..22: note = Description of Artificial Sequence: Syntheticoligonucleotide
  source 1..22: mol_type = other DNA
ccgactcgccggcgagtcggag

SEQ ID NO: 7422 - DNA, 22 bp, synthetic construct
  misc_feature 1..22: note = Description of Artificial Sequence: Syntheticoligonucleotide
  source 1..22: mol_type = other DNA
gggactcgccggcgagtcccgc

SEQ ID NO: 7423 - DNA, 22 bp, synthetic construct
  misc_feature 1..22: note = Description of Artificial Sequence: Syntheticoligonucleotide
  source 1..22: mol_type = other DNA
gggactcgccggcgagtccctc

SEQ ID NO: 7424 - DNA, 22 bp, synthetic construct
  misc_feature 1..22: note = Description of Artificial Sequence: Syntheticoligonucleotide
  source 1..22: mol_type = other DNA
gggactcgccggcgagtcccac

SEQ ID NO: 7425 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcacatgtgagtcnnnn

SEQ ID NO: 7426 - DNA, 22 bp, synthetic construct
  misc_feature 1..22: note = Description of Artificial Sequence: Syntheticoligonucleotide
  source 1..22: mol_type = other DNA
cggactcacatgtgagtccgcc

SEQ ID NO: 7427 - DNA, 22 bp, synthetic construct
  misc_feature 1..22: note = Description of Artificial Sequence: Syntheticoligonucleotide
  source 1..22: mol_type = other DNA
cggactcacatgtgagtccgct

SEQ ID NO: 7428 - DNA, 22 bp, synthetic construct
  misc_feature 1..22: note = Description of Artificial Sequence: Syntheticoligonucleotide
  source 1..22: mol_type = other DNA
cggactcacatgtgagtccgtc

SEQ ID NO: 7429 - DNA, 22 bp, synthetic construct
  misc_feature 1..22: note = Description of Artificial Sequence: Syntheticoligonucleotide
  source 1..22: mol_type = other DNA
aggactcacatgtgagtcctcc

SEQ ID NO: 7430 - DNA, 22 bp, synthetic construct
  misc_feature 1..22: note = Description of Artificial Sequence: Syntheticoligonucleotide
  source 1..22: mol_type = other DNA
cagactcacatgtgagtctgcc

SEQ ID NO: 7431 - DNA, 22 bp, synthetic construct
  misc_feature 1..22: note = Description of Artificial Sequence: Syntheticoligonucleotide
  source 1..22: mol_type = other DNA
cggactcacatgtgagtccgca

SEQ ID NO: 7432 - DNA, 22 bp, synthetic construct
  misc_feature 1..22: note = Description of Artificial Sequence: Syntheticoligonucleotide
  source 1..22: mol_type = other DNA
cggactcacatgtgagtccgac

SEQ ID NO: 7433 - DNA, 22 bp, synthetic construct
  misc_feature 1..22: note = Description of Artificial Sequence: Syntheticoligonucleotide
  source 1..22: mol_type = other DNA
tggactcacatgtgagtccacc

SEQ ID NO: 7434 - DNA, 22 bp, synthetic construct
  misc_feature 1..22: note = Description of Artificial Sequence: Syntheticoligonucleotide
  source 1..22: mol_type = other DNA
ctgactcacatgtgagtcagcc

SEQ ID NO: 7435 - DNA, 22 bp, synthetic construct
  misc_feature 1..22: note = Description of Artificial Sequence: Syntheticoligonucleotide
  source 1..22: mol_type = other DNA
ccgactcacatgtgagtcgggc

SEQ ID NO: 7436 - DNA, 22 bp, synthetic construct
  misc_feature 1..22: note = Description of Artificial Sequence: Syntheticoligonucleotide
  source 1..22: mol_type = other DNA
ccgactcacatgtgagtcgggt

SEQ ID NO: 7437 - DNA, 22 bp, synthetic construct
  misc_feature 1..22: note = Description of Artificial Sequence: Syntheticoligonucleotide
  source 1..22: mol_type = other DNA
ccgactcacatgtgagtcggtc

SEQ ID NO: 7438 - DNA, 22 bp, synthetic construct
  misc_feature 1..22: note = Description of Artificial Sequence: Syntheticoligonucleotide
  source 1..22: mol_type = other DNA
acgactcacatgtgagtcgtgc

SEQ ID NO: 7439 - DNA, 22 bp, synthetic construct
  misc_feature 1..22: note = Description of Artificial Sequence: Syntheticoligonucleotide
  source 1..22: mol_type = other DNA
cagactcacatgtgagtctggc

SEQ ID NO: 7440 - DNA, 22 bp, synthetic construct
  misc_feature 1..22: note = Description of Artificial Sequence: Syntheticoligonucleotide
  source 1..22: mol_type = other DNA
ccgactcacatgtgagtcggga

SEQ ID NO: 7441 - DNA, 22 bp, synthetic construct
  misc_feature 1..22: note = Description of Artificial Sequence: Syntheticoligonucleotide
  source 1..22: mol_type = other DNA
ccgactcacatgtgagtcggac

SEQ ID NO: 7442 - DNA, 22 bp, synthetic construct
  misc_feature 1..22: note = Description of Artificial Sequence: Syntheticoligonucleotide
  source 1..22: mol_type = other DNA
ctgactcacatgtgagtcaggc

SEQ ID NO: 7443 - DNA, 22 bp, synthetic construct
  misc_feature 1..22: note = Description of Artificial Sequence: Syntheticoligonucleotide
  source 1..22: mol_type = other DNA
gcgactcacatgtgagtcgccc

SEQ ID NO: 7444 - DNA, 22 bp, synthetic construct
  misc_feature 1..22: note = Description of Artificial Sequence: Syntheticoligonucleotide
  source 1..22: mol_type = other DNA
gcgactcacatgtgagtcgcct

SEQ ID NO: 7445 - DNA, 22 bp, synthetic construct
  misc_feature 1..22: note = Description of Artificial Sequence: Syntheticoligonucleotide
  source 1..22: mol_type = other DNA
gcgactcacatgtgagtcgctc

SEQ ID NO: 7446 - DNA, 22 bp, synthetic construct
  misc_feature 1..22: note = Description of Artificial Sequence: Syntheticoligonucleotide
  source 1..22: mol_type = other DNA
acgactcacatgtgagtcgtcc

SEQ ID NO: 7447 - DNA, 22 bp, synthetic construct
  misc_feature 1..22: note = Description of Artificial Sequence: Syntheticoligonucleotide
  source 1..22: mol_type = other DNA
gagactcacatgtgagtctccc

SEQ ID NO: 7448 - DNA, 22 bp, synthetic construct
  misc_feature 1..22: note = Description of Artificial Sequence: Syntheticoligonucleotide
  source 1..22: mol_type = other DNA
gcgactcacatgtgagtcgcca

SEQ ID NO: 7449 - DNA, 22 bp, synthetic construct
  misc_feature 1..22: note = Description of Artificial Sequence: Syntheticoligonucleotide
  source 1..22: mol_type = other DNA
gcgactcacatgtgagtcgcac

SEQ ID NO: 7450 - DNA, 22 bp, synthetic construct
  misc_feature 1..22: note = Description of Artificial Sequence: Syntheticoligonucleotide
  source 1..22: mol_type = other DNA
gtgactcacatgtgagtcaccc

SEQ ID NO: 7451 - DNA, 22 bp, synthetic construct
  misc_feature 1..22: note = Description of Artificial Sequence: Syntheticoligonucleotide
  source 1..22: mol_type = other DNA
gggactcacatgtgagtcccgt

SEQ ID NO: 7452 - DNA, 22 bp, synthetic construct
  misc_feature 1..22: note = Description of Artificial Sequence: Syntheticoligonucleotide
  source 1..22: mol_type = other DNA
gggactcacatgtgagtccctg

SEQ ID NO: 7453 - DNA, 22 bp, synthetic construct
  misc_feature 1..22: note = Description of Artificial Sequence: Syntheticoligonucleotide
  source 1..22: mol_type = other DNA
aggactcacatgtgagtcctgg

SEQ ID NO: 7454 - DNA, 22 bp, synthetic construct
  misc_feature 1..22: note = Description of Artificial Sequence: Syntheticoligonucleotide
  source 1..22: mol_type = other DNA
gagactcacatgtgagtctcgg

SEQ ID NO: 7455 - DNA, 22 bp, synthetic construct
  misc_feature 1..22: note = Description of Artificial Sequence: Syntheticoligonucleotide
  source 1..22: mol_type = other DNA
gggactcacatgtgagtcccga

SEQ ID NO: 7456 - DNA, 22 bp, synthetic construct
  misc_feature 1..22: note = Description of Artificial Sequence: Syntheticoligonucleotide
  source 1..22: mol_type = other DNA
gggactcacatgtgagtcccag

SEQ ID NO: 7457 - DNA, 22 bp, synthetic construct
  misc_feature 1..22: note = Description of Artificial Sequence: Syntheticoligonucleotide
  source 1..22: mol_type = other DNA
tggactcacatgtgagtccagg

SEQ ID NO: 7458 - DNA, 22 bp, synthetic construct
  misc_feature 1..22: note = Description of Artificial Sequence: Syntheticoligonucleotide
  source 1..22: mol_type = other DNA
gtgactcacatgtgagtcacgg

SEQ ID NO: 7459 - DNA, 22 bp, synthetic construct
  misc_feature 1..22: note = Description of Artificial Sequence: Syntheticoligonucleotide
  source 1..22: mol_type = other DNA
gcgactcacatgtgagtcgccg

SEQ ID NO: 7460 - DNA, 22 bp, synthetic construct
  misc_feature 1..22: note = Description of Artificial Sequence: Syntheticoligonucleotide
  source 1..22: mol_type = other DNA
gcgactcacatgtgagtcgctg

SEQ ID NO: 7461 - DNA, 22 bp, synthetic construct
  misc_feature 1..22: note = Description of Artificial Sequence: Syntheticoligonucleotide
  source 1..22: mol_type = other DNA
acgactcacatgtgagtcgtcg

SEQ ID NO: 7462 - DNA, 22 bp, synthetic construct
  misc_feature 1..22: note = Description of Artificial Sequence: Syntheticoligonucleotide
  source 1..22: mol_type = other DNA
gagactcacatgtgagtctccg

SEQ ID NO: 7463 - DNA, 22 bp, synthetic construct
  misc_feature 1..22: note = Description of Artificial Sequence: Syntheticoligonucleotide
  source 1..22: mol_type = other DNA
gcgactcacatgtgagtcgcag

SEQ ID NO: 7464 - DNA, 22 bp, synthetic construct
  misc_feature 1..22: note = Description of Artificial Sequence: Syntheticoligonucleotide
  source 1..22: mol_type = other DNA
gtgactcacatgtgagtcaccg

SEQ ID NO: 7465 - DNA, 22 bp, synthetic construct
  misc_feature 1..22: note = Description of Artificial Sequence: Syntheticoligonucleotide
  source 1..22: mol_type = other DNA
cggactcacatgtgagtccgtg

SEQ ID NO: 7466 - DNA, 22 bp, synthetic construct
  misc_feature 1..22: note = Description of Artificial Sequence: Syntheticoligonucleotide
  source 1..22: mol_type = other DNA
cagactcacatgtgagtctggg

SEQ ID NO: 7467 - DNA, 22 bp, synthetic construct
  misc_feature 1..22: note = Description of Artificial Sequence: Syntheticoligonucleotide
  source 1..22: mol_type = other DNA
cggactcacatgtgagtccgag

SEQ ID NO: 7468 - DNA, 22 bp, synthetic construct
  misc_feature 1..22: note = Description of Artificial Sequence: Syntheticoligonucleotide
  source 1..22: mol_type = other DNA
ctgactcacatgtgagtcaggg

SEQ ID NO: 7469 - DNA, 22 bp, synthetic construct
  misc_feature 1..22: note = Description of Artificial Sequence: Syntheticoligonucleotide
  source 1..22: mol_type = other DNA
acgactcacatgtgagtcgtgg

SEQ ID NO: 7470 - DNA, 22 bp, synthetic construct
  misc_feature 1..22: note = Description of Artificial Sequence: Syntheticoligonucleotide
  source 1..22: mol_type = other DNA
ccgactcacatgtgagtcggct

SEQ ID NO: 7471 - DNA, 22 bp, synthetic construct
  misc_feature 1..22: note = Description of Artificial Sequence: Syntheticoligonucleotide
  source 1..22: mol_type = other DNA
ccgactcacatgtgagtcggca

SEQ ID NO: 7472 - DNA, 22 bp, synthetic construct
  misc_feature 1..22: note = Description of Artificial Sequence: Syntheticoligonucleotide
  source 1..22: mol_type = other DNA
gagactcacatgtgagtctcgc

SEQ ID NO: 7473 - DNA, 22 bp, synthetic construct
  misc_feature 1..22: note = Description of Artificial Sequence: Syntheticoligonucleotide
  source 1..22: mol_type = other DNA
gtgactcacatgtgagtcacgc

SEQ ID NO: 7474 - DNA, 22 bp, synthetic construct
  misc_feature 1..22: note = Description of Artificial Sequence: Syntheticoligonucleotide
  source 1..22: mol_type = other DNA
aggactcacatgtgagtcctgc

SEQ ID NO: 7475 - DNA, 22 bp, synthetic construct
  misc_feature 1..22: note = Description of Artificial Sequence: Syntheticoligonucleotide
  source 1..22: mol_type = other DNA
tggactcacatgtgagtccagc

SEQ ID NO: 7476 - DNA, 22 bp, synthetic construct
  misc_feature 1..22: note = Description of Artificial Sequence: Syntheticoligonucleotide
  source 1..22: mol_type = other DNA
aggactcacatgtgagtcctcg

SEQ ID NO: 7477 - DNA, 22 bp, synthetic construct
  misc_feature 1..22: note = Description of Artificial Sequence: Syntheticoligonucleotide
  source 1..22: mol_type = other DNA
tggactcacatgtgagtccacg

SEQ ID NO: 7478 - DNA, 22 bp, synthetic construct
  misc_feature 1..22: note = Description of Artificial Sequence: Syntheticoligonucleotide
  source 1..22: mol_type = other DNA
ccgactcacatgtgagtcggtg

SEQ ID NO: 7479 - DNA, 22 bp, synthetic construct
  misc_feature 1..22: note = Description of Artificial Sequence: Syntheticoligonucleotide
  source 1..22: mol_type = other DNA
ccgactcacatgtgagtcggag

SEQ ID NO: 7480 - DNA, 22 bp, synthetic construct
  misc_feature 1..22: note = Description of Artificial Sequence: Syntheticoligonucleotide
  source 1..22: mol_type = other DNA
gggactcacatgtgagtcccgc

SEQ ID NO: 7481 - DNA, 22 bp, synthetic construct
  misc_feature 1..22: note = Description of Artificial Sequence: Syntheticoligonucleotide
  source 1..22: mol_type = other DNA
gggactcacatgtgagtccctc

SEQ ID NO: 7482 - DNA, 22 bp, synthetic construct
  misc_feature 1..22: note = Description of Artificial Sequence: Syntheticoligonucleotide
  source 1..22: mol_type = other DNA
gggactcacatgtgagtcccac

SEQ ID NO: 7483 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcactagtgagtcnnnn

SEQ ID NO: 7484 - DNA, 22 bp, synthetic construct
  misc_feature 1..22: note = Description of Artificial Sequence: Syntheticoligonucleotide
  source 1..22: mol_type = other DNA
cggactcactagtgagtccgcc

SEQ ID NO: 7485 - DNA, 22 bp, synthetic construct
  misc_feature 1..22: note = Description of Artificial Sequence: Syntheticoligonucleotide
  source 1..22: mol_type = other DNA
cggactcactagtgagtccgct

SEQ ID NO: 7486 - DNA, 22 bp, synthetic construct
  misc_feature 1..22: note = Description of Artificial Sequence: Syntheticoligonucleotide
  source 1..22: mol_type = other DNA
cggactcactagtgagtccgtc

SEQ ID NO: 7487 - DNA, 22 bp, synthetic construct
  misc_feature 1..22: note = Description of Artificial Sequence: Syntheticoligonucleotide
  source 1..22: mol_type = other DNA
aggactcactagtgagtcctcc

SEQ ID NO: 7488 - DNA, 22 bp, synthetic construct
  misc_feature 1..22: note = Description of Artificial Sequence: Syntheticoligonucleotide
  source 1..22: mol_type = other DNA
cagactcactagtgagtctgcc

SEQ ID NO: 7489 - DNA, 22 bp, synthetic construct
  misc_feature 1..22: note = Description of Artificial Sequence: Syntheticoligonucleotide
  source 1..22: mol_type = other DNA
cggactcactagtgagtccgca

SEQ ID NO: 7490 - DNA, 22 bp, synthetic construct
  misc_feature 1..22: note = Description of Artificial Sequence: Syntheticoligonucleotide
  source 1..22: mol_type = other DNA
cggactcactagtgagtccgac

SEQ ID NO: 7491 - DNA, 22 bp, synthetic construct
  misc_feature 1..22: note = Description of Artificial Sequence: Syntheticoligonucleotide
  source 1..22: mol_type = other DNA
tggactcactagtgagtccacc

SEQ ID NO: 7492 - DNA, 22 bp, synthetic construct
  misc_feature 1..22: note = Description of Artificial Sequence: Syntheticoligonucleotide
  source 1..22: mol_type = other DNA
ctgactcactagtgagtcagcc

SEQ ID NO: 7493 - DNA, 22 bp, synthetic construct
  misc_feature 1..22: note = Description of Artificial Sequence: Syntheticoligonucleotide
  source 1..22: mol_type = other DNA
ccgactcactagtgagtcgggc

SEQ ID NO: 7494 - DNA, 22 bp, synthetic construct
  misc_feature 1..22: note = Description of Artificial Sequence: Syntheticoligonucleotide
  source 1..22: mol_type = other DNA
ccgactcactagtgagtcgggt

SEQ ID NO: 7495 - DNA, 22 bp, synthetic construct
  misc_feature 1..22: note = Description of Artificial Sequence: Syntheticoligonucleotide
  source 1..22: mol_type = other DNA
ccgactcactagtgagtcggtc

SEQ ID NO: 7496 - DNA, 22 bp, synthetic construct
  misc_feature 1..22: note = Description of Artificial Sequence: Syntheticoligonucleotide
  source 1..22: mol_type = other DNA
acgactcactagtgagtcgtgc

SEQ ID NO: 7497 - DNA, 22 bp, synthetic construct
  misc_feature 1..22: note = Description of Artificial Sequence: Syntheticoligonucleotide
  source 1..22: mol_type = other DNA
cagactcactagtgagtctggc

SEQ ID NO: 7498 - DNA, 22 bp, synthetic construct
  misc_feature 1..22: note = Description of Artificial Sequence: Syntheticoligonucleotide
  source 1..22: mol_type = other DNA
ccgactcactagtgagtcggga

SEQ ID NO: 7499 - DNA, 22 bp, synthetic construct
  misc_feature 1..22: note = Description of Artificial Sequence: Syntheticoligonucleotide
  source 1..22: mol_type = other DNA
ccgactcactagtgagtcggac

SEQ ID NO: 7500 - DNA, 22 bp, synthetic construct
  misc_feature 1..22: note = Description of Artificial Sequence: Syntheticoligonucleotide
  source 1..22: mol_type = other DNA
ctgactcactagtgagtcaggc

SEQ ID NO: 7501 - DNA, 22 bp, synthetic construct
  misc_feature 1..22: note = Description of Artificial Sequence: Syntheticoligonucleotide
  source 1..22: mol_type = other DNA
gcgactcactagtgagtcgccc

SEQ ID NO: 7502 - DNA, 22 bp, synthetic construct
  misc_feature 1..22: note = Description of Artificial Sequence: Syntheticoligonucleotide
  source 1..22: mol_type = other DNA
gcgactcactagtgagtcgcct

SEQ ID NO: 7503 - DNA, 22 bp, synthetic construct
  misc_feature 1..22: note = Description of Artificial Sequence: Syntheticoligonucleotide
  source 1..22: mol_type = other DNA
gcgactcactagtgagtcgctc

SEQ ID NO: 7504 - DNA, 22 bp, synthetic construct
  misc_feature 1..22: note = Description of Artificial Sequence: Syntheticoligonucleotide
  source 1..22: mol_type = other DNA
acgactcactagtgagtcgtcc

SEQ ID NO: 7505 - DNA, 22 bp, synthetic construct
  misc_feature 1..22: note = Description of Artificial Sequence: Syntheticoligonucleotide
  source 1..22: mol_type = other DNA
gagactcactagtgagtctccc

SEQ ID NO: 7506 - DNA, 22 bp, synthetic construct
  misc_feature 1..22: note = Description of Artificial Sequence: Syntheticoligonucleotide
  source 1..22: mol_type = other DNA
gcgactcactagtgagtcgcca

SEQ ID NO: 7507 - DNA, 22 bp, synthetic construct
  misc_feature 1..22: note = Description of Artificial Sequence: Syntheticoligonucleotide
  source 1..22: mol_type = other DNA
gcgactcactagtgagtcgcac

SEQ ID NO: 7508 - DNA, 22 bp, synthetic construct
  misc_feature 1..22: note = Description of Artificial Sequence: Syntheticoligonucleotide
  source 1..22: mol_type = other DNA
gtgactcactagtgagtcaccc

SEQ ID NO: 7509 - DNA, 22 bp, synthetic construct
  misc_feature 1..22: note = Description of Artificial Sequence: Syntheticoligonucleotide
  source 1..22: mol_type = other DNA
gggactcactagtgagtcccgt

SEQ ID NO: 7510 - DNA, 22 bp, synthetic construct
  misc_feature 1..22: note = Description of Artificial Sequence: Syntheticoligonucleotide
  source 1..22: mol_type = other DNA
gggactcactagtgagtccctg

SEQ ID NO: 7511 - DNA, 22 bp, synthetic construct
  misc_feature 1..22: note = Description of Artificial Sequence: Syntheticoligonucleotide
  source 1..22: mol_type = other DNA
aggactcactagtgagtcctgg

SEQ ID NO: 7512 - DNA, 22 bp, synthetic construct
  misc_feature 1..22: note = Description of Artificial Sequence: Syntheticoligonucleotide
  source 1..22: mol_type = other DNA
gagactcactagtgagtctcgg

SEQ ID NO: 7513 - DNA, 22 bp, synthetic construct
  misc_feature 1..22: note = Description of Artificial Sequence: Syntheticoligonucleotide
  source 1..22: mol_type = other DNA
gggactcactagtgagtcccga

SEQ ID NO: 7514 - DNA, 22 bp, synthetic construct
  misc_feature 1..22: note = Description of Artificial Sequence: Syntheticoligonucleotide
  source 1..22: mol_type = other DNA
gggactcactagtgagtcccag

SEQ ID NO: 7515 - DNA, 22 bp, synthetic construct
  misc_feature 1..22: note = Description of Artificial Sequence: Syntheticoligonucleotide
  source 1..22: mol_type = other DNA
tggactcactagtgagtccagg

SEQ ID NO: 7516 - DNA, 22 bp, synthetic construct
  misc_feature 1..22: note = Description of Artificial Sequence: Syntheticoligonucleotide
  source 1..22: mol_type = other DNA
gtgactcactagtgagtcacgg

SEQ ID NO: 7517 - DNA, 22 bp, synthetic construct
  misc_feature 1..22: note = Description of Artificial Sequence: Syntheticoligonucleotide
  source 1..22: mol_type = other DNA
gcgactcactagtgagtcgccg

SEQ ID NO: 7518 - DNA, 22 bp, synthetic construct
  misc_feature 1..22: note = Description of Artificial Sequence: Syntheticoligonucleotide
  source 1..22: mol_type = other DNA
gcgactcactagtgagtcgctg

SEQ ID NO: 7519 - DNA, 22 bp, synthetic construct
  misc_feature 1..22: note = Description of Artificial Sequence: Syntheticoligonucleotide
  source 1..22: mol_type = other DNA
acgactcactagtgagtcgtcg

SEQ ID NO: 7520 - DNA, 22 bp, synthetic construct
  misc_feature 1..22: note = Description of Artificial Sequence: Syntheticoligonucleotide
  source 1..22: mol_type = other DNA
gagactcactagtgagtctccg

SEQ ID NO: 7521 - DNA, 22 bp, synthetic construct
  misc_feature 1..22: note = Description of Artificial Sequence: Syntheticoligonucleotide
  source 1..22: mol_type = other DNA
gcgactcactagtgagtcgcag

SEQ ID NO: 7522 - DNA, 22 bp, synthetic construct
  misc_feature 1..22: note = Description of Artificial Sequence: Syntheticoligonucleotide
  source 1..22: mol_type = other DNA
gtgactcactagtgagtcaccg

SEQ ID NO: 7523 - DNA, 22 bp, synthetic construct
  misc_feature 1..22: note = Description of Artificial Sequence: Syntheticoligonucleotide
  source 1..22: mol_type = other DNA
cggactcactagtgagtccgtg

SEQ ID NO: 7524 - DNA, 22 bp, synthetic construct
  misc_feature 1..22: note = Description of Artificial Sequence: Syntheticoligonucleotide
  source 1..22: mol_type = other DNA
cagactcactagtgagtctggg

SEQ ID NO: 7525 - DNA, 22 bp, synthetic construct
  misc_feature 1..22: note = Description of Artificial Sequence: Syntheticoligonucleotide
  source 1..22: mol_type = other DNA
cggactcactagtgagtccgag

SEQ ID NO: 7526 - DNA, 22 bp, synthetic construct
  misc_feature 1..22: note = Description of Artificial Sequence: Syntheticoligonucleotide
  source 1..22: mol_type = other DNA
ctgactcactagtgagtcaggg

SEQ ID NO: 7527 - DNA, 22 bp, synthetic construct
  misc_feature 1..22: note = Description of Artificial Sequence: Syntheticoligonucleotide
  source 1..22: mol_type = other DNA
acgactcactagtgagtcgtgg

SEQ ID NO: 7528 - DNA, 22 bp, synthetic construct
  misc_feature 1..22: note = Description of Artificial Sequence: Syntheticoligonucleotide
  source 1..22: mol_type = other DNA
ccgactcactagtgagtcggct

SEQ ID NO: 7529 - DNA, 22 bp, synthetic construct
  misc_feature 1..22: note = Description of Artificial Sequence: Syntheticoligonucleotide
  source 1..22: mol_type = other DNA
ccgactcactagtgagtcggca

SEQ ID NO: 7530 - DNA, 22 bp, synthetic construct
  misc_feature 1..22: note = Description of Artificial Sequence: Syntheticoligonucleotide
  source 1..22: mol_type = other DNA
gagactcactagtgagtctcgc

SEQ ID NO: 7531 - DNA, 22 bp, synthetic construct
  misc_feature 1..22: note = Description of Artificial Sequence: Syntheticoligonucleotide
  source 1..22: mol_type = other DNA
gtgactcactagtgagtcacgc

SEQ ID NO: 7532 - DNA, 22 bp, synthetic construct
  misc_feature 1..22: note = Description of Artificial Sequence: Syntheticoligonucleotide
  source 1..22: mol_type = other DNA
aggactcactagtgagtcctgc

SEQ ID NO: 7533 - DNA, 22 bp, synthetic construct
  misc_feature 1..22: note = Description of Artificial Sequence: Syntheticoligonucleotide
  source 1..22: mol_type = other DNA
tggactcactagtgagtccagc

SEQ ID NO: 7534 - DNA, 22 bp, synthetic construct
  misc_feature 1..22: note = Description of Artificial Sequence: Syntheticoligonucleotide
  source 1..22: mol_type = other DNA
aggactcactagtgagtcctcg

SEQ ID NO: 7535 - DNA, 22 bp, synthetic construct
  misc_feature 1..22: note = Description of Artificial Sequence: Syntheticoligonucleotide
  source 1..22: mol_type = other DNA
tggactcactagtgagtccacg

SEQ ID NO: 7536 - DNA, 22 bp, synthetic construct
  misc_feature 1..22: note = Description of Artificial Sequence: Syntheticoligonucleotide
  source 1..22: mol_type = other DNA
ccgactcactagtgagtcggtg

SEQ ID NO: 7537 - DNA, 22 bp, synthetic construct
  misc_feature 1..22: note = Description of Artificial Sequence: Syntheticoligonucleotide
  source 1..22: mol_type = other DNA
ccgactcactagtgagtcggag

SEQ ID NO: 7538 - DNA, 22 bp, synthetic construct
  misc_feature 1..22: note = Description of Artificial Sequence: Syntheticoligonucleotide
  source 1..22: mol_type = other DNA
gggactcactagtgagtcccgc

SEQ ID NO: 7539 - DNA, 22 bp, synthetic construct
  misc_feature 1..22: note = Description of Artificial Sequence: Syntheticoligonucleotide
  source 1..22: mol_type = other DNA
gggactcactagtgagtccctc

SEQ ID NO: 7540 - DNA, 22 bp, synthetic construct
  misc_feature 1..22: note = Description of Artificial Sequence: Syntheticoligonucleotide
  source 1..22: mol_type = other DNA
gggactcactagtgagtcccac

SEQ ID NO: 7541 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcacgcgtgagtcnnnn

SEQ ID NO: 7542 - DNA, 22 bp, synthetic construct
  misc_feature 1..22: note = Description of Artificial Sequence: Syntheticoligonucleotide
  source 1..22: mol_type = other DNA
cggactcacgcgtgagtccgcc

SEQ ID NO: 7543 - DNA, 22 bp, synthetic construct
  misc_feature 1..22: note = Description of Artificial Sequence: Syntheticoligonucleotide
  source 1..22: mol_type = other DNA
cggactcacgcgtgagtccgct

SEQ ID NO: 7544 - DNA, 22 bp, synthetic construct
  misc_feature 1..22: note = Description of Artificial Sequence: Syntheticoligonucleotide
  source 1..22: mol_type = other DNA
cggactcacgcgtgagtccgtc

SEQ ID NO: 7545 - DNA, 22 bp, synthetic construct
  misc_feature 1..22: note = Description of Artificial Sequence: Syntheticoligonucleotide
  source 1..22: mol_type = other DNA
aggactcacgcgtgagtcctcc

SEQ ID NO: 7546 - DNA, 22 bp, synthetic construct
  misc_feature 1..22: note = Description of Artificial Sequence: Syntheticoligonucleotide
  source 1..22: mol_type = other DNA
cagactcacgcgtgagtctgcc

SEQ ID NO: 7547 - DNA, 22 bp, synthetic construct
  misc_feature 1..22: note = Description of Artificial Sequence: Syntheticoligonucleotide
  source 1..22: mol_type = other DNA
cggactcacgcgtgagtccgca

SEQ ID NO: 7548 - DNA, 22 bp, synthetic construct
  misc_feature 1..22: note = Description of Artificial Sequence: Syntheticoligonucleotide
  source 1..22: mol_type = other DNA
cggactcacgcgtgagtccgac

SEQ ID NO: 7549 - DNA, 22 bp, synthetic construct
  misc_feature 1..22: note = Description of Artificial Sequence: Syntheticoligonucleotide
  source 1..22: mol_type = other DNA
tggactcacgcgtgagtccacc

SEQ ID NO: 7550 - DNA, 22 bp, synthetic construct
  misc_feature 1..22: note = Description of Artificial Sequence: Syntheticoligonucleotide
  source 1..22: mol_type = other DNA
ctgactcacgcgtgagtcagcc

SEQ ID NO: 7551 - DNA, 22 bp, synthetic construct
  misc_feature 1..22: note = Description of Artificial Sequence: Syntheticoligonucleotide
  source 1..22: mol_type = other DNA
ccgactcacgcgtgagtcgggc

SEQ ID NO: 7552 - DNA, 22 bp, synthetic construct
  misc_feature 1..22: note = Description of Artificial Sequence: Syntheticoligonucleotide
  source 1..22: mol_type = other DNA
ccgactcacgcgtgagtcgggt

SEQ ID NO: 7553 - DNA, 22 bp, synthetic construct
  misc_feature 1..22: note = Description of Artificial Sequence: Syntheticoligonucleotide
  source 1..22: mol_type = other DNA
ccgactcacgcgtgagtcggtc

SEQ ID NO: 7554 - DNA, 22 bp, synthetic construct
  misc_feature 1..22: note = Description of Artificial Sequence: Syntheticoligonucleotide
  source 1..22: mol_type = other DNA
acgactcacgcgtgagtcgtgc

SEQ ID NO: 7555 - DNA, 22 bp, synthetic construct
  misc_feature 1..22: note = Description of Artificial Sequence: Syntheticoligonucleotide
  source 1..22: mol_type = other DNA
cagactcacgcgtgagtctggc

SEQ ID NO: 7556 - DNA, 22 bp, synthetic construct
  misc_feature 1..22: note = Description of Artificial Sequence: Syntheticoligonucleotide
  source 1..22: mol_type = other DNA
ccgactcacgcgtgagtcggga

SEQ ID NO: 7557 - DNA, 22 bp, synthetic construct
  misc_feature 1..22: note = Description of Artificial Sequence: Syntheticoligonucleotide
  source 1..22: mol_type = other DNA
ccgactcacgcgtgagtcggac

SEQ ID NO: 7558 - DNA, 22 bp, synthetic construct
  misc_feature 1..22: note = Description of Artificial Sequence: Syntheticoligonucleotide
  source 1..22: mol_type = other DNA
ctgactcacgcgtgagtcaggc

SEQ ID NO: 7559 - DNA, 22 bp, synthetic construct
  misc_feature 1..22: note = Description of Artificial Sequence: Syntheticoligonucleotide
  source 1..22: mol_type = other DNA
gcgactcacgcgtgagtcgccc

SEQ ID NO: 7560 - DNA, 22 bp, synthetic construct
  misc_feature 1..22: note = Description of Artificial Sequence: Syntheticoligonucleotide
  source 1..22: mol_type = other DNA
gcgactcacgcgtgagtcgcct

SEQ ID NO: 7561 - DNA, 22 bp, synthetic construct
  misc_feature 1..22: note = Description of Artificial Sequence: Syntheticoligonucleotide
  source 1..22: mol_type = other DNA
gcgactcacgcgtgagtcgctc

SEQ ID NO: 7562 - DNA, 22 bp, synthetic construct
  misc_feature 1..22: note = Description of Artificial Sequence: Syntheticoligonucleotide
  source 1..22: mol_type = other DNA
acgactcacgcgtgagtcgtcc

SEQ ID NO: 7563 - DNA, 22 bp, synthetic construct
  misc_feature 1..22: note = Description of Artificial Sequence: Syntheticoligonucleotide
  source 1..22: mol_type = other DNA
gagactcacgcgtgagtctccc

SEQ ID NO: 7564 - DNA, 22 bp, synthetic construct
  misc_feature 1..22: note = Description of Artificial Sequence: Syntheticoligonucleotide
  source 1..22: mol_type = other DNA
gcgactcacgcgtgagtcgcca

SEQ ID NO: 7565 - DNA, 22 bp, synthetic construct
  misc_feature 1..22: note = Description of Artificial Sequence: Syntheticoligonucleotide
  source 1..22: mol_type = other DNA
gcgactcacgcgtgagtcgcac

SEQ ID NO: 7566 - DNA, 22 bp, synthetic construct
  misc_feature 1..22: note = Description of Artificial Sequence: Syntheticoligonucleotide
  source 1..22: mol_type = other DNA
gtgactcacgcgtgagtcaccc

SEQ ID NO: 7567 - DNA, 22 bp, synthetic construct
  misc_feature 1..22: note = Description of Artificial Sequence: Syntheticoligonucleotide
  source 1..22: mol_type = other DNA
gggactcacgcgtgagtcccgt

SEQ ID NO: 7568 - DNA, 22 bp, synthetic construct
  misc_feature 1..22: note = Description of Artificial Sequence: Syntheticoligonucleotide
  source 1..22: mol_type = other DNA
gggactcacgcgtgagtccctg

SEQ ID NO: 7569 - DNA, 22 bp, synthetic construct
  misc_feature 1..22: note = Description of Artificial Sequence: Syntheticoligonucleotide
  source 1..22: mol_type = other DNA
aggactcacgcgtgagtcctgg

SEQ ID NO: 7570 - DNA, 22 bp, synthetic construct
  misc_feature 1..22: note = Description of Artificial Sequence: Syntheticoligonucleotide
  source 1..22: mol_type = other DNA
gagactcacgcgtgagtctcgg

SEQ ID NO: 7571 - DNA, 22 bp, synthetic construct
  misc_feature 1..22: note = Description of Artificial Sequence: Syntheticoligonucleotide
  source 1..22: mol_type = other DNA
gggactcacgcgtgagtcccga

SEQ ID NO: 7572 - DNA, 22 bp, synthetic construct
  misc_feature 1..22: note = Description of Artificial Sequence: Syntheticoligonucleotide
  source 1..22: mol_type = other DNA
gggactcacgcgtgagtcccag

SEQ ID NO: 7573 - DNA, 22 bp, synthetic construct
  misc_feature 1..22: note = Description of Artificial Sequence: Syntheticoligonucleotide
  source 1..22: mol_type = other DNA
tggactcacgcgtgagtccagg

SEQ ID NO: 7574 - DNA, 22 bp, synthetic construct
  misc_feature 1..22: note = Description of Artificial Sequence: Syntheticoligonucleotide
  source 1..22: mol_type = other DNA
gtgactcacgcgtgagtcacgg

SEQ ID NO: 7575 - DNA, 22 bp, synthetic construct
  misc_feature 1..22: note = Description of Artificial Sequence: Syntheticoligonucleotide
  source 1..22: mol_type = other DNA
gcgactcacgcgtgagtcgccg

SEQ ID NO: 7576 - DNA, 22 bp, synthetic construct
  misc_feature 1..22: note = Description of Artificial Sequence: Syntheticoligonucleotide
  source 1..22: mol_type = other DNA
gcgactcacgcgtgagtcgctg

SEQ ID NO: 7577 - DNA, 22 bp, synthetic construct
  misc_feature 1..22: note = Description of Artificial Sequence: Syntheticoligonucleotide
  source 1..22: mol_type = other DNA
acgactcacgcgtgagtcgtcg

SEQ ID NO: 7578 - DNA, 22 bp, synthetic construct
  misc_feature 1..22: note = Description of Artificial Sequence: Syntheticoligonucleotide
  source 1..22: mol_type = other DNA
gagactcacgcgtgagtctccg

SEQ ID NO: 7579 - DNA, 22 bp, synthetic construct
  misc_feature 1..22: note = Description of Artificial Sequence: Syntheticoligonucleotide
  source 1..22: mol_type = other DNA
gcgactcacgcgtgagtcgcag

SEQ ID NO: 7580 - DNA, 22 bp, synthetic construct
  misc_feature 1..22: note = Description of Artificial Sequence: Syntheticoligonucleotide
  source 1..22: mol_type = other DNA
gtgactcacgcgtgagtcaccg

SEQ ID NO: 7581 - DNA, 22 bp, synthetic construct
  misc_feature 1..22: note = Description of Artificial Sequence: Syntheticoligonucleotide
  source 1..22: mol_type = other DNA
cggactcacgcgtgagtccgtg

SEQ ID NO: 7582 - DNA, 22 bp, synthetic construct
  misc_feature 1..22: note = Description of Artificial Sequence: Syntheticoligonucleotide
  source 1..22: mol_type = other DNA
cagactcacgcgtgagtctggg

SEQ ID NO: 7583 - DNA, 22 bp, synthetic construct
  misc_feature 1..22: note = Description of Artificial Sequence: Syntheticoligonucleotide
  source 1..22: mol_type = other DNA
cggactcacgcgtgagtccgag

SEQ ID NO: 7584 - DNA, 22 bp, synthetic construct
  misc_feature 1..22: note = Description of Artificial Sequence: Syntheticoligonucleotide
  source 1..22: mol_type = other DNA
ctgactcacgcgtgagtcaggg

SEQ ID NO: 7585 - DNA, 22 bp, synthetic construct
  misc_feature 1..22: note = Description of Artificial Sequence: Syntheticoligonucleotide
  source 1..22: mol_type = other DNA
acgactcacgcgtgagtcgtgg

SEQ ID NO: 7586 - DNA, 22 bp, synthetic construct
  misc_feature 1..22: note = Description of Artificial Sequence: Syntheticoligonucleotide
  source 1..22: mol_type = other DNA
ccgactcacgcgtgagtcggct

SEQ ID NO: 7587 - DNA, 22 bp, synthetic construct
  misc_feature 1..22: note = Description of Artificial Sequence: Syntheticoligonucleotide
  source 1..22: mol_type = other DNA
ccgactcacgcgtgagtcggca

SEQ ID NO: 7588 - DNA, 22 bp, synthetic construct
  misc_feature 1..22: note = Description of Artificial Sequence: Syntheticoligonucleotide
  source 1..22: mol_type = other DNA
gagactcacgcgtgagtctcgc

SEQ ID NO: 7589 - DNA, 22 bp, synthetic construct
  misc_feature 1..22: note = Description of Artificial Sequence: Syntheticoligonucleotide
  source 1..22: mol_type = other DNA
gtgactcacgcgtgagtcacgc

SEQ ID NO: 7590 - DNA, 22 bp, synthetic construct
  misc_feature 1..22: note = Description of Artificial Sequence: Syntheticoligonucleotide
  source 1..22: mol_type = other DNA
aggactcacgcgtgagtcctgc

SEQ ID NO: 7591 - DNA, 22 bp, synthetic construct
  misc_feature 1..22: note = Description of Artificial Sequence: Syntheticoligonucleotide
  source 1..22: mol_type = other DNA
tggactcacgcgtgagtccagc

SEQ ID NO: 7592 - DNA, 22 bp, synthetic construct
  misc_feature 1..22: note = Description of Artificial Sequence: Syntheticoligonucleotide
  source 1..22: mol_type = other DNA
aggactcacgcgtgagtcctcg

SEQ ID NO: 7593 - DNA, 22 bp, synthetic construct
  misc_feature 1..22: note = Description of Artificial Sequence: Syntheticoligonucleotide
  source 1..22: mol_type = other DNA
tggactcacgcgtgagtccacg

SEQ ID NO: 7594 - DNA, 22 bp, synthetic construct
  misc_feature 1..22: note = Description of Artificial Sequence: Syntheticoligonucleotide
  source 1..22: mol_type = other DNA
ccgactcacgcgtgagtcggtg

SEQ ID NO: 7595 - DNA, 22 bp, synthetic construct
  misc_feature 1..22: note = Description of Artificial Sequence: Syntheticoligonucleotide
  source 1..22: mol_type = other DNA
ccgactcacgcgtgagtcggag

SEQ ID NO: 7596 - DNA, 22 bp, synthetic construct
  misc_feature 1..22: note = Description of Artificial Sequence: Syntheticoligonucleotide
  source 1..22: mol_type = other DNA
gggactcacgcgtgagtcccgc

SEQ ID NO: 7597 - DNA, 22 bp, synthetic construct
  misc_feature 1..22: note = Description of Artificial Sequence: Syntheticoligonucleotide
  source 1..22: mol_type = other DNA
gggactcacgcgtgagtccctc

SEQ ID NO: 7598 - DNA, 22 bp, synthetic construct
  misc_feature 1..22: note = Description of Artificial Sequence: Syntheticoligonucleotide
  source 1..22: mol_type = other DNA
gggactcacgcgtgagtcccac

SEQ ID NO: 7599 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcaccggtgagtcnnnn

SEQ ID NO: 7600 - DNA, 22 bp, synthetic construct
  misc_feature 1..22: note = Description of Artificial Sequence: Syntheticoligonucleotide
  source 1..22: mol_type = other DNA
cggactcaccggtgagtccgcc

SEQ ID NO: 7601 - DNA, 22 bp, synthetic construct
  misc_feature 1..22: note = Description of Artificial Sequence: Syntheticoligonucleotide
  source 1..22: mol_type = other DNA
cggactcaccggtgagtccgct

SEQ ID NO: 7602 - DNA, 22 bp, synthetic construct
  misc_feature 1..22: note = Description of Artificial Sequence: Syntheticoligonucleotide
  source 1..22: mol_type = other DNA
cggactcaccggtgagtccgtc

SEQ ID NO: 7603 - DNA, 22 bp, synthetic construct
  misc_feature 1..22: note = Description of Artificial Sequence: Syntheticoligonucleotide
  source 1..22: mol_type = other DNA
aggactcaccggtgagtcctcc

SEQ ID NO: 7604 - DNA, 22 bp, synthetic construct
  misc_feature 1..22: note = Description of Artificial Sequence: Syntheticoligonucleotide
  source 1..22: mol_type = other DNA
cagactcaccggtgagtctgcc

SEQ ID NO: 7605 - DNA, 22 bp, synthetic construct
  misc_feature 1..22: note = Description of Artificial Sequence: Syntheticoligonucleotide
  source 1..22: mol_type = other DNA
cggactcaccggtgagtccgca

SEQ ID NO: 7606 - DNA, 22 bp, synthetic construct
  misc_feature 1..22: note = Description of Artificial Sequence: Syntheticoligonucleotide
  source 1..22: mol_type = other DNA
cggactcaccggtgagtccgac

SEQ ID NO: 7607 - DNA, 22 bp, synthetic construct
  misc_feature 1..22: note = Description of Artificial Sequence: Syntheticoligonucleotide
  source 1..22: mol_type = other DNA
tggactcaccggtgagtccacc

SEQ ID NO: 7608 - DNA, 22 bp, synthetic construct
  misc_feature 1..22: note = Description of Artificial Sequence: Syntheticoligonucleotide
  source 1..22: mol_type = other DNA
ctgactcaccggtgagtcagcc

SEQ ID NO: 7609 - DNA, 22 bp, synthetic construct
  misc_feature 1..22: note = Description of Artificial Sequence: Syntheticoligonucleotide
  source 1..22: mol_type = other DNA
ccgactcaccggtgagtcgggc

SEQ ID NO: 7610 - DNA, 22 bp, synthetic construct
  misc_feature 1..22: note = Description of Artificial Sequence: Syntheticoligonucleotide
  source 1..22: mol_type = other DNA
ccgactcaccggtgagtcgggt

SEQ ID NO: 7611 - DNA, 22 bp, synthetic construct
  misc_feature 1..22: note = Description of Artificial Sequence: Syntheticoligonucleotide
  source 1..22: mol_type = other DNA
ccgactcaccggtgagtcggtc

SEQ ID NO: 7612 - DNA, 22 bp, synthetic construct
  misc_feature 1..22: note = Description of Artificial Sequence: Syntheticoligonucleotide
  source 1..22: mol_type = other DNA
acgactcaccggtgagtcgtgc

SEQ ID NO: 7613 - DNA, 22 bp, synthetic construct
  misc_feature 1..22: note = Description of Artificial Sequence: Syntheticoligonucleotide
  source 1..22: mol_type = other DNA
cagactcaccggtgagtctggc

SEQ ID NO: 7614 - DNA, 22 bp, synthetic construct
  misc_feature 1..22: note = Description of Artificial Sequence: Syntheticoligonucleotide
  source 1..22: mol_type = other DNA
ccgactcaccggtgagtcggga

SEQ ID NO: 7615 - DNA, 22 bp, synthetic construct
  misc_feature 1..22: note = Description of Artificial Sequence: Syntheticoligonucleotide
  source 1..22: mol_type = other DNA
ccgactcaccggtgagtcggac

SEQ ID NO: 7616 - DNA, 22 bp, synthetic construct
  misc_feature 1..22: note = Description of Artificial Sequence: Syntheticoligonucleotide
  source 1..22: mol_type = other DNA
ctgactcaccggtgagtcaggc

SEQ ID NO: 7617 - DNA, 22 bp, synthetic construct
  misc_feature 1..22: note = Description of Artificial Sequence: Syntheticoligonucleotide
  source 1..22: mol_type = other DNA
gcgactcaccggtgagtcgccc

SEQ ID NO: 7618 - DNA, 22 bp, synthetic construct
  misc_feature 1..22: note = Description of Artificial Sequence: Syntheticoligonucleotide
  source 1..22: mol_type = other DNA
gcgactcaccggtgagtcgcct

SEQ ID NO: 7619 - DNA, 22 bp, synthetic construct
  misc_feature 1..22: note = Description of Artificial Sequence: Syntheticoligonucleotide
  source 1..22: mol_type = other DNA
gcgactcaccggtgagtcgctc

SEQ ID NO: 7620 - DNA, 22 bp, synthetic construct
  misc_feature 1..22: note = Description of Artificial Sequence: Syntheticoligonucleotide
  source 1..22: mol_type = other DNA
acgactcaccggtgagtcgtcc

SEQ ID NO: 7621 - DNA, 22 bp, synthetic construct
  misc_feature 1..22: note = Description of Artificial Sequence: Syntheticoligonucleotide
  source 1..22: mol_type = other DNA
gagactcaccggtgagtctccc

SEQ ID NO: 7622 - DNA, 22 bp, synthetic construct
  misc_feature 1..22: note = Description of Artificial Sequence: Syntheticoligonucleotide
  source 1..22: mol_type = other DNA
gcgactcaccggtgagtcgcca

SEQ ID NO: 7623 - DNA, 22 bp, synthetic construct
  misc_feature 1..22: note = Description of Artificial Sequence: Syntheticoligonucleotide
  source 1..22: mol_type = other DNA
gcgactcaccggtgagtcgcac

SEQ ID NO: 7624 - DNA, 22 bp, synthetic construct
  misc_feature 1..22: note = Description of Artificial Sequence: Syntheticoligonucleotide
  source 1..22: mol_type = other DNA
gtgactcaccggtgagtcaccc

SEQ ID NO: 7625 - DNA, 22 bp, synthetic construct
  misc_feature 1..22: note = Description of Artificial Sequence: Syntheticoligonucleotide
  source 1..22: mol_type = other DNA
gggactcaccggtgagtcccgt

SEQ ID NO: 7626 - DNA, 22 bp, synthetic construct
  misc_feature 1..22: note = Description of Artificial Sequence: Syntheticoligonucleotide
  source 1..22: mol_type = other DNA
gggactcaccggtgagtccctg

SEQ ID NO: 7627 - DNA, 22 bp, synthetic construct
  misc_feature 1..22: note = Description of Artificial Sequence: Syntheticoligonucleotide
  source 1..22: mol_type = other DNA
aggactcaccggtgagtcctgg

SEQ ID NO: 7628 - DNA, 22 bp, synthetic construct
  misc_feature 1..22: note = Description of Artificial Sequence: Syntheticoligonucleotide
  source 1..22: mol_type = other DNA
gagactcaccggtgagtctcgg

SEQ ID NO: 7629 - DNA, 22 bp, synthetic construct
  misc_feature 1..22: note = Description of Artificial Sequence: Syntheticoligonucleotide
  source 1..22: mol_type = other DNA
gggactcaccggtgagtcccga

SEQ ID NO: 7630 - DNA, 22 bp, synthetic construct
  misc_feature 1..22: note = Description of Artificial Sequence: Syntheticoligonucleotide
  source 1..22: mol_type = other DNA
gggactcaccggtgagtcccag

SEQ ID NO: 7631 - DNA, 22 bp, synthetic construct
  misc_feature 1..22: note = Description of Artificial Sequence: Syntheticoligonucleotide
  source 1..22: mol_type = other DNA
tggactcaccggtgagtccagg

SEQ ID NO: 7632 - DNA, 22 bp, synthetic construct
  misc_feature 1..22: note = Description of Artificial Sequence: Syntheticoligonucleotide
  source 1..22: mol_type = other DNA
gtgactcaccggtgagtcacgg

SEQ ID NO: 7633 - DNA, 22 bp, synthetic construct
  misc_feature 1..22: note = Description of Artificial Sequence: Syntheticoligonucleotide
  source 1..22: mol_type = other DNA
gcgactcaccggtgagtcgccg

SEQ ID NO: 7634 - DNA, 22 bp, synthetic construct
  misc_feature 1..22: note = Description of Artificial Sequence: Syntheticoligonucleotide
  source 1..22: mol_type = other DNA
gcgactcaccggtgagtcgctg

SEQ ID NO: 7635 - DNA, 22 bp, synthetic construct
  misc_feature 1..22: note = Description of Artificial Sequence: Syntheticoligonucleotide
  source 1..22: mol_type = other DNA
acgactcaccggtgagtcgtcg

SEQ ID NO: 7636 - DNA, 22 bp, synthetic construct
  misc_feature 1..22: note = Description of Artificial Sequence: Syntheticoligonucleotide
  source 1..22: mol_type = other DNA
gagactcaccggtgagtctccg

SEQ ID NO: 7637 - DNA, 22 bp, synthetic construct
  misc_feature 1..22: note = Description of Artificial Sequence: Syntheticoligonucleotide
  source 1..22: mol_type = other DNA
gcgactcaccggtgagtcgcag

SEQ ID NO: 7638 - DNA, 22 bp, synthetic construct
  misc_feature 1..22: note = Description of Artificial Sequence: Syntheticoligonucleotide
  source 1..22: mol_type = other DNA
gtgactcaccggtgagtcaccg

SEQ ID NO: 7639 - DNA, 22 bp, synthetic construct
  misc_feature 1..22: note = Description of Artificial Sequence: Syntheticoligonucleotide
  source 1..22: mol_type = other DNA
cggactcaccggtgagtccgtg

SEQ ID NO: 7640 - DNA, 22 bp, synthetic construct
  misc_feature 1..22: note = Description of Artificial Sequence: Syntheticoligonucleotide
  source 1..22: mol_type = other DNA
cagactcaccggtgagtctggg

SEQ ID NO: 7641 - DNA, 22 bp, synthetic construct
  misc_feature 1..22: note = Description of Artificial Sequence: Syntheticoligonucleotide
  source 1..22: mol_type = other DNA
cggactcaccggtgagtccgag

SEQ ID NO: 7642 - DNA, 22 bp, synthetic construct
  misc_feature 1..22: note = Description of Artificial Sequence: Syntheticoligonucleotide
  source 1..22: mol_type = other DNA
ctgactcaccggtgagtcaggg

SEQ ID NO: 7643 - DNA, 22 bp, synthetic construct
  misc_feature 1..22: note = Description of Artificial Sequence: Syntheticoligonucleotide
  source 1..22: mol_type = other DNA
acgactcaccggtgagtcgtgg

SEQ ID NO: 7644 - DNA, 22 bp, synthetic construct
  misc_feature 1..22: note = Description of Artificial Sequence: Syntheticoligonucleotide
  source 1..22: mol_type = other DNA
ccgactcaccggtgagtcggct

SEQ ID NO: 7645 - DNA, 22 bp, synthetic construct
  misc_feature 1..22: note = Description of Artificial Sequence: Syntheticoligonucleotide
  source 1..22: mol_type = other DNA
ccgactcaccggtgagtcggca

SEQ ID NO: 7646 - DNA, 22 bp, synthetic construct
  misc_feature 1..22: note = Description of Artificial Sequence: Syntheticoligonucleotide
  source 1..22: mol_type = other DNA
gagactcaccggtgagtctcgc

SEQ ID NO: 7647 - DNA, 22 bp, synthetic construct
  misc_feature 1..22: note = Description of Artificial Sequence: Syntheticoligonucleotide
  source 1..22: mol_type = other DNA
gtgactcaccggtgagtcacgc

SEQ ID NO: 7648 - DNA, 22 bp, synthetic construct
  misc_feature 1..22: note = Description of Artificial Sequence: Syntheticoligonucleotide
  source 1..22: mol_type = other DNA
aggactcaccggtgagtcctgc

SEQ ID NO: 7649 - DNA, 22 bp, synthetic construct
  misc_feature 1..22: note = Description of Artificial Sequence: Syntheticoligonucleotide
  source 1..22: mol_type = other DNA
tggactcaccggtgagtccagc

SEQ ID NO: 7650 - DNA, 22 bp, synthetic construct
  misc_feature 1..22: note = Description of Artificial Sequence: Syntheticoligonucleotide
  source 1..22: mol_type = other DNA
aggactcaccggtgagtcctcg

SEQ ID NO: 7651 - DNA, 22 bp, synthetic construct
  misc_feature 1..22: note = Description of Artificial Sequence: Syntheticoligonucleotide
  source 1..22: mol_type = other DNA
tggactcaccggtgagtccacg

SEQ ID NO: 7652 - DNA, 22 bp, synthetic construct
  misc_feature 1..22: note = Description of Artificial Sequence: Syntheticoligonucleotide
  source 1..22: mol_type = other DNA
ccgactcaccggtgagtcggtg

SEQ ID NO: 7653 - DNA, 22 bp, synthetic construct
  misc_feature 1..22: note = Description of Artificial Sequence: Syntheticoligonucleotide
  source 1..22: mol_type = other DNA
ccgactcaccggtgagtcggag

SEQ ID NO: 7654 - DNA, 22 bp, synthetic construct
  misc_feature 1..22: note = Description of Artificial Sequence: Syntheticoligonucleotide
  source 1..22: mol_type = other DNA
gggactcaccggtgagtcccgc

SEQ ID NO: 7655 - DNA, 22 bp, synthetic construct
  misc_feature 1..22: note = Description of Artificial Sequence: Syntheticoligonucleotide
  source 1..22: mol_type = other DNA
gggactcaccggtgagtccctc

SEQ ID NO: 7656 - DNA, 22 bp, synthetic construct
  misc_feature 1..22: note = Description of Artificial Sequence: Syntheticoligonucleotide
  source 1..22: mol_type = other DNA
gggactcaccggtgagtcccac

SEQ ID NO: 7657 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcggatccgagtcnnnn

SEQ ID NO: 7658 - DNA, 22 bp, synthetic construct
  misc_feature 1..22: note = Description of Artificial Sequence: Syntheticoligonucleotide
  source 1..22: mol_type = other DNA
cggactcggatccgagtccgcc

SEQ ID NO: 7659 - DNA, 22 bp, synthetic construct
  misc_feature 1..22: note = Description of Artificial Sequence: Syntheticoligonucleotide
  source 1..22: mol_type = other DNA
cggactcggatccgagtccgct

SEQ ID NO: 7660 - DNA, 22 bp, synthetic construct
  misc_feature 1..22: note = Description of Artificial Sequence: Syntheticoligonucleotide
  source 1..22: mol_type = other DNA
cggactcggatccgagtccgtc

SEQ ID NO: 7661 - DNA, 22 bp, synthetic construct
  misc_feature 1..22: note = Description of Artificial Sequence: Syntheticoligonucleotide
  source 1..22: mol_type = other DNA
aggactcggatccgagtcctcc

SEQ ID NO: 7662 - DNA, 22 bp, synthetic construct
  misc_feature 1..22: note = Description of Artificial Sequence: Syntheticoligonucleotide
  source 1..22: mol_type = other DNA
cagactcggatccgagtctgcc

SEQ ID NO: 7663 - DNA, 22 bp, synthetic construct
  misc_feature 1..22: note = Description of Artificial Sequence: Syntheticoligonucleotide
  source 1..22: mol_type = other DNA
cggactcggatccgagtccgca

SEQ ID NO: 7664 - DNA, 22 bp, synthetic construct
  misc_feature 1..22: note = Description of Artificial Sequence: Syntheticoligonucleotide
  source 1..22: mol_type = other DNA
cggactcggatccgagtccgac

SEQ ID NO: 7665 - DNA, 22 bp, synthetic construct
  misc_feature 1..22: note = Description of Artificial Sequence: Syntheticoligonucleotide
  source 1..22: mol_type = other DNA
tggactcggatccgagtccacc

SEQ ID NO: 7666 - DNA, 22 bp, synthetic construct
  misc_feature 1..22: note = Description of Artificial Sequence: Syntheticoligonucleotide
  source 1..22: mol_type = other DNA
ctgactcggatccgagtcagcc

SEQ ID NO: 7667 - DNA, 22 bp, synthetic construct
  misc_feature 1..22: note = Description of Artificial Sequence: Syntheticoligonucleotide
  source 1..22: mol_type = other DNA
ccgactcggatccgagtcgggc

SEQ ID NO: 7668 - DNA, 22 bp, synthetic construct
  misc_feature 1..22: note = Description of Artificial Sequence: Syntheticoligonucleotide
  source 1..22: mol_type = other DNA
ccgactcggatccgagtcgggt

SEQ ID NO: 7669 - DNA, 22 bp, synthetic construct
  misc_feature 1..22: note = Description of Artificial Sequence: Syntheticoligonucleotide
  source 1..22: mol_type = other DNA
ccgactcggatccgagtcggtc

SEQ ID NO: 7670 - DNA, 22 bp, synthetic construct
  misc_feature 1..22: note = Description of Artificial Sequence: Syntheticoligonucleotide
  source 1..22: mol_type = other DNA
acgactcggatccgagtcgtgc

SEQ ID NO: 7671 - DNA, 22 bp, synthetic construct
  misc_feature 1..22: note = Description of Artificial Sequence: Syntheticoligonucleotide
  source 1..22: mol_type = other DNA
cagactcggatccgagtctggc

SEQ ID NO: 7672 - DNA, 22 bp, synthetic construct
  misc_feature 1..22: note = Description of Artificial Sequence: Syntheticoligonucleotide
  source 1..22: mol_type = other DNA
ccgactcggatccgagtcggga

SEQ ID NO: 7673 - DNA, 22 bp, synthetic construct
  misc_feature 1..22: note = Description of Artificial Sequence: Syntheticoligonucleotide
  source 1..22: mol_type = other DNA
ccgactcggatccgagtcggac

SEQ ID NO: 7674 - DNA, 22 bp, synthetic construct
  misc_feature 1..22: note = Description of Artificial Sequence: Syntheticoligonucleotide
  source 1..22: mol_type = other DNA
ctgactcggatccgagtcaggc

SEQ ID NO: 7675 - DNA, 22 bp, synthetic construct
  misc_feature 1..22: note = Description of Artificial Sequence: Syntheticoligonucleotide
  source 1..22: mol_type = other DNA
gcgactcggatccgagtcgccc

SEQ ID NO: 7676 - DNA, 22 bp, synthetic construct
  misc_feature 1..22: note = Description of Artificial Sequence: Syntheticoligonucleotide
  source 1..22: mol_type = other DNA
gcgactcggatccgagtcgcct

SEQ ID NO: 7677 - DNA, 22 bp, synthetic construct
  misc_feature 1..22: note = Description of Artificial Sequence: Syntheticoligonucleotide
  source 1..22: mol_type = other DNA
gcgactcggatccgagtcgctc

SEQ ID NO: 7678 - DNA, 22 bp, synthetic construct
  misc_feature 1..22: note = Description of Artificial Sequence: Syntheticoligonucleotide
  source 1..22: mol_type = other DNA
acgactcggatccgagtcgtcc

SEQ ID NO: 7679 - DNA, 22 bp, synthetic construct
  misc_feature 1..22: note = Description of Artificial Sequence: Syntheticoligonucleotide
  source 1..22: mol_type = other DNA
gagactcggatccgagtctccc

SEQ ID NO: 7680 - DNA, 22 bp, synthetic construct
  misc_feature 1..22: note = Description of Artificial Sequence: Syntheticoligonucleotide
  source 1..22: mol_type = other DNA
gcgactcggatccgagtcgcca

SEQ ID NO: 7681 - DNA, 22 bp, synthetic construct
  misc_feature 1..22: note = Description of Artificial Sequence: Syntheticoligonucleotide
  source 1..22: mol_type = other DNA
gcgactcggatccgagtcgcac

SEQ ID NO: 7682 - DNA, 22 bp, synthetic construct
  misc_feature 1..22: note = Description of Artificial Sequence: Syntheticoligonucleotide
  source 1..22: mol_type = other DNA
gtgactcggatccgagtcaccc

SEQ ID NO: 7683 - DNA, 22 bp, synthetic construct
  misc_feature 1..22: note = Description of Artificial Sequence: Syntheticoligonucleotide
  source 1..22: mol_type = other DNA
gggactcggatccgagtcccgt

SEQ ID NO: 7684 - DNA, 22 bp, synthetic construct
  misc_feature 1..22: note = Description of Artificial Sequence: Syntheticoligonucleotide
  source 1..22: mol_type = other DNA
gggactcggatccgagtccctg

SEQ ID NO: 7685 - DNA, 22 bp, synthetic construct
  misc_feature 1..22: note = Description of Artificial Sequence: Syntheticoligonucleotide
  source 1..22: mol_type = other DNA
aggactcggatccgagtcctgg

SEQ ID NO: 7686 - DNA, 22 bp, synthetic construct
  misc_feature 1..22: note = Description of Artificial Sequence: Syntheticoligonucleotide
  source 1..22: mol_type = other DNA
gagactcggatccgagtctcgg

SEQ ID NO: 7687 - DNA, 22 bp, synthetic construct
  misc_feature 1..22: note = Description of Artificial Sequence: Syntheticoligonucleotide
  source 1..22: mol_type = other DNA
gggactcggatccgagtcccga

SEQ ID NO: 7688 - DNA, 22 bp, synthetic construct
  misc_feature 1..22: note = Description of Artificial Sequence: Syntheticoligonucleotide
  source 1..22: mol_type = other DNA
gggactcggatccgagtcccag

SEQ ID NO: 7689 - DNA, 22 bp, synthetic construct
  misc_feature 1..22: note = Description of Artificial Sequence: Syntheticoligonucleotide
  source 1..22: mol_type = other DNA
tggactcggatccgagtccagg

SEQ ID NO: 7690 - DNA, 22 bp, synthetic construct
  misc_feature 1..22: note = Description of Artificial Sequence: Syntheticoligonucleotide
  source 1..22: mol_type = other DNA
gtgactcggatccgagtcacgg

SEQ ID NO: 7691 - DNA, 22 bp, synthetic construct
  misc_feature 1..22: note = Description of Artificial Sequence: Syntheticoligonucleotide
  source 1..22: mol_type = other DNA
gcgactcggatccgagtcgccg

SEQ ID NO: 7692 - DNA, 22 bp, synthetic construct
  misc_feature 1..22: note = Description of Artificial Sequence: Syntheticoligonucleotide
  source 1..22: mol_type = other DNA
gcgactcggatccgagtcgctg

SEQ ID NO: 7693 - DNA, 22 bp, synthetic construct
  misc_feature 1..22: note = Description of Artificial Sequence: Syntheticoligonucleotide
  source 1..22: mol_type = other DNA
acgactcggatccgagtcgtcg

SEQ ID NO: 7694 - DNA, 22 bp, synthetic construct
  misc_feature 1..22: note = Description of Artificial Sequence: Syntheticoligonucleotide
  source 1..22: mol_type = other DNA
gagactcggatccgagtctccg

SEQ ID NO: 7695 - DNA, 22 bp, synthetic construct
  misc_feature 1..22: note = Description of Artificial Sequence: Syntheticoligonucleotide
  source 1..22: mol_type = other DNA
gcgactcggatccgagtcgcag

SEQ ID NO: 7696 - DNA, 22 bp, synthetic construct
  misc_feature 1..22: note = Description of Artificial Sequence: Syntheticoligonucleotide
  source 1..22: mol_type = other DNA
gtgactcggatccgagtcaccg

SEQ ID NO: 7697 - DNA, 22 bp, synthetic construct
  misc_feature 1..22: note = Description of Artificial Sequence: Syntheticoligonucleotide
  source 1..22: mol_type = other DNA
cggactcggatccgagtccgtg

SEQ ID NO: 7698 - DNA, 22 bp, synthetic construct
  misc_feature 1..22: note = Description of Artificial Sequence: Syntheticoligonucleotide
  source 1..22: mol_type = other DNA
cagactcggatccgagtctggg

SEQ ID NO: 7699 - DNA, 22 bp, synthetic construct
  misc_feature 1..22: note = Description of Artificial Sequence: Syntheticoligonucleotide
  source 1..22: mol_type = other DNA
cggactcggatccgagtccgag

SEQ ID NO: 7700 - DNA, 22 bp, synthetic construct
  misc_feature 1..22: note = Description of Artificial Sequence: Syntheticoligonucleotide
  source 1..22: mol_type = other DNA
ctgactcggatccgagtcaggg

SEQ ID NO: 7701 - DNA, 22 bp, synthetic construct
  misc_feature 1..22: note = Description of Artificial Sequence: Syntheticoligonucleotide
  source 1..22: mol_type = other DNA
acgactcggatccgagtcgtgg

SEQ ID NO: 7702 - DNA, 22 bp, synthetic construct
  misc_feature 1..22: note = Description of Artificial Sequence: Syntheticoligonucleotide
  source 1..22: mol_type = other DNA
ccgactcggatccgagtcggct

SEQ ID NO: 7703 - DNA, 22 bp, synthetic construct
  misc_feature 1..22: note = Description of Artificial Sequence: Syntheticoligonucleotide
  source 1..22: mol_type = other DNA
ccgactcggatccgagtcggca

SEQ ID NO: 7704 - DNA, 22 bp, synthetic construct
  misc_feature 1..22: note = Description of Artificial Sequence: Syntheticoligonucleotide
  source 1..22: mol_type = other DNA
gagactcggatccgagtctcgc

SEQ ID NO: 7705 - DNA, 22 bp, synthetic construct
  misc_feature 1..22: note = Description of Artificial Sequence: Syntheticoligonucleotide
  source 1..22: mol_type = other DNA
gtgactcggatccgagtcacgc

SEQ ID NO: 7706 - DNA, 22 bp, synthetic construct
  misc_feature 1..22: note = Description of Artificial Sequence: Syntheticoligonucleotide
  source 1..22: mol_type = other DNA
aggactcggatccgagtcctgc

SEQ ID NO: 7707 - DNA, 22 bp, synthetic construct
  misc_feature 1..22: note = Description of Artificial Sequence: Syntheticoligonucleotide
  source 1..22: mol_type = other DNA
tggactcggatccgagtccagc

SEQ ID NO: 7708 - DNA, 22 bp, synthetic construct
  misc_feature 1..22: note = Description of Artificial Sequence: Syntheticoligonucleotide
  source 1..22: mol_type = other DNA
aggactcggatccgagtcctcg

SEQ ID NO: 7709 - DNA, 22 bp, synthetic construct
  misc_feature 1..22: note = Description of Artificial Sequence: Syntheticoligonucleotide
  source 1..22: mol_type = other DNA
tggactcggatccgagtccacg

SEQ ID NO: 7710 - DNA, 22 bp, synthetic construct
  misc_feature 1..22: note = Description of Artificial Sequence: Syntheticoligonucleotide
  source 1..22: mol_type = other DNA
ccgactcggatccgagtcggtg

SEQ ID NO: 7711 - DNA, 22 bp, synthetic construct
  misc_feature 1..22: note = Description of Artificial Sequence: Syntheticoligonucleotide
  source 1..22: mol_type = other DNA
ccgactcggatccgagtcggag

SEQ ID NO: 7712 - DNA, 22 bp, synthetic construct
  misc_feature 1..22: note = Description of Artificial Sequence: Syntheticoligonucleotide
  source 1..22: mol_type = other DNA
gggactcggatccgagtcccgc

SEQ ID NO: 7713 - DNA, 22 bp, synthetic construct
  misc_feature 1..22: note = Description of Artificial Sequence: Syntheticoligonucleotide
  source 1..22: mol_type = other DNA
gggactcggatccgagtccctc

SEQ ID NO: 7714 - DNA, 22 bp, synthetic construct
  misc_feature 1..22: note = Description of Artificial Sequence: Syntheticoligonucleotide
  source 1..22: mol_type = other DNA
gggactcggatccgagtcccac

SEQ ID NO: 7715 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcggtaccgagtcnnnn

SEQ ID NO: 7716 - DNA, 22 bp, synthetic construct
  misc_feature 1..22: note = Description of Artificial Sequence: Syntheticoligonucleotide
  source 1..22: mol_type = other DNA
cggactcggtaccgagtccgcc

SEQ ID NO: 7717 - DNA, 22 bp, synthetic construct
  misc_feature 1..22: note = Description of Artificial Sequence: Syntheticoligonucleotide
  source 1..22: mol_type = other DNA
cggactcggtaccgagtccgct

SEQ ID NO: 7718 - DNA, 22 bp, synthetic construct
  misc_feature 1..22: note = Description of Artificial Sequence: Syntheticoligonucleotide
  source 1..22: mol_type = other DNA
cggactcggtaccgagtccgtc

SEQ ID NO: 7719 - DNA, 22 bp, synthetic construct
  misc_feature 1..22: note = Description of Artificial Sequence: Syntheticoligonucleotide
  source 1..22: mol_type = other DNA
aggactcggtaccgagtcctcc

SEQ ID NO: 7720 - DNA, 22 bp, synthetic construct
  misc_feature 1..22: note = Description of Artificial Sequence: Syntheticoligonucleotide
  source 1..22: mol_type = other DNA
cagactcggtaccgagtctgcc

SEQ ID NO: 7721 - DNA, 22 bp, synthetic construct
  misc_feature 1..22: note = Description of Artificial Sequence: Syntheticoligonucleotide
  source 1..22: mol_type = other DNA
cggactcggtaccgagtccgca

SEQ ID NO: 7722 - DNA, 22 bp, synthetic construct
  misc_feature 1..22: note = Description of Artificial Sequence: Syntheticoligonucleotide
  source 1..22: mol_type = other DNA
cggactcggtaccgagtccgac

SEQ ID NO: 7723 - DNA, 22 bp, synthetic construct
  misc_feature 1..22: note = Description of Artificial Sequence: Syntheticoligonucleotide
  source 1..22: mol_type = other DNA
tggactcggtaccgagtccacc

SEQ ID NO: 7724 - DNA, 22 bp, synthetic construct
  misc_feature 1..22: note = Description of Artificial Sequence: Syntheticoligonucleotide
  source 1..22: mol_type = other DNA
ctgactcggtaccgagtcagcc

SEQ ID NO: 7725 - DNA, 22 bp, synthetic construct
  misc_feature 1..22: note = Description of Artificial Sequence: Syntheticoligonucleotide
  source 1..22: mol_type = other DNA
ccgactcggtaccgagtcgggc

SEQ ID NO: 7726 - DNA, 22 bp, synthetic construct
  misc_feature 1..22: note = Description of Artificial Sequence: Syntheticoligonucleotide
  source 1..22: mol_type = other DNA
ccgactcggtaccgagtcgggt

SEQ ID NO: 7727 - DNA, 22 bp, synthetic construct
  misc_feature 1..22: note = Description of Artificial Sequence: Syntheticoligonucleotide
  source 1..22: mol_type = other DNA
ccgactcggtaccgagtcggtc

SEQ ID NO: 7728 - DNA, 22 bp, synthetic construct
  misc_feature 1..22: note = Description of Artificial Sequence: Syntheticoligonucleotide
  source 1..22: mol_type = other DNA
acgactcggtaccgagtcgtgc

SEQ ID NO: 7729 - DNA, 22 bp, synthetic construct
  misc_feature 1..22: note = Description of Artificial Sequence: Syntheticoligonucleotide
  source 1..22: mol_type = other DNA
cagactcggtaccgagtctggc

SEQ ID NO: 7730 - DNA, 22 bp, synthetic construct
  misc_feature 1..22: note = Description of Artificial Sequence: Syntheticoligonucleotide
  source 1..22: mol_type = other DNA
ccgactcggtaccgagtcggga

SEQ ID NO: 7731 - DNA, 22 bp, synthetic construct
  misc_feature 1..22: note = Description of Artificial Sequence: Syntheticoligonucleotide
  source 1..22: mol_type = other DNA
ccgactcggtaccgagtcggac

SEQ ID NO: 7732 - DNA, 22 bp, synthetic construct
  misc_feature 1..22: note = Description of Artificial Sequence: Syntheticoligonucleotide
  source 1..22: mol_type = other DNA
ctgactcggtaccgagtcaggc

SEQ ID NO: 7733 - DNA, 22 bp, synthetic construct
  misc_feature 1..22: note = Description of Artificial Sequence: Syntheticoligonucleotide
  source 1..22: mol_type = other DNA
gcgactcggtaccgagtcgccc

SEQ ID NO: 7734 - DNA, 22 bp, synthetic construct
  misc_feature 1..22: note = Description of Artificial Sequence: Syntheticoligonucleotide
  source 1..22: mol_type = other DNA
gcgactcggtaccgagtcgcct

SEQ ID NO: 7735 - DNA, 22 bp, synthetic construct
  misc_feature 1..22: note = Description of Artificial Sequence: Syntheticoligonucleotide
  source 1..22: mol_type = other DNA
gcgactcggtaccgagtcgctc

SEQ ID NO: 7736 - DNA, 22 bp, synthetic construct
  misc_feature 1..22: note = Description of Artificial Sequence: Syntheticoligonucleotide
  source 1..22: mol_type = other DNA
acgactcggtaccgagtcgtcc

SEQ ID NO: 7737 - DNA, 22 bp, synthetic construct
  misc_feature 1..22: note = Description of Artificial Sequence: Syntheticoligonucleotide
  source 1..22: mol_type = other DNA
gagactcggtaccgagtctccc

SEQ ID NO: 7738 - DNA, 22 bp, synthetic construct
  misc_feature 1..22: note = Description of Artificial Sequence: Syntheticoligonucleotide
  source 1..22: mol_type = other DNA
gcgactcggtaccgagtcgcca

SEQ ID NO: 7739 - DNA, 22 bp, synthetic construct
  misc_feature 1..22: note = Description of Artificial Sequence: Syntheticoligonucleotide
  source 1..22: mol_type = other DNA
gcgactcggtaccgagtcgcac

SEQ ID NO: 7740 - DNA, 22 bp, synthetic construct
  misc_feature 1..22: note = Description of Artificial Sequence: Syntheticoligonucleotide
  source 1..22: mol_type = other DNA
gtgactcggtaccgagtcaccc

SEQ ID NO: 7741 - DNA, 22 bp, synthetic construct
  misc_feature 1..22: note = Description of Artificial Sequence: Syntheticoligonucleotide
  source 1..22: mol_type = other DNA
gggactcggtaccgagtcccgt

SEQ ID NO: 7742 - DNA, 22 bp, synthetic construct
  misc_feature 1..22: note = Description of Artificial Sequence: Syntheticoligonucleotide
  source 1..22: mol_type = other DNA
gggactcggtaccgagtccctg

SEQ ID NO: 7743 - DNA, 22 bp, synthetic construct
  misc_feature 1..22: note = Description of Artificial Sequence: Syntheticoligonucleotide
  source 1..22: mol_type = other DNA
aggactcggtaccgagtcctgg

SEQ ID NO: 7744 - DNA, 22 bp, synthetic construct
  misc_feature 1..22: note = Description of Artificial Sequence: Syntheticoligonucleotide
  source 1..22: mol_type = other DNA
gagactcggtaccgagtctcgg

SEQ ID NO: 7745 - DNA, 22 bp, synthetic construct
  misc_feature 1..22: note = Description of Artificial Sequence: Syntheticoligonucleotide
  source 1..22: mol_type = other DNA
gggactcggtaccgagtcccga

SEQ ID NO: 7746 - DNA, 22 bp, synthetic construct
  misc_feature 1..22: note = Description of Artificial Sequence: Syntheticoligonucleotide
  source 1..22: mol_type = other DNA
gggactcggtaccgagtcccag

SEQ ID NO: 7747 - DNA, 22 bp, synthetic construct
  misc_feature 1..22: note = Description of Artificial Sequence: Syntheticoligonucleotide
  source 1..22: mol_type = other DNA
tggactcggtaccgagtccagg

SEQ ID NO: 7748 - DNA, 22 bp, synthetic construct
  misc_feature 1..22: note = Description of Artificial Sequence: Syntheticoligonucleotide
  source 1..22: mol_type = other DNA
gtgactcggtaccgagtcacgg

SEQ ID NO: 7749 - DNA, 22 bp, synthetic construct
  misc_feature 1..22: note = Description of Artificial Sequence: Syntheticoligonucleotide
  source 1..22: mol_type = other DNA
gcgactcggtaccgagtcgccg

SEQ ID NO: 7750 - DNA, 22 bp, synthetic construct
  misc_feature 1..22: note = Description of Artificial Sequence: Syntheticoligonucleotide
  source 1..22: mol_type = other DNA
gcgactcggtaccgagtcgctg

SEQ ID NO: 7751 - DNA, 22 bp, synthetic construct
  misc_feature 1..22: note = Description of Artificial Sequence: Syntheticoligonucleotide
  source 1..22: mol_type = other DNA
acgactcggtaccgagtcgtcg

SEQ ID NO: 7752 - DNA, 22 bp, synthetic construct
  misc_feature 1..22: note = Description of Artificial Sequence: Syntheticoligonucleotide
  source 1..22: mol_type = other DNA
gagactcggtaccgagtctccg

SEQ ID NO: 7753 - DNA, 22 bp, synthetic construct
  misc_feature 1..22: note = Description of Artificial Sequence: Syntheticoligonucleotide
  source 1..22: mol_type = other DNA
gcgactcggtaccgagtcgcag

SEQ ID NO: 7754 - DNA, 22 bp, synthetic construct
  misc_feature 1..22: note = Description of Artificial Sequence: Syntheticoligonucleotide
  source 1..22: mol_type = other DNA
gtgactcggtaccgagtcaccg

SEQ ID NO: 7755 - DNA, 22 bp, synthetic construct
  misc_feature 1..22: note = Description of Artificial Sequence: Syntheticoligonucleotide
  source 1..22: mol_type = other DNA
cggactcggtaccgagtccgtg

SEQ ID NO: 7756 - DNA, 22 bp, synthetic construct
  misc_feature 1..22: note = Description of Artificial Sequence: Syntheticoligonucleotide
  source 1..22: mol_type = other DNA
cagactcggtaccgagtctggg

SEQ ID NO: 7757 - DNA, 22 bp, synthetic construct
  misc_feature 1..22: note = Description of Artificial Sequence: Syntheticoligonucleotide
  source 1..22: mol_type = other DNA
cggactcggtaccgagtccgag

SEQ ID NO: 7758 - DNA, 22 bp, synthetic construct
  misc_feature 1..22: note = Description of Artificial Sequence: Syntheticoligonucleotide
  source 1..22: mol_type = other DNA
ctgactcggtaccgagtcaggg

SEQ ID NO: 7759 - DNA, 22 bp, synthetic construct
  misc_feature 1..22: note = Description of Artificial Sequence: Syntheticoligonucleotide
  source 1..22: mol_type = other DNA
acgactcggtaccgagtcgtgg

SEQ ID NO: 7760 - DNA, 22 bp, synthetic construct
  misc_feature 1..22: note = Description of Artificial Sequence: Syntheticoligonucleotide
  source 1..22: mol_type = other DNA
ccgactcggtaccgagtcggct

SEQ ID NO: 7761 - DNA, 22 bp, synthetic construct
  misc_feature 1..22: note = Description of Artificial Sequence: Syntheticoligonucleotide
  source 1..22: mol_type = other DNA
ccgactcggtaccgagtcggca

SEQ ID NO: 7762 - DNA, 22 bp, synthetic construct
  misc_feature 1..22: note = Description of Artificial Sequence: Syntheticoligonucleotide
  source 1..22: mol_type = other DNA
gagactcggtaccgagtctcgc

SEQ ID NO: 7763 - DNA, 22 bp, synthetic construct
  misc_feature 1..22: note = Description of Artificial Sequence: Syntheticoligonucleotide
  source 1..22: mol_type = other DNA
gtgactcggtaccgagtcacgc

SEQ ID NO: 7764 - DNA, 22 bp, synthetic construct
  misc_feature 1..22: note = Description of Artificial Sequence: Syntheticoligonucleotide
  source 1..22: mol_type = other DNA
aggactcggtaccgagtcctgc

SEQ ID NO: 7765 - DNA, 22 bp, synthetic construct
  misc_feature 1..22: note = Description of Artificial Sequence: Syntheticoligonucleotide
  source 1..22: mol_type = other DNA
tggactcggtaccgagtccagc

SEQ ID NO: 7766 - DNA, 22 bp, synthetic construct
  misc_feature 1..22: note = Description of Artificial Sequence: Syntheticoligonucleotide
  source 1..22: mol_type = other DNA
aggactcggtaccgagtcctcg

SEQ ID NO: 7767 - DNA, 22 bp, synthetic construct
  misc_feature 1..22: note = Description of Artificial Sequence: Syntheticoligonucleotide
  source 1..22: mol_type = other DNA
tggactcggtaccgagtccacg

SEQ ID NO: 7768 - DNA, 22 bp, synthetic construct
  misc_feature 1..22: note = Description of Artificial Sequence: Syntheticoligonucleotide
  source 1..22: mol_type = other DNA
ccgactcggtaccgagtcggtg

SEQ ID NO: 7769 - DNA, 22 bp, synthetic construct
  misc_feature 1..22: note = Description of Artificial Sequence: Syntheticoligonucleotide
  source 1..22: mol_type = other DNA
ccgactcggtaccgagtcggag

SEQ ID NO: 7770 - DNA, 22 bp, synthetic construct
  misc_feature 1..22: note = Description of Artificial Sequence: Syntheticoligonucleotide
  source 1..22: mol_type = other DNA
gggactcggtaccgagtcccgc

SEQ ID NO: 7771 - DNA, 22 bp, synthetic construct
  misc_feature 1..22: note = Description of Artificial Sequence: Syntheticoligonucleotide
  source 1..22: mol_type = other DNA
gggactcggtaccgagtccctc

SEQ ID NO: 7772 - DNA, 22 bp, synthetic construct
  misc_feature 1..22: note = Description of Artificial Sequence: Syntheticoligonucleotide
  source 1..22: mol_type = other DNA
gggactcggtaccgagtcccac

SEQ ID NO: 7773 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcgggcccgagtcnnnn

SEQ ID NO: 7774 - DNA, 22 bp, synthetic construct
  misc_feature 1..22: note = Description of Artificial Sequence: Syntheticoligonucleotide
  source 1..22: mol_type = other DNA
cggactcgggcccgagtccgcc

SEQ ID NO: 7775 - DNA, 22 bp, synthetic construct
  misc_feature 1..22: note = Description of Artificial Sequence: Syntheticoligonucleotide
  source 1..22: mol_type = other DNA
cggactcgggcccgagtccgct

SEQ ID NO: 7776 - DNA, 22 bp, synthetic construct
  misc_feature 1..22: note = Description of Artificial Sequence: Syntheticoligonucleotide
  source 1..22: mol_type = other DNA
cggactcgggcccgagtccgtc

SEQ ID NO: 7777 - DNA, 22 bp, synthetic construct
  misc_feature 1..22: note = Description of Artificial Sequence: Syntheticoligonucleotide
  source 1..22: mol_type = other DNA
aggactcgggcccgagtcctcc

SEQ ID NO: 7778 - DNA, 22 bp, synthetic construct
  misc_feature 1..22: note = Description of Artificial Sequence: Syntheticoligonucleotide
  source 1..22: mol_type = other DNA
cagactcgggcccgagtctgcc

SEQ ID NO: 7779 - DNA, 22 bp, synthetic construct
  misc_feature 1..22: note = Description of Artificial Sequence: Syntheticoligonucleotide
  source 1..22: mol_type = other DNA
cggactcgggcccgagtccgca

SEQ ID NO: 7780 - DNA, 22 bp, synthetic construct
  misc_feature 1..22: note = Description of Artificial Sequence: Syntheticoligonucleotide
  source 1..22: mol_type = other DNA
cggactcgggcccgagtccgac

SEQ ID NO: 7781 - DNA, 22 bp, synthetic construct
  misc_feature 1..22: note = Description of Artificial Sequence: Syntheticoligonucleotide
  source 1..22: mol_type = other DNA
tggactcgggcccgagtccacc

SEQ ID NO: 7782 - DNA, 22 bp, synthetic construct
  misc_feature 1..22: note = Description of Artificial Sequence: Syntheticoligonucleotide
  source 1..22: mol_type = other DNA
ctgactcgggcccgagtcagcc

SEQ ID NO: 7783 - DNA, 22 bp, synthetic construct
  misc_feature 1..22: note = Description of Artificial Sequence: Syntheticoligonucleotide
  source 1..22: mol_type = other DNA
ccgactcgggcccgagtcgggc

SEQ ID NO: 7784 - DNA, 22 bp, synthetic construct
  misc_feature 1..22: note = Description of Artificial Sequence: Syntheticoligonucleotide
  source 1..22: mol_type = other DNA
ccgactcgggcccgagtcgggt

SEQ ID NO: 7785 - DNA, 22 bp, synthetic construct
  misc_feature 1..22: note = Description of Artificial Sequence: Syntheticoligonucleotide
  source 1..22: mol_type = other DNA
ccgactcgggcccgagtcggtc

SEQ ID NO: 7786 - DNA, 22 bp, synthetic construct
  misc_feature 1..22: note = Description of Artificial Sequence: Syntheticoligonucleotide
  source 1..22: mol_type = other DNA
acgactcgggcccgagtcgtgc

SEQ ID NO: 7787 - DNA, 22 bp, synthetic construct
  misc_feature 1..22: note = Description of Artificial Sequence: Syntheticoligonucleotide
  source 1..22: mol_type = other DNA
cagactcgggcccgagtctggc

SEQ ID NO: 7788 - DNA, 22 bp, synthetic construct
  misc_feature 1..22: note = Description of Artificial Sequence: Syntheticoligonucleotide
  source 1..22: mol_type = other DNA
ccgactcgggcccgagtcggga

SEQ ID NO: 7789 - DNA, 22 bp, synthetic construct
  misc_feature 1..22: note = Description of Artificial Sequence: Syntheticoligonucleotide
  source 1..22: mol_type = other DNA
ccgactcgggcccgagtcggac

SEQ ID NO: 7790 - DNA, 22 bp, synthetic construct
  misc_feature 1..22: note = Description of Artificial Sequence: Syntheticoligonucleotide
  source 1..22: mol_type = other DNA
ctgactcgggcccgagtcaggc

SEQ ID NO: 7791 - DNA, 22 bp, synthetic construct
  misc_feature 1..22: note = Description of Artificial Sequence: Syntheticoligonucleotide
  source 1..22: mol_type = other DNA
gcgactcgggcccgagtcgccc

SEQ ID NO: 7792 - DNA, 22 bp, synthetic construct
  misc_feature 1..22: note = Description of Artificial Sequence: Syntheticoligonucleotide
  source 1..22: mol_type = other DNA
gcgactcgggcccgagtcgcct

SEQ ID NO: 7793 - DNA, 22 bp, synthetic construct
  misc_feature 1..22: note = Description of Artificial Sequence: Syntheticoligonucleotide
  source 1..22: mol_type = other DNA
gcgactcgggcccgagtcgctc

SEQ ID NO: 7794 - DNA, 22 bp, synthetic construct
  misc_feature 1..22: note = Description of Artificial Sequence: Syntheticoligonucleotide
  source 1..22: mol_type = other DNA
acgactcgggcccgagtcgtcc

SEQ ID NO: 7795 - DNA, 22 bp, synthetic construct
  misc_feature 1..22: note = Description of Artificial Sequence: Syntheticoligonucleotide
  source 1..22: mol_type = other DNA
gagactcgggcccgagtctccc

SEQ ID NO: 7796 - DNA, 22 bp, synthetic construct
  misc_feature 1..22: note = Description of Artificial Sequence: Syntheticoligonucleotide
  source 1..22: mol_type = other DNA
gcgactcgggcccgagtcgcca

SEQ ID NO: 7797 - DNA, 22 bp, synthetic construct
  misc_feature 1..22: note = Description of Artificial Sequence: Syntheticoligonucleotide
  source 1..22: mol_type = other DNA
gcgactcgggcccgagtcgcac

SEQ ID NO: 7798 - DNA, 22 bp, synthetic construct
  misc_feature 1..22: note = Description of Artificial Sequence: Syntheticoligonucleotide
  source 1..22: mol_type = other DNA
gtgactcgggcccgagtcaccc

SEQ ID NO: 7799 - DNA, 22 bp, synthetic construct
  misc_feature 1..22: note = Description of Artificial Sequence: Syntheticoligonucleotide
  source 1..22: mol_type = other DNA
gggactcgggcccgagtcccgt

SEQ ID NO: 7800 - DNA, 22 bp, synthetic construct
  misc_feature 1..22: note = Description of Artificial Sequence: Syntheticoligonucleotide
  source 1..22: mol_type = other DNA
gggactcgggcccgagtccctg

SEQ ID NO: 7801 - DNA, 22 bp, synthetic construct
  misc_feature 1..22: note = Description of Artificial Sequence: Syntheticoligonucleotide
  source 1..22: mol_type = other DNA
aggactcgggcccgagtcctgg

SEQ ID NO: 7802 - DNA, 22 bp, synthetic construct
  misc_feature 1..22: note = Description of Artificial Sequence: Syntheticoligonucleotide
  source 1..22: mol_type = other DNA
gagactcgggcccgagtctcgg

SEQ ID NO: 7803 - DNA, 22 bp, synthetic construct
  misc_feature 1..22: note = Description of Artificial Sequence: Syntheticoligonucleotide
  source 1..22: mol_type = other DNA
gggactcgggcccgagtcccga

SEQ ID NO: 7804 - DNA, 22 bp, synthetic construct
  misc_feature 1..22: note = Description of Artificial Sequence: Syntheticoligonucleotide
  source 1..22: mol_type = other DNA
gggactcgggcccgagtcccag

SEQ ID NO: 7805 - DNA, 22 bp, synthetic construct
  misc_feature 1..22: note = Description of Artificial Sequence: Syntheticoligonucleotide
  source 1..22: mol_type = other DNA
tggactcgggcccgagtccagg

SEQ ID NO: 7806 - DNA, 22 bp, synthetic construct
  misc_feature 1..22: note = Description of Artificial Sequence: Syntheticoligonucleotide
  source 1..22: mol_type = other DNA
gtgactcgggcccgagtcacgg

SEQ ID NO: 7807 - DNA, 22 bp, synthetic construct
  misc_feature 1..22: note = Description of Artificial Sequence: Syntheticoligonucleotide
  source 1..22: mol_type = other DNA
gcgactcgggcccgagtcgccg

SEQ ID NO: 7808 - DNA, 22 bp, synthetic construct
  misc_feature 1..22: note = Description of Artificial Sequence: Syntheticoligonucleotide
  source 1..22: mol_type = other DNA
gcgactcgggcccgagtcgctg

SEQ ID NO: 7809 - DNA, 22 bp, synthetic construct
  misc_feature 1..22: note = Description of Artificial Sequence: Syntheticoligonucleotide
  source 1..22: mol_type = other DNA
acgactcgggcccgagtcgtcg

SEQ ID NO: 7810 - DNA, 22 bp, synthetic construct
  misc_feature 1..22: note = Description of Artificial Sequence: Syntheticoligonucleotide
  source 1..22: mol_type = other DNA
gagactcgggcccgagtctccg

SEQ ID NO: 7811 - DNA, 22 bp, synthetic construct
  misc_feature 1..22: note = Description of Artificial Sequence: Syntheticoligonucleotide
  source 1..22: mol_type = other DNA
gcgactcgggcccgagtcgcag

SEQ ID NO: 7812 - DNA, 22 bp, synthetic construct
  misc_feature 1..22: note = Description of Artificial Sequence: Syntheticoligonucleotide
  source 1..22: mol_type = other DNA
gtgactcgggcccgagtcaccg

SEQ ID NO: 7813 - DNA, 22 bp, synthetic construct
  misc_feature 1..22: note = Description of Artificial Sequence: Syntheticoligonucleotide
  source 1..22: mol_type = other DNA
cggactcgggcccgagtccgtg

SEQ ID NO: 7814 - DNA, 22 bp, synthetic construct
  misc_feature 1..22: note = Description of Artificial Sequence: Syntheticoligonucleotide
  source 1..22: mol_type = other DNA
cagactcgggcccgagtctggg

SEQ ID NO: 7815 - DNA, 22 bp, synthetic construct
  misc_feature 1..22: note = Description of Artificial Sequence: Syntheticoligonucleotide
  source 1..22: mol_type = other DNA
cggactcgggcccgagtccgag

SEQ ID NO: 7816 - DNA, 22 bp, synthetic construct
  misc_feature 1..22: note = Description of Artificial Sequence: Syntheticoligonucleotide
  source 1..22: mol_type = other DNA
ctgactcgggcccgagtcaggg

SEQ ID NO: 7817 - DNA, 22 bp, synthetic construct
  misc_feature 1..22: note = Description of Artificial Sequence: Syntheticoligonucleotide
  source 1..22: mol_type = other DNA
acgactcgggcccgagtcgtgg

SEQ ID NO: 7818 - DNA, 22 bp, synthetic construct
  misc_feature 1..22: note = Description of Artificial Sequence: Syntheticoligonucleotide
  source 1..22: mol_type = other DNA
ccgactcgggcccgagtcggct

SEQ ID NO: 7819 - DNA, 22 bp, synthetic construct
  misc_feature 1..22: note = Description of Artificial Sequence: Syntheticoligonucleotide
  source 1..22: mol_type = other DNA
ccgactcgggcccgagtcggca

SEQ ID NO: 7820 - DNA, 22 bp, synthetic construct
  misc_feature 1..22: note = Description of Artificial Sequence: Syntheticoligonucleotide
  source 1..22: mol_type = other DNA
gagactcgggcccgagtctcgc

SEQ ID NO: 7821 - DNA, 22 bp, synthetic construct
  misc_feature 1..22: note = Description of Artificial Sequence: Syntheticoligonucleotide
  source 1..22: mol_type = other DNA
gtgactcgggcccgagtcacgc

SEQ ID NO: 7822 - DNA, 22 bp, synthetic construct
  misc_feature 1..22: note = Description of Artificial Sequence: Syntheticoligonucleotide
  source 1..22: mol_type = other DNA
aggactcgggcccgagtcctgc

SEQ ID NO: 7823 - DNA, 22 bp, synthetic construct
  misc_feature 1..22: note = Description of Artificial Sequence: Syntheticoligonucleotide
  source 1..22: mol_type = other DNA
tggactcgggcccgagtccagc

SEQ ID NO: 7824 - DNA, 22 bp, synthetic construct
  misc_feature 1..22: note = Description of Artificial Sequence: Syntheticoligonucleotide
  source 1..22: mol_type = other DNA
aggactcgggcccgagtcctcg

SEQ ID NO: 7825 - DNA, 22 bp, synthetic construct
  misc_feature 1..22: note = Description of Artificial Sequence: Syntheticoligonucleotide
  source 1..22: mol_type = other DNA
tggactcgggcccgagtccacg

SEQ ID NO: 7826 - DNA, 22 bp, synthetic construct
  misc_feature 1..22: note = Description of Artificial Sequence: Syntheticoligonucleotide
  source 1..22: mol_type = other DNA
ccgactcgggcccgagtcggtg

SEQ ID NO: 7827 - DNA, 22 bp, synthetic construct
  misc_feature 1..22: note = Description of Artificial Sequence: Syntheticoligonucleotide
  source 1..22: mol_type = other DNA
ccgactcgggcccgagtcggag

SEQ ID NO: 7828 - DNA, 22 bp, synthetic construct
  misc_feature 1..22: note = Description of Artificial Sequence: Syntheticoligonucleotide
  source 1..22: mol_type = other DNA
gggactcgggcccgagtcccgc

SEQ ID NO: 7829 - DNA, 22 bp, synthetic construct
  misc_feature 1..22: note = Description of Artificial Sequence: Syntheticoligonucleotide
  source 1..22: mol_type = other DNA
gggactcgggcccgagtccctc

SEQ ID NO: 7830 - DNA, 22 bp, synthetic construct
  misc_feature 1..22: note = Description of Artificial Sequence: Syntheticoligonucleotide
  source 1..22: mol_type = other DNA
gggactcgggcccgagtcccac

SEQ ID NO: 7831 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcggcgccgagtcnnnn

SEQ ID NO: 7832 - DNA, 22 bp, synthetic construct
  misc_feature 1..22: note = Description of Artificial Sequence: Syntheticoligonucleotide
  source 1..22: mol_type = other DNA
cggactcggcgccgagtccgcc

SEQ ID NO: 7833 - DNA, 22 bp, synthetic construct
  misc_feature 1..22: note = Description of Artificial Sequence: Syntheticoligonucleotide
  source 1..22: mol_type = other DNA
cggactcggcgccgagtccgct

SEQ ID NO: 7834 - DNA, 22 bp, synthetic construct
  misc_feature 1..22: note = Description of Artificial Sequence: Syntheticoligonucleotide
  source 1..22: mol_type = other DNA
cggactcggcgccgagtccgtc

SEQ ID NO: 7835 - DNA, 22 bp, synthetic construct
  misc_feature 1..22: note = Description of Artificial Sequence: Syntheticoligonucleotide
  source 1..22: mol_type = other DNA
aggactcggcgccgagtcctcc

SEQ ID NO: 7836 - DNA, 22 bp, synthetic construct
  misc_feature 1..22: note = Description of Artificial Sequence: Syntheticoligonucleotide
  source 1..22: mol_type = other DNA
cagactcggcgccgagtctgcc

SEQ ID NO: 7837 - DNA, 22 bp, synthetic construct
  misc_feature 1..22: note = Description of Artificial Sequence: Syntheticoligonucleotide
  source 1..22: mol_type = other DNA
cggactcggcgccgagtccgca

SEQ ID NO: 7838 - DNA, 22 bp, synthetic construct
  misc_feature 1..22: note = Description of Artificial Sequence: Syntheticoligonucleotide
  source 1..22: mol_type = other DNA
cggactcggcgccgagtccgac

SEQ ID NO: 7839 - DNA, 22 bp, synthetic construct
  misc_feature 1..22: note = Description of Artificial Sequence: Syntheticoligonucleotide
  source 1..22: mol_type = other DNA
tggactcggcgccgagtccacc

SEQ ID NO: 7840 - DNA, 22 bp, synthetic construct
  misc_feature 1..22: note = Description of Artificial Sequence: Syntheticoligonucleotide
  source 1..22: mol_type = other DNA
ctgactcggcgccgagtcagcc

SEQ ID NO: 7841 - DNA, 22 bp, synthetic construct
  misc_feature 1..22: note = Description of Artificial Sequence: Syntheticoligonucleotide
  source 1..22: mol_type = other DNA
ccgactcggcgccgagtcgggc

SEQ ID NO: 7842 - DNA, 22 bp, synthetic construct
  misc_feature 1..22: note = Description of Artificial Sequence: Syntheticoligonucleotide
  source 1..22: mol_type = other DNA
ccgactcggcgccgagtcgggt

SEQ ID NO: 7843 - DNA, 22 bp, synthetic construct
  misc_feature 1..22: note = Description of Artificial Sequence: Syntheticoligonucleotide
  source 1..22: mol_type = other DNA
ccgactcggcgccgagtcggtc

SEQ ID NO: 7844 - DNA, 22 bp, synthetic construct
  misc_feature 1..22: note = Description of Artificial Sequence: Syntheticoligonucleotide
  source 1..22: mol_type = other DNA
acgactcggcgccgagtcgtgc

SEQ ID NO: 7845 - DNA, 22 bp, synthetic construct
  misc_feature 1..22: note = Description of Artificial Sequence: Syntheticoligonucleotide
  source 1..22: mol_type = other DNA
cagactcggcgccgagtctggc

SEQ ID NO: 7846 - DNA, 22 bp, synthetic construct
  misc_feature 1..22: note = Description of Artificial Sequence: Syntheticoligonucleotide
  source 1..22: mol_type = other DNA
ccgactcggcgccgagtcggga

SEQ ID NO: 7847 - DNA, 22 bp, synthetic construct
  misc_feature 1..22: note = Description of Artificial Sequence: Syntheticoligonucleotide
  source 1..22: mol_type = other DNA
ccgactcggcgccgagtcggac

SEQ ID NO: 7848 - DNA, 22 bp, synthetic construct
  misc_feature 1..22: note = Description of Artificial Sequence: Syntheticoligonucleotide
  source 1..22: mol_type = other DNA
ctgactcggcgccgagtcaggc

SEQ ID NO: 7849 - DNA, 22 bp, synthetic construct
  misc_feature 1..22: note = Description of Artificial Sequence: Syntheticoligonucleotide
  source 1..22: mol_type = other DNA
gcgactcggcgccgagtcgccc

SEQ ID NO: 7850 - DNA, 22 bp, synthetic construct
  misc_feature 1..22: note = Description of Artificial Sequence: Syntheticoligonucleotide
  source 1..22: mol_type = other DNA
gcgactcggcgccgagtcgcct

SEQ ID NO: 7851 - DNA, 22 bp, synthetic construct
  misc_feature 1..22: note = Description of Artificial Sequence: Syntheticoligonucleotide
  source 1..22: mol_type = other DNA
gcgactcggcgccgagtcgctc

SEQ ID NO: 7852 - DNA, 22 bp, synthetic construct
  misc_feature 1..22: note = Description of Artificial Sequence: Syntheticoligonucleotide
  source 1..22: mol_type = other DNA
acgactcggcgccgagtcgtcc

SEQ ID NO: 7853 - DNA, 22 bp, synthetic construct
  misc_feature 1..22: note = Description of Artificial Sequence: Syntheticoligonucleotide
  source 1..22: mol_type = other DNA
gagactcggcgccgagtctccc

SEQ ID NO: 7854 - DNA, 22 bp, synthetic construct
  misc_feature 1..22: note = Description of Artificial Sequence: Syntheticoligonucleotide
  source 1..22: mol_type = other DNA
gcgactcggcgccgagtcgcca

SEQ ID NO: 7855 - DNA, 22 bp, synthetic construct
  misc_feature 1..22: note = Description of Artificial Sequence: Syntheticoligonucleotide
  source 1..22: mol_type = other DNA
gcgactcggcgccgagtcgcac

SEQ ID NO: 7856 - DNA, 22 bp, synthetic construct
  misc_feature 1..22: note = Description of Artificial Sequence: Syntheticoligonucleotide
  source 1..22: mol_type = other DNA
gtgactcggcgccgagtcaccc

SEQ ID NO: 7857 - DNA, 22 bp, synthetic construct
  misc_feature 1..22: note = Description of Artificial Sequence: Syntheticoligonucleotide
  source 1..22: mol_type = other DNA
gggactcggcgccgagtcccgt

SEQ ID NO: 7858 - DNA, 22 bp, synthetic construct
  misc_feature 1..22: note = Description of Artificial Sequence: Syntheticoligonucleotide
  source 1..22: mol_type = other DNA
gggactcggcgccgagtccctg

SEQ ID NO: 7859 - DNA, 22 bp, synthetic construct
  misc_feature 1..22: note = Description of Artificial Sequence: Syntheticoligonucleotide
  source 1..22: mol_type = other DNA
aggactcggcgccgagtcctgg

SEQ ID NO: 7860 - DNA, 22 bp, synthetic construct
  misc_feature 1..22: note = Description of Artificial Sequence: Syntheticoligonucleotide
  source 1..22: mol_type = other DNA
gagactcggcgccgagtctcgg

SEQ ID NO: 7861 - DNA, 22 bp, synthetic construct
  misc_feature 1..22: note = Description of Artificial Sequence: Syntheticoligonucleotide
  source 1..22: mol_type = other DNA
gggactcggcgccgagtcccga

SEQ ID NO: 7862 - DNA, 22 bp, synthetic construct
  misc_feature 1..22: note = Description of Artificial Sequence: Syntheticoligonucleotide
  source 1..22: mol_type = other DNA
gggactcggcgccgagtcccag

SEQ ID NO: 7863 - DNA, 22 bp, synthetic construct
  misc_feature 1..22: note = Description of Artificial Sequence: Syntheticoligonucleotide
  source 1..22: mol_type = other DNA
tggactcggcgccgagtccagg

SEQ ID NO: 7864 - DNA, 22 bp, synthetic construct
  misc_feature 1..22: note = Description of Artificial Sequence: Syntheticoligonucleotide
  source 1..22: mol_type = other DNA
gtgactcggcgccgagtcacgg

SEQ ID NO: 7865 - DNA, 22 bp, synthetic construct
  misc_feature 1..22: note = Description of Artificial Sequence: Syntheticoligonucleotide
  source 1..22: mol_type = other DNA
gcgactcggcgccgagtcgccg

SEQ ID NO: 7866 - DNA, 22 bp, synthetic construct
  misc_feature 1..22: note = Description of Artificial Sequence: Syntheticoligonucleotide
  source 1..22: mol_type = other DNA
gcgactcggcgccgagtcgctg

SEQ ID NO: 7867 - DNA, 22 bp, synthetic construct
  misc_feature 1..22: note = Description of Artificial Sequence: Syntheticoligonucleotide
  source 1..22: mol_type = other DNA
acgactcggcgccgagtcgtcg

SEQ ID NO: 7868 - DNA, 22 bp, synthetic construct
  misc_feature 1..22: note = Description of Artificial Sequence: Syntheticoligonucleotide
  source 1..22: mol_type = other DNA
gagactcggcgccgagtctccg

SEQ ID NO: 7869 - DNA, 22 bp, synthetic construct
  misc_feature 1..22: note = Description of Artificial Sequence: Syntheticoligonucleotide
  source 1..22: mol_type = other DNA
gcgactcggcgccgagtcgcag

SEQ ID NO: 7870 - DNA, 22 bp, synthetic construct
  misc_feature 1..22: note = Description of Artificial Sequence: Syntheticoligonucleotide
  source 1..22: mol_type = other DNA
gtgactcggcgccgagtcaccg

SEQ ID NO: 7871 - DNA, 22 bp, synthetic construct
  misc_feature 1..22: note = Description of Artificial Sequence: Syntheticoligonucleotide
  source 1..22: mol_type = other DNA
cggactcggcgccgagtccgtg

SEQ ID NO: 7872 - DNA, 22 bp, synthetic construct
  misc_feature 1..22: note = Description of Artificial Sequence: Syntheticoligonucleotide
  source 1..22: mol_type = other DNA
cagactcggcgccgagtctggg

SEQ ID NO: 7873 - DNA, 22 bp, synthetic construct
  misc_feature 1..22: note = Description of Artificial Sequence: Syntheticoligonucleotide
  source 1..22: mol_type = other DNA
cggactcggcgccgagtccgag

SEQ ID NO: 7874 - DNA, 22 bp, synthetic construct
  misc_feature 1..22: note = Description of Artificial Sequence: Syntheticoligonucleotide
  source 1..22: mol_type = other DNA
ctgactcggcgccgagtcaggg

SEQ ID NO: 7875 - DNA, 22 bp, synthetic construct
  misc_feature 1..22: note = Description of Artificial Sequence: Syntheticoligonucleotide
  source 1..22: mol_type = other DNA
acgactcggcgccgagtcgtgg

SEQ ID NO: 7876 - DNA, 22 bp, synthetic construct
  misc_feature 1..22: note = Description of Artificial Sequence: Syntheticoligonucleotide
  source 1..22: mol_type = other DNA
ccgactcggcgccgagtcggct

SEQ ID NO: 7877 - DNA, 22 bp, synthetic construct
  misc_feature 1..22: note = Description of Artificial Sequence: Syntheticoligonucleotide
  source 1..22: mol_type = other DNA
ccgactcggcgccgagtcggca

SEQ ID NO: 7878 - DNA, 22 bp, synthetic construct
  misc_feature 1..22: note = Description of Artificial Sequence: Syntheticoligonucleotide
  source 1..22: mol_type = other DNA
gagactcggcgccgagtctcgc

SEQ ID NO: 7879 - DNA, 22 bp, synthetic construct
  misc_feature 1..22: note = Description of Artificial Sequence: Syntheticoligonucleotide
  source 1..22: mol_type = other DNA
gtgactcggcgccgagtcacgc

SEQ ID NO: 7880 - DNA, 22 bp, synthetic construct
  misc_feature 1..22: note = Description of Artificial Sequence: Syntheticoligonucleotide
  source 1..22: mol_type = other DNA
aggactcggcgccgagtcctgc

SEQ ID NO: 7881 - DNA, 22 bp, synthetic construct
  misc_feature 1..22: note = Description of Artificial Sequence: Syntheticoligonucleotide
  source 1..22: mol_type = other DNA
tggactcggcgccgagtccagc

SEQ ID NO: 7882 - DNA, 22 bp, synthetic construct
  misc_feature 1..22: note = Description of Artificial Sequence: Syntheticoligonucleotide
  source 1..22: mol_type = other DNA
aggactcggcgccgagtcctcg

SEQ ID NO: 7883 - DNA, 22 bp, synthetic construct
  misc_feature 1..22: note = Description of Artificial Sequence: Syntheticoligonucleotide
  source 1..22: mol_type = other DNA
tggactcggcgccgagtccacg

SEQ ID NO: 7884 - DNA, 22 bp, synthetic construct
  misc_feature 1..22: note = Description of Artificial Sequence: Syntheticoligonucleotide
  source 1..22: mol_type = other DNA
ccgactcggcgccgagtcggtg

SEQ ID NO: 7885 - DNA, 22 bp, synthetic construct
  misc_feature 1..22: note = Description of Artificial Sequence: Syntheticoligonucleotide
  source 1..22: mol_type = other DNA
ccgactcggcgccgagtcggag

SEQ ID NO: 7886 - DNA, 22 bp, synthetic construct
  misc_feature 1..22: note = Description of Artificial Sequence: Syntheticoligonucleotide
  source 1..22: mol_type = other DNA
gggactcggcgccgagtcccgc

SEQ ID NO: 7887 - DNA, 22 bp, synthetic construct
  misc_feature 1..22: note = Description of Artificial Sequence: Syntheticoligonucleotide
  source 1..22: mol_type = other DNA
gggactcggcgccgagtccctc

SEQ ID NO: 7888 - DNA, 22 bp, synthetic construct
  misc_feature 1..22: note = Description of Artificial Sequence: Syntheticoligonucleotide
  source 1..22: mol_type = other DNA
gggactcggcgccgagtcccac

SEQ ID NO: 7889 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcccatgggagtcnnnn

SEQ ID NO: 7890 - DNA, 22 bp, synthetic construct
  misc_feature 1..22: note = Description of Artificial Sequence: Syntheticoligonucleotide
  source 1..22: mol_type = other DNA
cggactcccatgggagtccgcc

SEQ ID NO: 7891 - DNA, 22 bp, synthetic construct
  misc_feature 1..22: note = Description of Artificial Sequence: Syntheticoligonucleotide
  source 1..22: mol_type = other DNA
cggactcccatgggagtccgct

SEQ ID NO: 7892 - DNA, 22 bp, synthetic construct
  misc_feature 1..22: note = Description of Artificial Sequence: Syntheticoligonucleotide
  source 1..22: mol_type = other DNA
cggactcccatgggagtccgtc

SEQ ID NO: 7893 - DNA, 22 bp, synthetic construct
  misc_feature 1..22: note = Description of Artificial Sequence: Syntheticoligonucleotide
  source 1..22: mol_type = other DNA
aggactcccatgggagtcctcc

SEQ ID NO: 7894 - DNA, 22 bp, synthetic construct
  misc_feature 1..22: note = Description of Artificial Sequence: Syntheticoligonucleotide
  source 1..22: mol_type = other DNA
cagactcccatgggagtctgcc

SEQ ID NO: 7895 - DNA, 22 bp, synthetic construct
  misc_feature 1..22: note = Description of Artificial Sequence: Syntheticoligonucleotide
  source 1..22: mol_type = other DNA
cggactcccatgggagtccgca

SEQ ID NO: 7896 - DNA, 22 bp, synthetic construct
  misc_feature 1..22: note = Description of Artificial Sequence: Syntheticoligonucleotide
  source 1..22: mol_type = other DNA
cggactcccatgggagtccgac

SEQ ID NO: 7897 - DNA, 22 bp, synthetic construct
  misc_feature 1..22: note = Description of Artificial Sequence: Syntheticoligonucleotide
  source 1..22: mol_type = other DNA
tggactcccatgggagtccacc

SEQ ID NO: 7898 - DNA, 22 bp, synthetic construct
  misc_feature 1..22: note = Description of Artificial Sequence: Syntheticoligonucleotide
  source 1..22: mol_type = other DNA
ctgactcccatgggagtcagcc

SEQ ID NO: 7899 - DNA, 22 bp, synthetic construct
  misc_feature 1..22: note = Description of Artificial Sequence: Syntheticoligonucleotide
  source 1..22: mol_type = other DNA
ccgactcccatgggagtcgggc

SEQ ID NO: 7900 - DNA, 22 bp, synthetic construct
  misc_feature 1..22: note = Description of Artificial Sequence: Syntheticoligonucleotide
  source 1..22: mol_type = other DNA
ccgactcccatgggagtcgggt

SEQ ID NO: 7901 - DNA, 22 bp, synthetic construct
  misc_feature 1..22: note = Description of Artificial Sequence: Syntheticoligonucleotide
  source 1..22: mol_type = other DNA
ccgactcccatgggagtcggtc

SEQ ID NO: 7902 - DNA, 22 bp, synthetic construct
  misc_feature 1..22: note = Description of Artificial Sequence: Syntheticoligonucleotide
  source 1..22: mol_type = other DNA
acgactcccatgggagtcgtgc

SEQ ID NO: 7903 - DNA, 22 bp, synthetic construct
  misc_feature 1..22: note = Description of Artificial Sequence: Syntheticoligonucleotide
  source 1..22: mol_type = other DNA
cagactcccatgggagtctggc

SEQ ID NO: 7904 - DNA, 22 bp, synthetic construct
  misc_feature 1..22: note = Description of Artificial Sequence: Syntheticoligonucleotide
  source 1..22: mol_type = other DNA
ccgactcccatgggagtcggga

SEQ ID NO: 7905 - DNA, 22 bp, synthetic construct
  misc_feature 1..22: note = Description of Artificial Sequence: Syntheticoligonucleotide
  source 1..22: mol_type = other DNA
ccgactcccatgggagtcggac

SEQ ID NO: 7906 - DNA, 22 bp, synthetic construct
  misc_feature 1..22: note = Description of Artificial Sequence: Syntheticoligonucleotide
  source 1..22: mol_type = other DNA
ctgactcccatgggagtcaggc

SEQ ID NO: 7907 - DNA, 22 bp, synthetic construct
  misc_feature 1..22: note = Description of Artificial Sequence: Syntheticoligonucleotide
  source 1..22: mol_type = other DNA
gcgactcccatgggagtcgccc

SEQ ID NO: 7908 - DNA, 22 bp, synthetic construct
  misc_feature 1..22: note = Description of Artificial Sequence: Syntheticoligonucleotide
  source 1..22: mol_type = other DNA
gcgactcccatgggagtcgcct

SEQ ID NO: 7909 - DNA, 22 bp, synthetic construct
  misc_feature 1..22: note = Description of Artificial Sequence: Syntheticoligonucleotide
  source 1..22: mol_type = other DNA
gcgactcccatgggagtcgctc

SEQ ID NO: 7910 - DNA, 22 bp, synthetic construct
  misc_feature 1..22: note = Description of Artificial Sequence: Syntheticoligonucleotide
  source 1..22: mol_type = other DNA
acgactcccatgggagtcgtcc

SEQ ID NO: 7911 - DNA, 22 bp, synthetic construct
  misc_feature 1..22: note = Description of Artificial Sequence: Syntheticoligonucleotide
  source 1..22: mol_type = other DNA
gagactcccatgggagtctccc

SEQ ID NO: 7912 - DNA, 22 bp, synthetic construct
  misc_feature 1..22: note = Description of Artificial Sequence: Syntheticoligonucleotide
  source 1..22: mol_type = other DNA
gcgactcccatgggagtcgcca

SEQ ID NO: 7913 - DNA, 22 bp, synthetic construct
  misc_feature 1..22: note = Description of Artificial Sequence: Syntheticoligonucleotide
  source 1..22: mol_type = other DNA
gcgactcccatgggagtcgcac

SEQ ID NO: 7914 - DNA, 22 bp, synthetic construct
  misc_feature 1..22: note = Description of Artificial Sequence: Syntheticoligonucleotide
  source 1..22: mol_type = other DNA
gtgactcccatgggagtcaccc

SEQ ID NO: 7915 - DNA, 22 bp, synthetic construct
  misc_feature 1..22: note = Description of Artificial Sequence: Syntheticoligonucleotide
  source 1..22: mol_type = other DNA
gggactcccatgggagtcccgt

SEQ ID NO: 7916 - DNA, 22 bp, synthetic construct
  misc_feature 1..22: note = Description of Artificial Sequence: Syntheticoligonucleotide
  source 1..22: mol_type = other DNA
gggactcccatgggagtccctg

SEQ ID NO: 7917 - DNA, 22 bp, synthetic construct
  misc_feature 1..22: note = Description of Artificial Sequence: Syntheticoligonucleotide
  source 1..22: mol_type = other DNA
aggactcccatgggagtcctgg

SEQ ID NO: 7918 - DNA, 22 bp, synthetic construct
  misc_feature 1..22: note = Description of Artificial Sequence: Syntheticoligonucleotide
  source 1..22: mol_type = other DNA
gagactcccatgggagtctcgg

SEQ ID NO: 7919 - DNA, 22 bp, synthetic construct
  misc_feature 1..22: note = Description of Artificial Sequence: Syntheticoligonucleotide
  source 1..22: mol_type = other DNA
gggactcccatgggagtcccga

SEQ ID NO: 7920 - DNA, 22 bp, synthetic construct
  misc_feature 1..22: note = Description of Artificial Sequence: Syntheticoligonucleotide
  source 1..22: mol_type = other DNA
gggactcccatgggagtcccag

SEQ ID NO: 7921 - DNA, 22 bp, synthetic construct
  misc_feature 1..22: note = Description of Artificial Sequence: Syntheticoligonucleotide
  source 1..22: mol_type = other DNA
tggactcccatgggagtccagg

SEQ ID NO: 7922 - DNA, 22 bp, synthetic construct
  misc_feature 1..22: note = Description of Artificial Sequence: Syntheticoligonucleotide
  source 1..22: mol_type = other DNA
gtgactcccatgggagtcacgg

SEQ ID NO: 7923 - DNA, 22 bp, synthetic construct
  misc_feature 1..22: note = Description of Artificial Sequence: Syntheticoligonucleotide
  source 1..22: mol_type = other DNA
gcgactcccatgggagtcgccg

SEQ ID NO: 7924 - DNA, 22 bp, synthetic construct
  misc_feature 1..22: note = Description of Artificial Sequence: Syntheticoligonucleotide
  source 1..22: mol_type = other DNA
gcgactcccatgggagtcgctg

SEQ ID NO: 7925 - DNA, 22 bp, synthetic construct
  misc_feature 1..22: note = Description of Artificial Sequence: Syntheticoligonucleotide
  source 1..22: mol_type = other DNA
acgactcccatgggagtcgtcg

SEQ ID NO: 7926 - DNA, 22 bp, synthetic construct
  misc_feature 1..22: note = Description of Artificial Sequence: Syntheticoligonucleotide
  source 1..22: mol_type = other DNA
gagactcccatgggagtctccg

SEQ ID NO: 7927 - DNA, 22 bp, synthetic construct
  misc_feature 1..22: note = Description of Artificial Sequence: Syntheticoligonucleotide
  source 1..22: mol_type = other DNA
gcgactcccatgggagtcgcag

SEQ ID NO: 7928 - DNA, 22 bp, synthetic construct
  misc_feature 1..22: note = Description of Artificial Sequence: Syntheticoligonucleotide
  source 1..22: mol_type = other DNA
gtgactcccatgggagtcaccg

SEQ ID NO: 7929 - DNA, 22 bp, synthetic construct
  misc_feature 1..22: note = Description of Artificial Sequence: Syntheticoligonucleotide
  source 1..22: mol_type = other DNA
cggactcccatgggagtccgtg

SEQ ID NO: 7930 - DNA, 22 bp, synthetic construct
  misc_feature 1..22: note = Description of Artificial Sequence: Syntheticoligonucleotide
  source 1..22: mol_type = other DNA
cagactcccatgggagtctggg

SEQ ID NO: 7931 - DNA, 22 bp, synthetic construct
  misc_feature 1..22: note = Description of Artificial Sequence: Syntheticoligonucleotide
  source 1..22: mol_type = other DNA
cggactcccatgggagtccgag

SEQ ID NO: 7932 - DNA, 22 bp, synthetic construct
  misc_feature 1..22: note = Description of Artificial Sequence: Syntheticoligonucleotide
  source 1..22: mol_type = other DNA
ctgactcccatgggagtcaggg

SEQ ID NO: 7933 - DNA, 22 bp, synthetic construct
  misc_feature 1..22: note = Description of Artificial Sequence: Syntheticoligonucleotide
  source 1..22: mol_type = other DNA
acgactcccatgggagtcgtgg

SEQ ID NO: 7934 - DNA, 22 bp, synthetic construct
  misc_feature 1..22: note = Description of Artificial Sequence: Syntheticoligonucleotide
  source 1..22: mol_type = other DNA
ccgactcccatgggagtcggct

SEQ ID NO: 7935 - DNA, 22 bp, synthetic construct
  misc_feature 1..22: note = Description of Artificial Sequence: Syntheticoligonucleotide
  source 1..22: mol_type = other DNA
ccgactcccatgggagtcggca

SEQ ID NO: 7936 - DNA, 22 bp, synthetic construct
  misc_feature 1..22: note = Description of Artificial Sequence: Syntheticoligonucleotide
  source 1..22: mol_type = other DNA
gagactcccatgggagtctcgc

SEQ ID NO: 7937 - DNA, 22 bp, synthetic construct
  misc_feature 1..22: note = Description of Artificial Sequence: Syntheticoligonucleotide
  source 1..22: mol_type = other DNA
gtgactcccatgggagtcacgc

SEQ ID NO: 7938 - DNA, 22 bp, synthetic construct
  misc_feature 1..22: note = Description of Artificial Sequence: Syntheticoligonucleotide
  source 1..22: mol_type = other DNA
aggactcccatgggagtcctgc

SEQ ID NO: 7939 - DNA, 22 bp, synthetic construct
  misc_feature 1..22: note = Description of Artificial Sequence: Syntheticoligonucleotide
  source 1..22: mol_type = other DNA
tggactcccatgggagtccagc

SEQ ID NO: 7940 - DNA, 22 bp, synthetic construct
  misc_feature 1..22: note = Description of Artificial Sequence: Syntheticoligonucleotide
  source 1..22: mol_type = other DNA
aggactcccatgggagtcctcg

SEQ ID NO: 7941 - DNA, 22 bp, synthetic construct
  misc_feature 1..22: note = Description of Artificial Sequence: Syntheticoligonucleotide
  source 1..22: mol_type = other DNA
tggactcccatgggagtccacg

SEQ ID NO: 7942 - DNA, 22 bp, synthetic construct
  misc_feature 1..22: note = Description of Artificial Sequence: Syntheticoligonucleotide
  source 1..22: mol_type = other DNA
ccgactcccatgggagtcggtg

SEQ ID NO: 7943 - DNA, 22 bp, synthetic construct
  misc_feature 1..22: note = Description of Artificial Sequence: Syntheticoligonucleotide
  source 1..22: mol_type = other DNA
ccgactcccatgggagtcggag

SEQ ID NO: 7944 - DNA, 22 bp, synthetic construct
  misc_feature 1..22: note = Description of Artificial Sequence: Syntheticoligonucleotide
  source 1..22: mol_type = other DNA
gggactcccatgggagtcccgc

SEQ ID NO: 7945 - DNA, 22 bp, synthetic construct
  misc_feature 1..22: note = Description of Artificial Sequence: Syntheticoligonucleotide
  source 1..22: mol_type = other DNA
gggactcccatgggagtccctc

SEQ ID NO: 7946 - DNA, 22 bp, synthetic construct
  misc_feature 1..22: note = Description of Artificial Sequence: Syntheticoligonucleotide
  source 1..22: mol_type = other DNA
gggactcccatgggagtcccac

SEQ ID NO: 7947 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactccctagggagtcnnnn

SEQ ID NO: 7948 - DNA, 22 bp, synthetic construct
  misc_feature 1..22: note = Description of Artificial Sequence: Syntheticoligonucleotide
  source 1..22: mol_type = other DNA
cggactccctagggagtccgcc

SEQ ID NO: 7949 - DNA, 22 bp, synthetic construct
  misc_feature 1..22: note = Description of Artificial Sequence: Syntheticoligonucleotide
  source 1..22: mol_type = other DNA
cggactccctagggagtccgct

SEQ ID NO: 7950 - DNA, 22 bp, synthetic construct
  misc_feature 1..22: note = Description of Artificial Sequence: Syntheticoligonucleotide
  source 1..22: mol_type = other DNA
cggactccctagggagtccgtc

SEQ ID NO: 7951 - DNA, 22 bp, synthetic construct
  misc_feature 1..22: note = Description of Artificial Sequence: Syntheticoligonucleotide
  source 1..22: mol_type = other DNA
aggactccctagggagtcctcc

SEQ ID NO: 7952 - DNA, 22 bp, synthetic construct
  misc_feature 1..22: note = Description of Artificial Sequence: Syntheticoligonucleotide
  source 1..22: mol_type = other DNA
cagactccctagggagtctgcc

SEQ ID NO: 7953 - DNA, 22 bp, synthetic construct
  misc_feature 1..22: note = Description of Artificial Sequence: Syntheticoligonucleotide
  source 1..22: mol_type = other DNA
cggactccctagggagtccgca

SEQ ID NO: 7954 - DNA, 22 bp, synthetic construct
  misc_feature 1..22: note = Description of Artificial Sequence: Syntheticoligonucleotide
  source 1..22: mol_type = other DNA
cggactccctagggagtccgac

SEQ ID NO: 7955 - DNA, 22 bp, synthetic construct
  misc_feature 1..22: note = Description of Artificial Sequence: Syntheticoligonucleotide
  source 1..22: mol_type = other DNA
tggactccctagggagtccacc

SEQ ID NO: 7956 - DNA, 22 bp, synthetic construct
  misc_feature 1..22: note = Description of Artificial Sequence: Syntheticoligonucleotide
  source 1..22: mol_type = other DNA
ctgactccctagggagtcagcc

SEQ ID NO: 7957 - DNA, 22 bp, synthetic construct
  misc_feature 1..22: note = Description of Artificial Sequence: Syntheticoligonucleotide
  source 1..22: mol_type = other DNA
ccgactccctagggagtcgggc

SEQ ID NO: 7958 - DNA, 22 bp, synthetic construct
  misc_feature 1..22: note = Description of Artificial Sequence: Syntheticoligonucleotide
  source 1..22: mol_type = other DNA
ccgactccctagggagtcgggt

SEQ ID NO: 7959 - DNA, 22 bp, synthetic construct
  misc_feature 1..22: note = Description of Artificial Sequence: Syntheticoligonucleotide
  source 1..22: mol_type = other DNA
ccgactccctagggagtcggtc

SEQ ID NO: 7960 - DNA, 22 bp, synthetic construct
  misc_feature 1..22: note = Description of Artificial Sequence: Syntheticoligonucleotide
  source 1..22: mol_type = other DNA
acgactccctagggagtcgtgc

SEQ ID NO: 7961 - DNA, 22 bp, synthetic construct
  misc_feature 1..22: note = Description of Artificial Sequence: Syntheticoligonucleotide
  source 1..22: mol_type = other DNA
cagactccctagggagtctggc

SEQ ID NO: 7962 - DNA, 22 bp, synthetic construct
  misc_feature 1..22: note = Description of Artificial Sequence: Syntheticoligonucleotide
  source 1..22: mol_type = other DNA
ccgactccctagggagtcggga

SEQ ID NO: 7963 - DNA, 22 bp, synthetic construct
  misc_feature 1..22: note = Description of Artificial Sequence: Syntheticoligonucleotide
  source 1..22: mol_type = other DNA
ccgactccctagggagtcggac

SEQ ID NO: 7964 - DNA, 22 bp, synthetic construct
  misc_feature 1..22: note = Description of Artificial Sequence: Syntheticoligonucleotide
  source 1..22: mol_type = other DNA
ctgactccctagggagtcaggc

SEQ ID NO: 7965 - DNA, 22 bp, synthetic construct
  misc_feature 1..22: note = Description of Artificial Sequence: Syntheticoligonucleotide
  source 1..22: mol_type = other DNA
gcgactccctagggagtcgccc

SEQ ID NO: 7966 - DNA, 22 bp, synthetic construct
  misc_feature 1..22: note = Description of Artificial Sequence: Syntheticoligonucleotide
  source 1..22: mol_type = other DNA
gcgactccctagggagtcgcct

SEQ ID NO: 7967 - DNA, 22 bp, synthetic construct
  misc_feature 1..22: note = Description of Artificial Sequence: Syntheticoligonucleotide
  source 1..22: mol_type = other DNA
gcgactccctagggagtcgctc

SEQ ID NO: 7968 - DNA, 22 bp, synthetic construct
  misc_feature 1..22: note = Description of Artificial Sequence: Syntheticoligonucleotide
  source 1..22: mol_type = other DNA
acgactccctagggagtcgtcc

SEQ ID NO: 7969 - DNA, 22 bp, synthetic construct
  misc_feature 1..22: note = Description of Artificial Sequence: Syntheticoligonucleotide
  source 1..22: mol_type = other DNA
gagactccctagggagtctccc

SEQ ID NO: 7970 - DNA, 22 bp, synthetic construct
  misc_feature 1..22: note = Description of Artificial Sequence: Syntheticoligonucleotide
  source 1..22: mol_type = other DNA
gcgactccctagggagtcgcca

SEQ ID NO: 7971 - DNA, 22 bp, synthetic construct
  misc_feature 1..22: note = Description of Artificial Sequence: Syntheticoligonucleotide
  source 1..22: mol_type = other DNA
gcgactccctagggagtcgcac

SEQ ID NO: 7972 - DNA, 22 bp, synthetic construct
  misc_feature 1..22: note = Description of Artificial Sequence: Syntheticoligonucleotide
  source 1..22: mol_type = other DNA
gtgactccctagggagtcaccc

SEQ ID NO: 7973 - DNA, 22 bp, synthetic construct
  misc_feature 1..22: note = Description of Artificial Sequence: Syntheticoligonucleotide
  source 1..22: mol_type = other DNA
gggactccctagggagtcccgt

SEQ ID NO: 7974 - DNA, 22 bp, synthetic construct
  misc_feature 1..22: note = Description of Artificial Sequence: Syntheticoligonucleotide
  source 1..22: mol_type = other DNA
gggactccctagggagtccctg

SEQ ID NO: 7975 - DNA, 22 bp, synthetic construct
  misc_feature 1..22: note = Description of Artificial Sequence: Syntheticoligonucleotide
  source 1..22: mol_type = other DNA
aggactccctagggagtcctgg

SEQ ID NO: 7976 - DNA, 22 bp, synthetic construct
  misc_feature 1..22: note = Description of Artificial Sequence: Syntheticoligonucleotide
  source 1..22: mol_type = other DNA
gagactccctagggagtctcgg

SEQ ID NO: 7977 - DNA, 22 bp, synthetic construct
  misc_feature 1..22: note = Description of Artificial Sequence: Syntheticoligonucleotide
  source 1..22: mol_type = other DNA
gggactccctagggagtcccga

SEQ ID NO: 7978 - DNA, 22 bp, synthetic construct
  misc_feature 1..22: note = Description of Artificial Sequence: Syntheticoligonucleotide
  source 1..22: mol_type = other DNA
gggactccctagggagtcccag

SEQ ID NO: 7979 - DNA, 22 bp, synthetic construct
  misc_feature 1..22: note = Description of Artificial Sequence: Syntheticoligonucleotide
  source 1..22: mol_type = other DNA
tggactccctagggagtccagg

SEQ ID NO: 7980 - DNA, 22 bp, synthetic construct
  misc_feature 1..22: note = Description of Artificial Sequence: Syntheticoligonucleotide
  source 1..22: mol_type = other DNA
gtgactccctagggagtcacgg

SEQ ID NO: 7981 - DNA, 22 bp, synthetic construct
  misc_feature 1..22: note = Description of Artificial Sequence: Syntheticoligonucleotide
  source 1..22: mol_type = other DNA
gcgactccctagggagtcgccg

SEQ ID NO: 7982 - DNA, 22 bp, synthetic construct
  misc_feature 1..22: note = Description of Artificial Sequence: Syntheticoligonucleotide
  source 1..22: mol_type = other DNA
gcgactccctagggagtcgctg

SEQ ID NO: 7983 - DNA, 22 bp, synthetic construct
  misc_feature 1..22: note = Description of Artificial Sequence: Syntheticoligonucleotide
  source 1..22: mol_type = other DNA
acgactccctagggagtcgtcg

SEQ ID NO: 7984 - DNA, 22 bp, synthetic construct
  misc_feature 1..22: note = Description of Artificial Sequence: Syntheticoligonucleotide
  source 1..22: mol_type = other DNA
gagactccctagggagtctccg

SEQ ID NO: 7985 - DNA, 22 bp, synthetic construct
  misc_feature 1..22: note = Description of Artificial Sequence: Syntheticoligonucleotide
  source 1..22: mol_type = other DNA
gcgactccctagggagtcgcag

SEQ ID NO: 7986 - DNA, 22 bp, synthetic construct
  misc_feature 1..22: note = Description of Artificial Sequence: Syntheticoligonucleotide
  source 1..22: mol_type = other DNA
gtgactccctagggagtcaccg

SEQ ID NO: 7987 - DNA, 22 bp, synthetic construct
  misc_feature 1..22: note = Description of Artificial Sequence: Syntheticoligonucleotide
  source 1..22: mol_type = other DNA
cggactccctagggagtccgtg

SEQ ID NO: 7988 - DNA, 22 bp, synthetic construct
  misc_feature 1..22: note = Description of Artificial Sequence: Syntheticoligonucleotide
  source 1..22: mol_type = other DNA
cagactccctagggagtctggg

SEQ ID NO: 7989 - DNA, 22 bp, synthetic construct
  misc_feature 1..22: note = Description of Artificial Sequence: Syntheticoligonucleotide
  source 1..22: mol_type = other DNA
cggactccctagggagtccgag

SEQ ID NO: 7990 - DNA, 22 bp, synthetic construct
  misc_feature 1..22: note = Description of Artificial Sequence: Syntheticoligonucleotide
  source 1..22: mol_type = other DNA
ctgactccctagggagtcaggg

SEQ ID NO: 7991 - DNA, 22 bp, synthetic construct
  misc_feature 1..22: note = Description of Artificial Sequence: Syntheticoligonucleotide
  source 1..22: mol_type = other DNA
acgactccctagggagtcgtgg

SEQ ID NO: 7992 - DNA, 22 bp, synthetic construct
  misc_feature 1..22: note = Description of Artificial Sequence: Syntheticoligonucleotide
  source 1..22: mol_type = other DNA
ccgactccctagggagtcggct

SEQ ID NO: 7993 - DNA, 22 bp, synthetic construct
  misc_feature 1..22: note = Description of Artificial Sequence: Syntheticoligonucleotide
  source 1..22: mol_type = other DNA
ccgactccctagggagtcggca

SEQ ID NO: 7994 - DNA, 22 bp, synthetic construct
  misc_feature 1..22: note = Description of Artificial Sequence: Syntheticoligonucleotide
  source 1..22: mol_type = other DNA
gagactccctagggagtctcgc

SEQ ID NO: 7995 - DNA, 22 bp, synthetic construct
  misc_feature 1..22: note = Description of Artificial Sequence: Syntheticoligonucleotide
  source 1..22: mol_type = other DNA
gtgactccctagggagtcacgc

SEQ ID NO: 7996 - DNA, 22 bp, synthetic construct
  misc_feature 1..22: note = Description of Artificial Sequence: Syntheticoligonucleotide
  source 1..22: mol_type = other DNA
aggactccctagggagtcctgc

SEQ ID NO: 7997 - DNA, 22 bp, synthetic construct
  misc_feature 1..22: note = Description of Artificial Sequence: Syntheticoligonucleotide
  source 1..22: mol_type = other DNA
tggactccctagggagtccagc

SEQ ID NO: 7998 - DNA, 22 bp, synthetic construct
  misc_feature 1..22: note = Description of Artificial Sequence: Syntheticoligonucleotide
  source 1..22: mol_type = other DNA
aggactccctagggagtcctcg

SEQ ID NO: 7999 - DNA, 22 bp, synthetic construct
  misc_feature 1..22: note = Description of Artificial Sequence: Syntheticoligonucleotide
  source 1..22: mol_type = other DNA
tggactccctagggagtccacg

SEQ ID NO: 8000 - DNA, 22 bp, synthetic construct
  misc_feature 1..22: note = Description of Artificial Sequence: Syntheticoligonucleotide
  source 1..22: mol_type = other DNA
ccgactccctagggagtcggtg

SEQ ID NO: 8001 - DNA, 22 bp, synthetic construct
  misc_feature 1..22: note = Description of Artificial Sequence: Syntheticoligonucleotide
  source 1..22: mol_type = other DNA
ccgactccctagggagtcggag

SEQ ID NO: 8002 - DNA, 22 bp, synthetic construct
  misc_feature 1..22: note = Description of Artificial Sequence: Syntheticoligonucleotide
  source 1..22: mol_type = other DNA
gggactccctagggagtcccgc

SEQ ID NO: 8003 - DNA, 22 bp, synthetic construct
  misc_feature 1..22: note = Description of Artificial Sequence: Syntheticoligonucleotide
  source 1..22: mol_type = other DNA
gggactccctagggagtccctc

SEQ ID NO: 8004 - DNA, 22 bp, synthetic construct
  misc_feature 1..22: note = Description of Artificial Sequence: Syntheticoligonucleotide
  source 1..22: mol_type = other DNA
gggactccctagggagtcccac

SEQ ID NO: 8005 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcccgcgggagtcnnnn

SEQ ID NO: 8006 - DNA, 22 bp, synthetic construct
  misc_feature 1..22: note = Description of Artificial Sequence: Syntheticoligonucleotide
  source 1..22: mol_type = other DNA
cggactcccgcgggagtccgcc

SEQ ID NO: 8007 - DNA, 22 bp, synthetic construct
  misc_feature 1..22: note = Description of Artificial Sequence: Syntheticoligonucleotide
  source 1..22: mol_type = other DNA
cggactcccgcgggagtccgct

SEQ ID NO: 8008 - DNA, 22 bp, synthetic construct
  misc_feature 1..22: note = Description of Artificial Sequence: Syntheticoligonucleotide
  source 1..22: mol_type = other DNA
cggactcccgcgggagtccgtc

SEQ ID NO: 8009 - DNA, 22 bp, synthetic construct
  misc_feature 1..22: note = Description of Artificial Sequence: Syntheticoligonucleotide
  source 1..22: mol_type = other DNA
aggactcccgcgggagtcctcc

SEQ ID NO: 8010 - DNA, 22 bp, synthetic construct
  misc_feature 1..22: note = Description of Artificial Sequence: Syntheticoligonucleotide
  source 1..22: mol_type = other DNA
cagactcccgcgggagtctgcc

SEQ ID NO: 8011 - DNA, 22 bp, synthetic construct
  misc_feature 1..22: note = Description of Artificial Sequence: Syntheticoligonucleotide
  source 1..22: mol_type = other DNA
cggactcccgcgggagtccgca

SEQ ID NO: 8012 - DNA, 22 bp, synthetic construct
  misc_feature 1..22: note = Description of Artificial Sequence: Syntheticoligonucleotide
  source 1..22: mol_type = other DNA
cggactcccgcgggagtccgac

SEQ ID NO: 8013 - DNA, 22 bp, synthetic construct
  misc_feature 1..22: note = Description of Artificial Sequence: Syntheticoligonucleotide
  source 1..22: mol_type = other DNA
tggactcccgcgggagtccacc

SEQ ID NO: 8014 - DNA, 22 bp, synthetic construct
  misc_feature 1..22: note = Description of Artificial Sequence: Syntheticoligonucleotide
  source 1..22: mol_type = other DNA
ctgactcccgcgggagtcagcc

SEQ ID NO: 8015 - DNA, 22 bp, synthetic construct
  misc_feature 1..22: note = Description of Artificial Sequence: Syntheticoligonucleotide
  source 1..22: mol_type = other DNA
ccgactcccgcgggagtcgggc

SEQ ID NO: 8016 - DNA, 22 bp, synthetic construct
  misc_feature 1..22: note = Description of Artificial Sequence: Syntheticoligonucleotide
  source 1..22: mol_type = other DNA
ccgactcccgcgggagtcgggt

SEQ ID NO: 8017 - DNA, 22 bp, synthetic construct
  misc_feature 1..22: note = Description of Artificial Sequence: Syntheticoligonucleotide
  source 1..22: mol_type = other DNA
ccgactcccgcgggagtcggtc

SEQ ID NO: 8018 - DNA, 22 bp, synthetic construct
  misc_feature 1..22: note = Description of Artificial Sequence: Syntheticoligonucleotide
  source 1..22: mol_type = other DNA
acgactcccgcgggagtcgtgc

SEQ ID NO: 8019 - DNA, 22 bp, synthetic construct
  misc_feature 1..22: note = Description of Artificial Sequence: Syntheticoligonucleotide
  source 1..22: mol_type = other DNA
cagactcccgcgggagtctggc

SEQ ID NO: 8020 - DNA, 22 bp, synthetic construct
  misc_feature 1..22: note = Description of Artificial Sequence: Syntheticoligonucleotide
  source 1..22: mol_type = other DNA
ccgactcccgcgggagtcggga

SEQ ID NO: 8021 - DNA, 22 bp, synthetic construct
  misc_feature 1..22: note = Description of Artificial Sequence: Syntheticoligonucleotide
  source 1..22: mol_type = other DNA
ccgactcccgcgggagtcggac

SEQ ID NO: 8022 - DNA, 22 bp, synthetic construct
  misc_feature 1..22: note = Description of Artificial Sequence: Syntheticoligonucleotide
  source 1..22: mol_type = other DNA
ctgactcccgcgggagtcaggc

SEQ ID NO: 8023 - DNA, 22 bp, synthetic construct
  misc_feature 1..22: note = Description of Artificial Sequence: Syntheticoligonucleotide
  source 1..22: mol_type = other DNA
gcgactcccgcgggagtcgccc

SEQ ID NO: 8024 - DNA, 22 bp, synthetic construct
  misc_feature 1..22: note = Description of Artificial Sequence: Syntheticoligonucleotide
  source 1..22: mol_type = other DNA
gcgactcccgcgggagtcgcct

SEQ ID NO: 8025 - DNA, 22 bp, synthetic construct
  misc_feature 1..22: note = Description of Artificial Sequence: Syntheticoligonucleotide
  source 1..22: mol_type = other DNA
gcgactcccgcgggagtcgctc

SEQ ID NO: 8026 - DNA, 22 bp, synthetic construct
  misc_feature 1..22: note = Description of Artificial Sequence: Syntheticoligonucleotide
  source 1..22: mol_type = other DNA
acgactcccgcgggagtcgtcc

SEQ ID NO: 8027 - DNA, 22 bp, synthetic construct
  misc_feature 1..22: note = Description of Artificial Sequence: Syntheticoligonucleotide
  source 1..22: mol_type = other DNA
gagactcccgcgggagtctccc

SEQ ID NO: 8028 - DNA, 22 bp, synthetic construct
  misc_feature 1..22: note = Description of Artificial Sequence: Syntheticoligonucleotide
  source 1..22: mol_type = other DNA
gcgactcccgcgggagtcgcca

SEQ ID NO: 8029 - DNA, 22 bp, synthetic construct
  misc_feature 1..22: note = Description of Artificial Sequence: Syntheticoligonucleotide
  source 1..22: mol_type = other DNA
gcgactcccgcgggagtcgcac

SEQ ID NO: 8030 - DNA, 22 bp, synthetic construct
  misc_feature 1..22: note = Description of Artificial Sequence: Syntheticoligonucleotide
  source 1..22: mol_type = other DNA
gtgactcccgcgggagtcaccc

SEQ ID NO: 8031 - DNA, 22 bp, synthetic construct
  misc_feature 1..22: note = Description of Artificial Sequence: Syntheticoligonucleotide
  source 1..22: mol_type = other DNA
gggactcccgcgggagtcccgt

SEQ ID NO: 8032 - DNA, 22 bp, synthetic construct
  misc_feature 1..22: note = Description of Artificial Sequence: Syntheticoligonucleotide
  source 1..22: mol_type = other DNA
gggactcccgcgggagtccctg

SEQ ID NO: 8033 - DNA, 22 bp, synthetic construct
  misc_feature 1..22: note = Description of Artificial Sequence: Syntheticoligonucleotide
  source 1..22: mol_type = other DNA
aggactcccgcgggagtcctgg

SEQ ID NO: 8034 - DNA, 22 bp, synthetic construct
  misc_feature 1..22: note = Description of Artificial Sequence: Syntheticoligonucleotide
  source 1..22: mol_type = other DNA
gagactcccgcgggagtctcgg

SEQ ID NO: 8035 - DNA, 22 bp, synthetic construct
  misc_feature 1..22: note = Description of Artificial Sequence: Syntheticoligonucleotide
  source 1..22: mol_type = other DNA
gggactcccgcgggagtcccga

SEQ ID NO: 8036 - DNA, 22 bp, synthetic construct
  misc_feature 1..22: note = Description of Artificial Sequence: Syntheticoligonucleotide
  source 1..22: mol_type = other DNA
gggactcccgcgggagtcccag

SEQ ID NO: 8037 - DNA, 22 bp, synthetic construct
  misc_feature 1..22: note = Description of Artificial Sequence: Syntheticoligonucleotide
  source 1..22: mol_type = other DNA
tggactcccgcgggagtccagg

SEQ ID NO: 8038 - DNA, 22 bp, synthetic construct
  misc_feature 1..22: note = Description of Artificial Sequence: Syntheticoligonucleotide
  source 1..22: mol_type = other DNA
gtgactcccgcgggagtcacgg

SEQ ID NO: 8039 - DNA, 22 bp, synthetic construct
  misc_feature 1..22: note = Description of Artificial Sequence: Syntheticoligonucleotide
  source 1..22: mol_type = other DNA
gcgactcccgcgggagtcgccg

SEQ ID NO: 8040 - DNA, 22 bp, synthetic construct
  misc_feature 1..22: note = Description of Artificial Sequence: Syntheticoligonucleotide
  source 1..22: mol_type = other DNA
gcgactcccgcgggagtcgctg

SEQ ID NO: 8041 - DNA, 22 bp, synthetic construct
  misc_feature 1..22: note = Description of Artificial Sequence: Syntheticoligonucleotide
  source 1..22: mol_type = other DNA
acgactcccgcgggagtcgtcg

SEQ ID NO: 8042 - DNA, 22 bp, synthetic construct
  misc_feature 1..22: note = Description of Artificial Sequence: Syntheticoligonucleotide
  source 1..22: mol_type = other DNA
gagactcccgcgggagtctccg

SEQ ID NO: 8043 - DNA, 22 bp, synthetic construct
  misc_feature 1..22: note = Description of Artificial Sequence: Syntheticoligonucleotide
  source 1..22: mol_type = other DNA
gcgactcccgcgggagtcgcag

SEQ ID NO: 8044 - DNA, 22 bp, synthetic construct
  misc_feature 1..22: note = Description of Artificial Sequence: Syntheticoligonucleotide
  source 1..22: mol_type = other DNA
gtgactcccgcgggagtcaccg

SEQ ID NO: 8045 - DNA, 22 bp, synthetic construct
  misc_feature 1..22: note = Description of Artificial Sequence: Syntheticoligonucleotide
  source 1..22: mol_type = other DNA
cggactcccgcgggagtccgtg

SEQ ID NO: 8046 - DNA, 22 bp, synthetic construct
  misc_feature 1..22: note = Description of Artificial Sequence: Syntheticoligonucleotide
  source 1..22: mol_type = other DNA
cagactcccgcgggagtctggg

SEQ ID NO: 8047 - DNA, 22 bp, synthetic construct
  misc_feature 1..22: note = Description of Artificial Sequence: Syntheticoligonucleotide
  source 1..22: mol_type = other DNA
cggactcccgcgggagtccgag

SEQ ID NO: 8048 - DNA, 22 bp, synthetic construct
  misc_feature 1..22: note = Description of Artificial Sequence: Syntheticoligonucleotide
  source 1..22: mol_type = other DNA
ctgactcccgcgggagtcaggg

SEQ ID NO: 8049 - DNA, 22 bp, synthetic construct
  misc_feature 1..22: note = Description of Artificial Sequence: Syntheticoligonucleotide
  source 1..22: mol_type = other DNA
acgactcccgcgggagtcgtgg

SEQ ID NO: 8050 - DNA, 22 bp, synthetic construct
  misc_feature 1..22: note = Description of Artificial Sequence: Syntheticoligonucleotide
  source 1..22: mol_type = other DNA
ccgactcccgcgggagtcggct

SEQ ID NO: 8051 - DNA, 22 bp, synthetic construct
  misc_feature 1..22: note = Description of Artificial Sequence: Syntheticoligonucleotide
  source 1..22: mol_type = other DNA
ccgactcccgcgggagtcggca

SEQ ID NO: 8052 - DNA, 22 bp, synthetic construct
  misc_feature 1..22: note = Description of Artificial Sequence: Syntheticoligonucleotide
  source 1..22: mol_type = other DNA
gagactcccgcgggagtctcgc

SEQ ID NO: 8053 - DNA, 22 bp, synthetic construct
  misc_feature 1..22: note = Description of Artificial Sequence: Syntheticoligonucleotide
  source 1..22: mol_type = other DNA
gtgactcccgcgggagtcacgc

SEQ ID NO: 8054 - DNA, 22 bp, synthetic construct
  misc_feature 1..22: note = Description of Artificial Sequence: Syntheticoligonucleotide
  source 1..22: mol_type = other DNA
aggactcccgcgggagtcctgc

SEQ ID NO: 8055 - DNA, 22 bp, synthetic construct
  misc_feature 1..22: note = Description of Artificial Sequence: Syntheticoligonucleotide
  source 1..22: mol_type = other DNA
tggactcccgcgggagtccagc

SEQ ID NO: 8056 - DNA, 22 bp, synthetic construct
  misc_feature 1..22: note = Description of Artificial Sequence: Syntheticoligonucleotide
  source 1..22: mol_type = other DNA
aggactcccgcgggagtcctcg

SEQ ID NO: 8057 - DNA, 22 bp, synthetic construct
  misc_feature 1..22: note = Description of Artificial Sequence: Syntheticoligonucleotide
  source 1..22: mol_type = other DNA
tggactcccgcgggagtccacg

SEQ ID NO: 8058 - DNA, 22 bp, synthetic construct
  misc_feature 1..22: note = Description of Artificial Sequence: Syntheticoligonucleotide
  source 1..22: mol_type = other DNA
ccgactcccgcgggagtcggtg

SEQ ID NO: 8059 - DNA, 22 bp, synthetic construct
  misc_feature 1..22: note = Description of Artificial Sequence: Syntheticoligonucleotide
  source 1..22: mol_type = other DNA
ccgactcccgcgggagtcggag

SEQ ID NO: 8060 - DNA, 22 bp, synthetic construct
  misc_feature 1..22: note = Description of Artificial Sequence: Syntheticoligonucleotide
  source 1..22: mol_type = other DNA
gggactcccgcgggagtcccgc

SEQ ID NO: 8061 - DNA, 22 bp, synthetic construct
  misc_feature 1..22: note = Description of Artificial Sequence: Syntheticoligonucleotide
  source 1..22: mol_type = other DNA
gggactcccgcgggagtccctc

SEQ ID NO: 8062 - DNA, 22 bp, synthetic construct
  misc_feature 1..22: note = Description of Artificial Sequence: Syntheticoligonucleotide
  source 1..22: mol_type = other DNA
gggactcccgcgggagtcccac

SEQ ID NO: 8063 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactccccggggagtcnnnn

SEQ ID NO: 8064 - DNA, 22 bp, synthetic construct
  misc_feature 1..22: note = Description of Artificial Sequence: Syntheticoligonucleotide
  source 1..22: mol_type = other DNA
cggactccccggggagtccgcc

SEQ ID NO: 8065 - DNA, 22 bp, synthetic construct
  misc_feature 1..22: note = Description of Artificial Sequence: Syntheticoligonucleotide
  source 1..22: mol_type = other DNA
cggactccccggggagtccgct

SEQ ID NO: 8066 - DNA, 22 bp, synthetic construct
  misc_feature 1..22: note = Description of Artificial Sequence: Syntheticoligonucleotide
  source 1..22: mol_type = other DNA
cggactccccggggagtccgtc

SEQ ID NO: 8067 - DNA, 22 bp, synthetic construct
  misc_feature 1..22: note = Description of Artificial Sequence: Syntheticoligonucleotide
  source 1..22: mol_type = other DNA
aggactccccggggagtcctcc

SEQ ID NO: 8068 - DNA, 22 bp, synthetic construct
  misc_feature 1..22: note = Description of Artificial Sequence: Syntheticoligonucleotide
  source 1..22: mol_type = other DNA
cagactccccggggagtctgcc

SEQ ID NO: 8069 - DNA, 22 bp, synthetic construct
  misc_feature 1..22: note = Description of Artificial Sequence: Syntheticoligonucleotide
  source 1..22: mol_type = other DNA
cggactccccggggagtccgca

SEQ ID NO: 8070 - DNA, 22 bp, synthetic construct
  misc_feature 1..22: note = Description of Artificial Sequence: Syntheticoligonucleotide
  source 1..22: mol_type = other DNA
cggactccccggggagtccgac

SEQ ID NO: 8071 - DNA, 22 bp, synthetic construct
  misc_feature 1..22: note = Description of Artificial Sequence: Syntheticoligonucleotide
  source 1..22: mol_type = other DNA
tggactccccggggagtccacc

SEQ ID NO: 8072 - DNA, 22 bp, synthetic construct
  misc_feature 1..22: note = Description of Artificial Sequence: Syntheticoligonucleotide
  source 1..22: mol_type = other DNA
ctgactccccggggagtcagcc

SEQ ID NO: 8073 - DNA, 22 bp, synthetic construct
  misc_feature 1..22: note = Description of Artificial Sequence: Syntheticoligonucleotide
  source 1..22: mol_type = other DNA
ccgactccccggggagtcgggc

SEQ ID NO: 8074 - DNA, 22 bp, synthetic construct
  misc_feature 1..22: note = Description of Artificial Sequence: Syntheticoligonucleotide
  source 1..22: mol_type = other DNA
ccgactccccggggagtcgggt

SEQ ID NO: 8075 - DNA, 22 bp, synthetic construct
  misc_feature 1..22: note = Description of Artificial Sequence: Syntheticoligonucleotide
  source 1..22: mol_type = other DNA
ccgactccccggggagtcggtc

SEQ ID NO: 8076 - DNA, 22 bp, synthetic construct
  misc_feature 1..22: note = Description of Artificial Sequence: Syntheticoligonucleotide
  source 1..22: mol_type = other DNA
acgactccccggggagtcgtgc

SEQ ID NO: 8077 - DNA, 22 bp, synthetic construct
  misc_feature 1..22: note = Description of Artificial Sequence: Syntheticoligonucleotide
  source 1..22: mol_type = other DNA
cagactccccggggagtctggc

SEQ ID NO: 8078 - DNA, 22 bp, synthetic construct
  misc_feature 1..22: note = Description of Artificial Sequence: Syntheticoligonucleotide
  source 1..22: mol_type = other DNA
ccgactccccggggagtcggga

SEQ ID NO: 8079 - DNA, 22 bp, synthetic construct
  misc_feature 1..22: note = Description of Artificial Sequence: Syntheticoligonucleotide
  source 1..22: mol_type = other DNA
ccgactccccggggagtcggac

SEQ ID NO: 8080 - DNA, 22 bp, synthetic construct
  misc_feature 1..22: note = Description of Artificial Sequence: Syntheticoligonucleotide
  source 1..22: mol_type = other DNA
ctgactccccggggagtcaggc

SEQ ID NO: 8081 - DNA, 22 bp, synthetic construct
  misc_feature 1..22: note = Description of Artificial Sequence: Syntheticoligonucleotide
  source 1..22: mol_type = other DNA
gcgactccccggggagtcgccc

SEQ ID NO: 8082 - DNA, 22 bp, synthetic construct
  misc_feature 1..22: note = Description of Artificial Sequence: Syntheticoligonucleotide
  source 1..22: mol_type = other DNA
gcgactccccggggagtcgcct

SEQ ID NO: 8083 - DNA, 22 bp, synthetic construct
  misc_feature 1..22: note = Description of Artificial Sequence: Syntheticoligonucleotide
  source 1..22: mol_type = other DNA
gcgactccccggggagtcgctc

SEQ ID NO: 8084 - DNA, 22 bp, synthetic construct
  misc_feature 1..22: note = Description of Artificial Sequence: Syntheticoligonucleotide
  source 1..22: mol_type = other DNA
acgactccccggggagtcgtcc

SEQ ID NO: 8085 - DNA, 22 bp, synthetic construct
  misc_feature 1..22: note = Description of Artificial Sequence: Syntheticoligonucleotide
  source 1..22: mol_type = other DNA
gagactccccggggagtctccc

SEQ ID NO: 8086 - DNA, 22 bp, synthetic construct
  misc_feature 1..22: note = Description of Artificial Sequence: Syntheticoligonucleotide
  source 1..22: mol_type = other DNA
gcgactccccggggagtcgcca

SEQ ID NO: 8087 - DNA, 22 bp, synthetic construct
  misc_feature 1..22: note = Description of Artificial Sequence: Syntheticoligonucleotide
  source 1..22: mol_type = other DNA
gcgactccccggggagtcgcac

SEQ ID NO: 8088 - DNA, 22 bp, synthetic construct
  misc_feature 1..22: note = Description of Artificial Sequence: Syntheticoligonucleotide
  source 1..22: mol_type = other DNA
gtgactccccggggagtcaccc

SEQ ID NO: 8089 - DNA, 22 bp, synthetic construct
  misc_feature 1..22: note = Description of Artificial Sequence: Syntheticoligonucleotide
  source 1..22: mol_type = other DNA
gggactccccggggagtcccgt

SEQ ID NO: 8090 - DNA, 22 bp, synthetic construct
  misc_feature 1..22: note = Description of Artificial Sequence: Syntheticoligonucleotide
  source 1..22: mol_type = other DNA
gggactccccggggagtccctg

SEQ ID NO: 8091 - DNA, 22 bp, synthetic construct
  misc_feature 1..22: note = Description of Artificial Sequence: Syntheticoligonucleotide
  source 1..22: mol_type = other DNA
aggactccccggggagtcctgg

SEQ ID NO: 8092 - DNA, 22 bp, synthetic construct
  misc_feature 1..22: note = Description of Artificial Sequence: Syntheticoligonucleotide
  source 1..22: mol_type = other DNA
gagactccccggggagtctcgg

SEQ ID NO: 8093 - DNA, 22 bp, synthetic construct
  misc_feature 1..22: note = Description of Artificial Sequence: Syntheticoligonucleotide
  source 1..22: mol_type = other DNA
gggactccccggggagtcccga

SEQ ID NO: 8094 - DNA, 22 bp, synthetic construct
  misc_feature 1..22: note = Description of Artificial Sequence: Syntheticoligonucleotide
  source 1..22: mol_type = other DNA
gggactccccggggagtcccag

SEQ ID NO: 8095 - DNA, 22 bp, synthetic construct
  misc_feature 1..22: note = Description of Artificial Sequence: Syntheticoligonucleotide
  source 1..22: mol_type = other DNA
tggactccccggggagtccagg

SEQ ID NO: 8096 - DNA, 22 bp, synthetic construct
  misc_feature 1..22: note = Description of Artificial Sequence: Syntheticoligonucleotide
  source 1..22: mol_type = other DNA
gtgactccccggggagtcacgg

SEQ ID NO: 8097 - DNA, 22 bp, synthetic construct
  misc_feature 1..22: note = Description of Artificial Sequence: Syntheticoligonucleotide
  source 1..22: mol_type = other DNA
gcgactccccggggagtcgccg

SEQ ID NO: 8098 - DNA, 22 bp, synthetic construct
  misc_feature 1..22: note = Description of Artificial Sequence: Syntheticoligonucleotide
  source 1..22: mol_type = other DNA
gcgactccccggggagtcgctg

SEQ ID NO: 8099 - DNA, 22 bp, synthetic construct
  misc_feature 1..22: note = Description of Artificial Sequence: Syntheticoligonucleotide
  source 1..22: mol_type = other DNA
acgactccccggggagtcgtcg

SEQ ID NO: 8100 - DNA, 22 bp, synthetic construct
  misc_feature 1..22: note = Description of Artificial Sequence: Syntheticoligonucleotide
  source 1..22: mol_type = other DNA
gagactccccggggagtctccg

SEQ ID NO: 8101 - DNA, 22 bp, synthetic construct
  misc_feature 1..22: note = Description of Artificial Sequence: Syntheticoligonucleotide
  source 1..22: mol_type = other DNA
gcgactccccggggagtcgcag

SEQ ID NO: 8102 - DNA, 22 bp, synthetic construct
  misc_feature 1..22: note = Description of Artificial Sequence: Syntheticoligonucleotide
  source 1..22: mol_type = other DNA
gtgactccccggggagtcaccg

SEQ ID NO: 8103 - DNA, 22 bp, synthetic construct
  misc_feature 1..22: note = Description of Artificial Sequence: Syntheticoligonucleotide
  source 1..22: mol_type = other DNA
cggactccccggggagtccgtg

SEQ ID NO: 8104 - DNA, 22 bp, synthetic construct
  misc_feature 1..22: note = Description of Artificial Sequence: Syntheticoligonucleotide
  source 1..22: mol_type = other DNA
cagactccccggggagtctggg

SEQ ID NO: 8105 - DNA, 22 bp, synthetic construct
  misc_feature 1..22: note = Description of Artificial Sequence: Syntheticoligonucleotide
  source 1..22: mol_type = other DNA
cggactccccggggagtccgag

SEQ ID NO: 8106 - DNA, 22 bp, synthetic construct
  misc_feature 1..22: note = Description of Artificial Sequence: Syntheticoligonucleotide
  source 1..22: mol_type = other DNA
ctgactccccggggagtcaggg

SEQ ID NO: 8107 - DNA, 22 bp, synthetic construct
  misc_feature 1..22: note = Description of Artificial Sequence: Syntheticoligonucleotide
  source 1..22: mol_type = other DNA
acgactccccggggagtcgtgg

SEQ ID NO: 8108 - DNA, 22 bp, synthetic construct
  misc_feature 1..22: note = Description of Artificial Sequence: Syntheticoligonucleotide
  source 1..22: mol_type = other DNA
ccgactccccggggagtcggct

SEQ ID NO: 8109 - DNA, 22 bp, synthetic construct
  misc_feature 1..22: note = Description of Artificial Sequence: Syntheticoligonucleotide
  source 1..22: mol_type = other DNA
ccgactccccggggagtcggca

SEQ ID NO: 8110 - DNA, 22 bp, synthetic construct
  misc_feature 1..22: note = Description of Artificial Sequence: Syntheticoligonucleotide
  source 1..22: mol_type = other DNA
gagactccccggggagtctcgc

SEQ ID NO: 8111 - DNA, 22 bp, synthetic construct
  misc_feature 1..22: note = Description of Artificial Sequence: Syntheticoligonucleotide
  source 1..22: mol_type = other DNA
gtgactccccggggagtcacgc

SEQ ID NO: 8112 - DNA, 22 bp, synthetic construct
  misc_feature 1..22: note = Description of Artificial Sequence: Syntheticoligonucleotide
  source 1..22: mol_type = other DNA
aggactccccggggagtcctgc

SEQ ID NO: 8113 - DNA, 22 bp, synthetic construct
  misc_feature 1..22: note = Description of Artificial Sequence: Syntheticoligonucleotide
  source 1..22: mol_type = other DNA
tggactccccggggagtccagc

SEQ ID NO: 8114 - DNA, 22 bp, synthetic construct
  misc_feature 1..22: note = Description of Artificial Sequence: Syntheticoligonucleotide
  source 1..22: mol_type = other DNA
aggactccccggggagtcctcg

SEQ ID NO: 8115 - DNA, 22 bp, synthetic construct
  misc_feature 1..22: note = Description of Artificial Sequence: Syntheticoligonucleotide
  source 1..22: mol_type = other DNA
tggactccccggggagtccacg

SEQ ID NO: 8116 - DNA, 22 bp, synthetic construct
  misc_feature 1..22: note = Description of Artificial Sequence: Syntheticoligonucleotide
  source 1..22: mol_type = other DNA
ccgactccccggggagtcggtg

SEQ ID NO: 8117 - DNA, 22 bp, synthetic construct
  misc_feature 1..22: note = Description of Artificial Sequence: Syntheticoligonucleotide
  source 1..22: mol_type = other DNA
ccgactccccggggagtcggag

SEQ ID NO: 8118 - DNA, 22 bp, synthetic construct
  misc_feature 1..22: note = Description of Artificial Sequence: Syntheticoligonucleotide
  source 1..22: mol_type = other DNA
gggactccccggggagtcccgc

SEQ ID NO: 8119 - DNA, 22 bp, synthetic construct
  misc_feature 1..22: note = Description of Artificial Sequence: Syntheticoligonucleotide
  source 1..22: mol_type = other DNA
gggactccccggggagtccctc

SEQ ID NO: 8120 - DNA, 22 bp, synthetic construct
  misc_feature 1..22: note = Description of Artificial Sequence: Syntheticoligonucleotide
  source 1..22: mol_type = other DNA
gggactccccggggagtcccac

SEQ ID NO: 8121 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcgtatacgagtcnnnn

SEQ ID NO: 8122 - DNA, 22 bp, synthetic construct
  misc_feature 1..22: note = Description of Artificial Sequence: Syntheticoligonucleotide
  source 1..22: mol_type = other DNA
cggactcgtatacgagtccgcc

SEQ ID NO: 8123 - DNA, 22 bp, synthetic construct
  misc_feature 1..22: note = Description of Artificial Sequence: Syntheticoligonucleotide
  source 1..22: mol_type = other DNA
cggactcgtatacgagtccgct

SEQ ID NO: 8124 - DNA, 22 bp, synthetic construct
  misc_feature 1..22: note = Description of Artificial Sequence: Syntheticoligonucleotide
  source 1..22: mol_type = other DNA
cggactcgtatacgagtccgtc

SEQ ID NO: 8125 - DNA, 22 bp, synthetic construct
  misc_feature 1..22: note = Description of Artificial Sequence: Syntheticoligonucleotide
  source 1..22: mol_type = other DNA
aggactcgtatacgagtcctcc

SEQ ID NO: 8126 - DNA, 22 bp, synthetic construct
  misc_feature 1..22: note = Description of Artificial Sequence: Syntheticoligonucleotide
  source 1..22: mol_type = other DNA
cagactcgtatacgagtctgcc

SEQ ID NO: 8127 - DNA, 22 bp, synthetic construct
  misc_feature 1..22: note = Description of Artificial Sequence: Syntheticoligonucleotide
  source 1..22: mol_type = other DNA
cggactcgtatacgagtccgca

SEQ ID NO: 8128 - DNA, 22 bp, synthetic construct
  misc_feature 1..22: note = Description of Artificial Sequence: Syntheticoligonucleotide
  source 1..22: mol_type = other DNA
cggactcgtatacgagtccgac

SEQ ID NO: 8129 - DNA, 22 bp, synthetic construct
  misc_feature 1..22: note = Description of Artificial Sequence: Syntheticoligonucleotide
  source 1..22: mol_type = other DNA
tggactcgtatacgagtccacc

SEQ ID NO: 8130 - DNA, 22 bp, synthetic construct
  misc_feature 1..22: note = Description of Artificial Sequence: Syntheticoligonucleotide
  source 1..22: mol_type = other DNA
ctgactcgtatacgagtcagcc

SEQ ID NO: 8131 - DNA, 22 bp, synthetic construct
  misc_feature 1..22: note = Description of Artificial Sequence: Syntheticoligonucleotide
  source 1..22: mol_type = other DNA
ccgactcgtatacgagtcgggc

SEQ ID NO: 8132 - DNA, 22 bp, synthetic construct
  misc_feature 1..22: note = Description of Artificial Sequence: Syntheticoligonucleotide
  source 1..22: mol_type = other DNA
ccgactcgtatacgagtcgggt

SEQ ID NO: 8133 - DNA, 22 bp, synthetic construct
  misc_feature 1..22: note = Description of Artificial Sequence: Syntheticoligonucleotide
  source 1..22: mol_type = other DNA
ccgactcgtatacgagtcggtc

SEQ ID NO: 8134 - DNA, 22 bp, synthetic construct
  misc_feature 1..22: note = Description of Artificial Sequence: Syntheticoligonucleotide
  source 1..22: mol_type = other DNA
acgactcgtatacgagtcgtgc

SEQ ID NO: 8135 - DNA, 22 bp, synthetic construct
  misc_feature 1..22: note = Description of Artificial Sequence: Syntheticoligonucleotide
  source 1..22: mol_type = other DNA
cagactcgtatacgagtctggc

SEQ ID NO: 8136 - DNA, 22 bp, synthetic construct
  misc_feature 1..22: note = Description of Artificial Sequence: Syntheticoligonucleotide
  source 1..22: mol_type = other DNA
ccgactcgtatacgagtcggga

SEQ ID NO: 8137 - DNA, 22 bp, synthetic construct
  misc_feature 1..22: note = Description of Artificial Sequence: Syntheticoligonucleotide
  source 1..22: mol_type = other DNA
ccgactcgtatacgagtcggac

SEQ ID NO: 8138 - DNA, 22 bp, synthetic construct
  misc_feature 1..22: note = Description of Artificial Sequence: Syntheticoligonucleotide
  source 1..22: mol_type = other DNA
ctgactcgtatacgagtcaggc

SEQ ID NO: 8139 - DNA, 22 bp, synthetic construct
  misc_feature 1..22: note = Description of Artificial Sequence: Syntheticoligonucleotide
  source 1..22: mol_type = other DNA
gcgactcgtatacgagtcgccc

SEQ ID NO: 8140 - DNA, 22 bp, synthetic construct
  misc_feature 1..22: note = Description of Artificial Sequence: Syntheticoligonucleotide
  source 1..22: mol_type = other DNA
gcgactcgtatacgagtcgcct

SEQ ID NO: 8141 - DNA, 22 bp, synthetic construct
  misc_feature 1..22: note = Description of Artificial Sequence: Syntheticoligonucleotide
  source 1..22: mol_type = other DNA
gcgactcgtatacgagtcgctc

SEQ ID NO: 8142 - DNA, 22 bp, synthetic construct
  misc_feature 1..22: note = Description of Artificial Sequence: Syntheticoligonucleotide
  source 1..22: mol_type = other DNA
acgactcgtatacgagtcgtcc

SEQ ID NO: 8143 - DNA, 22 bp, synthetic construct
  misc_feature 1..22: note = Description of Artificial Sequence: Syntheticoligonucleotide
  source 1..22: mol_type = other DNA
gagactcgtatacgagtctccc

SEQ ID NO: 8144 - DNA, 22 bp, synthetic construct
  misc_feature 1..22: note = Description of Artificial Sequence: Syntheticoligonucleotide
  source 1..22: mol_type = other DNA
gcgactcgtatacgagtcgcca

SEQ ID NO: 8145 - DNA, 22 bp, synthetic construct
  misc_feature 1..22: note = Description of Artificial Sequence: Syntheticoligonucleotide
  source 1..22: mol_type = other DNA
gcgactcgtatacgagtcgcac

SEQ ID NO: 8146 - DNA, 22 bp, synthetic construct
  misc_feature 1..22: note = Description of Artificial Sequence: Syntheticoligonucleotide
  source 1..22: mol_type = other DNA
gtgactcgtatacgagtcaccc

SEQ ID NO: 8147 - DNA, 22 bp, synthetic construct
  misc_feature 1..22: note = Description of Artificial Sequence: Syntheticoligonucleotide
  source 1..22: mol_type = other DNA
gggactcgtatacgagtcccgt

SEQ ID NO: 8148 - DNA, 22 bp, synthetic construct
  misc_feature 1..22: note = Description of Artificial Sequence: Syntheticoligonucleotide
  source 1..22: mol_type = other DNA
gggactcgtatacgagtccctg

SEQ ID NO: 8149 - DNA, 22 bp, synthetic construct
  misc_feature 1..22: note = Description of Artificial Sequence: Syntheticoligonucleotide
  source 1..22: mol_type = other DNA
aggactcgtatacgagtcctgg

SEQ ID NO: 8150 - DNA, 22 bp, synthetic construct
  misc_feature 1..22: note = Description of Artificial Sequence: Syntheticoligonucleotide
  source 1..22: mol_type = other DNA
gagactcgtatacgagtctcgg

SEQ ID NO: 8151 - DNA, 22 bp, synthetic construct
  misc_feature 1..22: note = Description of Artificial Sequence: Syntheticoligonucleotide
  source 1..22: mol_type = other DNA
gggactcgtatacgagtcccga

SEQ ID NO: 8152 - DNA, 22 bp, synthetic construct
  misc_feature 1..22: note = Description of Artificial Sequence: Syntheticoligonucleotide
  source 1..22: mol_type = other DNA
gggactcgtatacgagtcccag

SEQ ID NO: 8153 - DNA, 22 bp, synthetic construct
  misc_feature 1..22: note = Description of Artificial Sequence: Syntheticoligonucleotide
  source 1..22: mol_type = other DNA
tggactcgtatacgagtccagg

SEQ ID NO: 8154 - DNA, 22 bp, synthetic construct
  misc_feature 1..22: note = Description of Artificial Sequence: Syntheticoligonucleotide
  source 1..22: mol_type = other DNA
gtgactcgtatacgagtcacgg

SEQ ID NO: 8155 - DNA, 22 bp, synthetic construct
  misc_feature 1..22: note = Description of Artificial Sequence: Syntheticoligonucleotide
  source 1..22: mol_type = other DNA
gcgactcgtatacgagtcgccg

SEQ ID NO: 8156 - DNA, 22 bp, synthetic construct
  misc_feature 1..22: note = Description of Artificial Sequence: Syntheticoligonucleotide
  source 1..22: mol_type = other DNA
gcgactcgtatacgagtcgctg

SEQ ID NO: 8157 - DNA, 22 bp, synthetic construct
  misc_feature 1..22: note = Description of Artificial Sequence: Syntheticoligonucleotide
  source 1..22: mol_type = other DNA
acgactcgtatacgagtcgtcg

SEQ ID NO: 8158 - DNA, 22 bp, synthetic construct
  misc_feature 1..22: note = Description of Artificial Sequence: Syntheticoligonucleotide
  source 1..22: mol_type = other DNA
gagactcgtatacgagtctccg

SEQ ID NO: 8159 - DNA, 22 bp, synthetic construct
  misc_feature 1..22: note = Description of Artificial Sequence: Syntheticoligonucleotide
  source 1..22: mol_type = other DNA
gcgactcgtatacgagtcgcag

SEQ ID NO: 8160 - DNA, 22 bp, synthetic construct
  misc_feature 1..22: note = Description of Artificial Sequence: Syntheticoligonucleotide
  source 1..22: mol_type = other DNA
gtgactcgtatacgagtcaccg

SEQ ID NO: 8161 - DNA, 22 bp, synthetic construct
  misc_feature 1..22: note = Description of Artificial Sequence: Syntheticoligonucleotide
  source 1..22: mol_type = other DNA
cggactcgtatacgagtccgtg

SEQ ID NO: 8162 - DNA, 22 bp, synthetic construct
  misc_feature 1..22: note = Description of Artificial Sequence: Syntheticoligonucleotide
  source 1..22: mol_type = other DNA
cagactcgtatacgagtctggg

SEQ ID NO: 8163 - DNA, 22 bp, synthetic construct
  misc_feature 1..22: note = Description of Artificial Sequence: Syntheticoligonucleotide
  source 1..22: mol_type = other DNA
cggactcgtatacgagtccgag

SEQ ID NO: 8164 - DNA, 22 bp, synthetic construct
  misc_feature 1..22: note = Description of Artificial Sequence: Syntheticoligonucleotide
  source 1..22: mol_type = other DNA
ctgactcgtatacgagtcaggg

SEQ ID NO: 8165 - DNA, 22 bp, synthetic construct
  misc_feature 1..22: note = Description of Artificial Sequence: Syntheticoligonucleotide
  source 1..22: mol_type = other DNA
acgactcgtatacgagtcgtgg

SEQ ID NO: 8166 - DNA, 22 bp, synthetic construct
  misc_feature 1..22: note = Description of Artificial Sequence: Syntheticoligonucleotide
  source 1..22: mol_type = other DNA
ccgactcgtatacgagtcggct

SEQ ID NO: 8167 - DNA, 22 bp, synthetic construct
  misc_feature 1..22: note = Description of Artificial Sequence: Syntheticoligonucleotide
  source 1..22: mol_type = other DNA
ccgactcgtatacgagtcggca

SEQ ID NO: 8168 - DNA, 22 bp, synthetic construct
  misc_feature 1..22: note = Description of Artificial Sequence: Syntheticoligonucleotide
  source 1..22: mol_type = other DNA
gagactcgtatacgagtctcgc

SEQ ID NO: 8169 - DNA, 22 bp, synthetic construct
  misc_feature 1..22: note = Description of Artificial Sequence: Syntheticoligonucleotide
  source 1..22: mol_type = other DNA
gtgactcgtatacgagtcacgc

SEQ ID NO: 8170 - DNA, 22 bp, synthetic construct
  misc_feature 1..22: note = Description of Artificial Sequence: Syntheticoligonucleotide
  source 1..22: mol_type = other DNA
aggactcgtatacgagtcctgc

SEQ ID NO: 8171 - DNA, 22 bp, synthetic construct
  misc_feature 1..22: note = Description of Artificial Sequence: Syntheticoligonucleotide
  source 1..22: mol_type = other DNA
tggactcgtatacgagtccagc

SEQ ID NO: 8172 - DNA, 22 bp, synthetic construct
  misc_feature 1..22: note = Description of Artificial Sequence: Syntheticoligonucleotide
  source 1..22: mol_type = other DNA
aggactcgtatacgagtcctcg

SEQ ID NO: 8173 - DNA, 22 bp, synthetic construct
  misc_feature 1..22: note = Description of Artificial Sequence: Syntheticoligonucleotide
  source 1..22: mol_type = other DNA
tggactcgtatacgagtccacg

SEQ ID NO: 8174 - DNA, 22 bp, synthetic construct
  misc_feature 1..22: note = Description of Artificial Sequence: Syntheticoligonucleotide
  source 1..22: mol_type = other DNA
ccgactcgtatacgagtcggtg

SEQ ID NO: 8175 - DNA, 22 bp, synthetic construct
  misc_feature 1..22: note = Description of Artificial Sequence: Syntheticoligonucleotide
  source 1..22: mol_type = other DNA
ccgactcgtatacgagtcggag

SEQ ID NO: 8176 - DNA, 22 bp, synthetic construct
  misc_feature 1..22: note = Description of Artificial Sequence: Syntheticoligonucleotide
  source 1..22: mol_type = other DNA
gggactcgtatacgagtcccgc

SEQ ID NO: 8177 - DNA, 22 bp, synthetic construct
  misc_feature 1..22: note = Description of Artificial Sequence: Syntheticoligonucleotide
  source 1..22: mol_type = other DNA
gggactcgtatacgagtccctc

SEQ ID NO: 8178 - DNA, 22 bp, synthetic construct
  misc_feature 1..22: note = Description of Artificial Sequence: Syntheticoligonucleotide
  source 1..22: mol_type = other DNA
gggactcgtatacgagtcccac

SEQ ID NO: 8179 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcgttaacgagtcnnnn

SEQ ID NO: 8180 - DNA, 22 bp, synthetic construct
  misc_feature 1..22: note = Description of Artificial Sequence: Syntheticoligonucleotide
  source 1..22: mol_type = other DNA
cggactcgttaacgagtccgcc

SEQ ID NO: 8181 - DNA, 22 bp, synthetic construct
  misc_feature 1..22: note = Description of Artificial Sequence: Syntheticoligonucleotide
  source 1..22: mol_type = other DNA
cggactcgttaacgagtccgct

SEQ ID NO: 8182 - DNA, 22 bp, synthetic construct
  misc_feature 1..22: note = Description of Artificial Sequence: Syntheticoligonucleotide
  source 1..22: mol_type = other DNA
cggactcgttaacgagtccgtc

SEQ ID NO: 8183 - DNA, 22 bp, synthetic construct
  misc_feature 1..22: note = Description of Artificial Sequence: Syntheticoligonucleotide
  source 1..22: mol_type = other DNA
aggactcgttaacgagtcctcc

SEQ ID NO: 8184 - DNA, 22 bp, synthetic construct
  misc_feature 1..22: note = Description of Artificial Sequence: Syntheticoligonucleotide
  source 1..22: mol_type = other DNA
cagactcgttaacgagtctgcc

SEQ ID NO: 8185 - DNA, 22 bp, synthetic construct
  misc_feature 1..22: note = Description of Artificial Sequence: Syntheticoligonucleotide
  source 1..22: mol_type = other DNA
cggactcgttaacgagtccgca

SEQ ID NO: 8186 - DNA, 22 bp, synthetic construct
  misc_feature 1..22: note = Description of Artificial Sequence: Syntheticoligonucleotide
  source 1..22: mol_type = other DNA
cggactcgttaacgagtccgac

SEQ ID NO: 8187 - DNA, 22 bp, synthetic construct
  misc_feature 1..22: note = Description of Artificial Sequence: Syntheticoligonucleotide
  source 1..22: mol_type = other DNA
tggactcgttaacgagtccacc

SEQ ID NO: 8188 - DNA, 22 bp, synthetic construct
  misc_feature 1..22: note = Description of Artificial Sequence: Syntheticoligonucleotide
  source 1..22: mol_type = other DNA
ctgactcgttaacgagtcagcc

SEQ ID NO: 8189 - DNA, 22 bp, synthetic construct
  misc_feature 1..22: note = Description of Artificial Sequence: Syntheticoligonucleotide
  source 1..22: mol_type = other DNA
ccgactcgttaacgagtcgggc

SEQ ID NO: 8190 - DNA, 22 bp, synthetic construct
  misc_feature 1..22: note = Description of Artificial Sequence: Syntheticoligonucleotide
  source 1..22: mol_type = other DNA
ccgactcgttaacgagtcgggt

SEQ ID NO: 8191 - DNA, 22 bp, synthetic construct
  misc_feature 1..22: note = Description of Artificial Sequence: Syntheticoligonucleotide
  source 1..22: mol_type = other DNA
ccgactcgttaacgagtcggtc

SEQ ID NO: 8192 - DNA, 22 bp, synthetic construct
  misc_feature 1..22: note = Description of Artificial Sequence: Syntheticoligonucleotide
  source 1..22: mol_type = other DNA
acgactcgttaacgagtcgtgc

SEQ ID NO: 8193 - DNA, 22 bp, synthetic construct
  misc_feature 1..22: note = Description of Artificial Sequence: Syntheticoligonucleotide
  source 1..22: mol_type = other DNA
cagactcgttaacgagtctggc

SEQ ID NO: 8194 - DNA, 22 bp, synthetic construct
  misc_feature 1..22: note = Description of Artificial Sequence: Syntheticoligonucleotide
  source 1..22: mol_type = other DNA
ccgactcgttaacgagtcggga

SEQ ID NO: 8195 - DNA, 22 bp, synthetic construct
  misc_feature 1..22: note = Description of Artificial Sequence: Syntheticoligonucleotide
  source 1..22: mol_type = other DNA
ccgactcgttaacgagtcggac

SEQ ID NO: 8196 - DNA, 22 bp, synthetic construct
  misc_feature 1..22: note = Description of Artificial Sequence: Syntheticoligonucleotide
  source 1..22: mol_type = other DNA
ctgactcgttaacgagtcaggc

SEQ ID NO: 8197 - DNA, 22 bp, synthetic construct
  misc_feature 1..22: note = Description of Artificial Sequence: Syntheticoligonucleotide
  source 1..22: mol_type = other DNA
gcgactcgttaacgagtcgccc

SEQ ID NO: 8198 - DNA, 22 bp, synthetic construct
  misc_feature 1..22: note = Description of Artificial Sequence: Syntheticoligonucleotide
  source 1..22: mol_type = other DNA
gcgactcgttaacgagtcgcct

SEQ ID NO: 8199 - DNA, 22 bp, synthetic construct
  misc_feature 1..22: note = Description of Artificial Sequence: Syntheticoligonucleotide
  source 1..22: mol_type = other DNA
gcgactcgttaacgagtcgctc

SEQ ID NO: 8200 - DNA, 22 bp, synthetic construct
  misc_feature 1..22: note = Description of Artificial Sequence: Syntheticoligonucleotide
  source 1..22: mol_type = other DNA
acgactcgttaacgagtcgtcc

SEQ ID NO: 8201 - DNA, 22 bp, synthetic construct
  misc_feature 1..22: note = Description of Artificial Sequence: Syntheticoligonucleotide
  source 1..22: mol_type = other DNA
gagactcgttaacgagtctccc

SEQ ID NO: 8202 - DNA, 22 bp, synthetic construct
  misc_feature 1..22: note = Description of Artificial Sequence: Syntheticoligonucleotide
  source 1..22: mol_type = other DNA
gcgactcgttaacgagtcgcca

SEQ ID NO: 8203 - DNA, 22 bp, synthetic construct
  misc_feature 1..22: note = Description of Artificial Sequence: Syntheticoligonucleotide
  source 1..22: mol_type = other DNA
gcgactcgttaacgagtcgcac

SEQ ID NO: 8204 - DNA, 22 bp, synthetic construct
  misc_feature 1..22: note = Description of Artificial Sequence: Syntheticoligonucleotide
  source 1..22: mol_type = other DNA
gtgactcgttaacgagtcaccc

SEQ ID NO: 8205 - DNA, 22 bp, synthetic construct
  misc_feature 1..22: note = Description of Artificial Sequence: Syntheticoligonucleotide
  source 1..22: mol_type = other DNA
gggactcgttaacgagtcccgt

SEQ ID NO: 8206 - DNA, 22 bp, synthetic construct
  misc_feature 1..22: note = Description of Artificial Sequence: Syntheticoligonucleotide
  source 1..22: mol_type = other DNA
gggactcgttaacgagtccctg

SEQ ID NO: 8207 - DNA, 22 bp, synthetic construct
  misc_feature 1..22: note = Description of Artificial Sequence: Syntheticoligonucleotide
  source 1..22: mol_type = other DNA
aggactcgttaacgagtcctgg

SEQ ID NO: 8208 - DNA, 22 bp, synthetic construct
  misc_feature 1..22: note = Description of Artificial Sequence: Syntheticoligonucleotide
  source 1..22: mol_type = other DNA
gagactcgttaacgagtctcgg

SEQ ID NO: 8209 - DNA, 22 bp, synthetic construct
  misc_feature 1..22: note = Description of Artificial Sequence: Syntheticoligonucleotide
  source 1..22: mol_type = other DNA
gggactcgttaacgagtcccga

SEQ ID NO: 8210 - DNA, 22 bp, synthetic construct
  misc_feature 1..22: note = Description of Artificial Sequence: Syntheticoligonucleotide
  source 1..22: mol_type = other DNA
gggactcgttaacgagtcccag

SEQ ID NO: 8211 - DNA, 22 bp, synthetic construct
  misc_feature 1..22: note = Description of Artificial Sequence: Syntheticoligonucleotide
  source 1..22: mol_type = other DNA
tggactcgttaacgagtccagg

SEQ ID NO: 8212 - DNA, 22 bp, synthetic construct
  misc_feature 1..22: note = Description of Artificial Sequence: Syntheticoligonucleotide
  source 1..22: mol_type = other DNA
gtgactcgttaacgagtcacgg

SEQ ID NO: 8213 - DNA, 22 bp, synthetic construct
  misc_feature 1..22: note = Description of Artificial Sequence: Syntheticoligonucleotide
  source 1..22: mol_type = other DNA
gcgactcgttaacgagtcgccg

SEQ ID NO: 8214 - DNA, 22 bp, synthetic construct
  misc_feature 1..22: note = Description of Artificial Sequence: Syntheticoligonucleotide
  source 1..22: mol_type = other DNA
gcgactcgttaacgagtcgctg

SEQ ID NO: 8215 - DNA, 22 bp, synthetic construct
  misc_feature 1..22: note = Description of Artificial Sequence: Syntheticoligonucleotide
  source 1..22: mol_type = other DNA
acgactcgttaacgagtcgtcg

SEQ ID NO: 8216 - DNA, 22 bp, synthetic construct
  misc_feature 1..22: note = Description of Artificial Sequence: Syntheticoligonucleotide
  source 1..22: mol_type = other DNA
gagactcgttaacgagtctccg

SEQ ID NO: 8217 - DNA, 22 bp, synthetic construct
  misc_feature 1..22: note = Description of Artificial Sequence: Syntheticoligonucleotide
  source 1..22: mol_type = other DNA
gcgactcgttaacgagtcgcag

SEQ ID NO: 8218 - DNA, 22 bp, synthetic construct
  misc_feature 1..22: note = Description of Artificial Sequence: Syntheticoligonucleotide
  source 1..22: mol_type = other DNA
gtgactcgttaacgagtcaccg

SEQ ID NO: 8219 - DNA, 22 bp, synthetic construct
  misc_feature 1..22: note = Description of Artificial Sequence: Syntheticoligonucleotide
  source 1..22: mol_type = other DNA
cggactcgttaacgagtccgtg

SEQ ID NO: 8220 - DNA, 22 bp, synthetic construct
  misc_feature 1..22: note = Description of Artificial Sequence: Syntheticoligonucleotide
  source 1..22: mol_type = other DNA
cagactcgttaacgagtctggg

SEQ ID NO: 8221 - DNA, 22 bp, synthetic construct
  misc_feature 1..22: note = Description of Artificial Sequence: Syntheticoligonucleotide
  source 1..22: mol_type = other DNA
cggactcgttaacgagtccgag

SEQ ID NO: 8222 - DNA, 22 bp, synthetic construct
  misc_feature 1..22: note = Description of Artificial Sequence: Syntheticoligonucleotide
  source 1..22: mol_type = other DNA
ctgactcgttaacgagtcaggg

SEQ ID NO: 8223 - DNA, 22 bp, synthetic construct
  misc_feature 1..22: note = Description of Artificial Sequence: Syntheticoligonucleotide
  source 1..22: mol_type = other DNA
acgactcgttaacgagtcgtgg

SEQ ID NO: 8224 - DNA, 22 bp, synthetic construct
  misc_feature 1..22: note = Description of Artificial Sequence: Syntheticoligonucleotide
  source 1..22: mol_type = other DNA
ccgactcgttaacgagtcggct

SEQ ID NO: 8225 - DNA, 22 bp, synthetic construct
  misc_feature 1..22: note = Description of Artificial Sequence: Syntheticoligonucleotide
  source 1..22: mol_type = other DNA
ccgactcgttaacgagtcggca

SEQ ID NO: 8226 - DNA, 22 bp, synthetic construct
  misc_feature 1..22: note = Description of Artificial Sequence: Syntheticoligonucleotide
  source 1..22: mol_type = other DNA
gagactcgttaacgagtctcgc

SEQ ID NO: 8227 - DNA, 22 bp, synthetic construct
  misc_feature 1..22: note = Description of Artificial Sequence: Syntheticoligonucleotide
  source 1..22: mol_type = other DNA
gtgactcgttaacgagtcacgc

SEQ ID NO: 8228 - DNA, 22 bp, synthetic construct
  misc_feature 1..22: note = Description of Artificial Sequence: Syntheticoligonucleotide
  source 1..22: mol_type = other DNA
aggactcgttaacgagtcctgc

SEQ ID NO: 8229 - DNA, 22 bp, synthetic construct
  misc_feature 1..22: note = Description of Artificial Sequence: Syntheticoligonucleotide
  source 1..22: mol_type = other DNA
tggactcgttaacgagtccagc

SEQ ID NO: 8230 - DNA, 22 bp, synthetic construct
  misc_feature 1..22: note = Description of Artificial Sequence: Syntheticoligonucleotide
  source 1..22: mol_type = other DNA
aggactcgttaacgagtcctcg

SEQ ID NO: 8231 - DNA, 22 bp, synthetic construct
  misc_feature 1..22: note = Description of Artificial Sequence: Syntheticoligonucleotide
  source 1..22: mol_type = other DNA
tggactcgttaacgagtccacg

SEQ ID NO: 8232 - DNA, 22 bp, synthetic construct
  misc_feature 1..22: note = Description of Artificial Sequence: Syntheticoligonucleotide
  source 1..22: mol_type = other DNA
ccgactcgttaacgagtcggtg

SEQ ID NO: 8233 - DNA, 22 bp, synthetic construct
  misc_feature 1..22: note = Description of Artificial Sequence: Syntheticoligonucleotide
  source 1..22: mol_type = other DNA
ccgactcgttaacgagtcggag

SEQ ID NO: 8234 - DNA, 22 bp, synthetic construct
  misc_feature 1..22: note = Description of Artificial Sequence: Syntheticoligonucleotide
  source 1..22: mol_type = other DNA
gggactcgttaacgagtcccgc

SEQ ID NO: 8235 - DNA, 22 bp, synthetic construct
  misc_feature 1..22: note = Description of Artificial Sequence: Syntheticoligonucleotide
  source 1..22: mol_type = other DNA
gggactcgttaacgagtccctc

SEQ ID NO: 8236 - DNA, 22 bp, synthetic construct
  misc_feature 1..22: note = Description of Artificial Sequence: Syntheticoligonucleotide
  source 1..22: mol_type = other DNA
gggactcgttaacgagtcccac

SEQ ID NO: 8237 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcgtgcacgagtcnnnn

SEQ ID NO: 8238 - DNA, 22 bp, synthetic construct
  misc_feature 1..22: note = Description of Artificial Sequence: Syntheticoligonucleotide
  source 1..22: mol_type = other DNA
cggactcgtgcacgagtccgcc

SEQ ID NO: 8239 - DNA, 22 bp, synthetic construct
  misc_feature 1..22: note = Description of Artificial Sequence: Syntheticoligonucleotide
  source 1..22: mol_type = other DNA
cggactcgtgcacgagtccgct

SEQ ID NO: 8240 - DNA, 22 bp, synthetic construct
  misc_feature 1..22: note = Description of Artificial Sequence: Syntheticoligonucleotide
  source 1..22: mol_type = other DNA
cggactcgtgcacgagtccgtc

SEQ ID NO: 8241 - DNA, 22 bp, synthetic construct
  misc_feature 1..22: note = Description of Artificial Sequence: Syntheticoligonucleotide
  source 1..22: mol_type = other DNA
aggactcgtgcacgagtcctcc

SEQ ID NO: 8242 - DNA, 22 bp, synthetic construct
  misc_feature 1..22: note = Description of Artificial Sequence: Syntheticoligonucleotide
  source 1..22: mol_type = other DNA
cagactcgtgcacgagtctgcc

SEQ ID NO: 8243 - DNA, 22 bp, synthetic construct
  misc_feature 1..22: note = Description of Artificial Sequence: Syntheticoligonucleotide
  source 1..22: mol_type = other DNA
cggactcgtgcacgagtccgca

SEQ ID NO: 8244 - DNA, 22 bp, synthetic construct
  misc_feature 1..22: note = Description of Artificial Sequence: Syntheticoligonucleotide
  source 1..22: mol_type = other DNA
cggactcgtgcacgagtccgac

SEQ ID NO: 8245 - DNA, 22 bp, synthetic construct
  misc_feature 1..22: note = Description of Artificial Sequence: Syntheticoligonucleotide
  source 1..22: mol_type = other DNA
tggactcgtgcacgagtccacc

SEQ ID NO: 8246 - DNA, 22 bp, synthetic construct
  misc_feature 1..22: note = Description of Artificial Sequence: Syntheticoligonucleotide
  source 1..22: mol_type = other DNA
ctgactcgtgcacgagtcagcc

SEQ ID NO: 8247 - DNA, 22 bp, synthetic construct
  misc_feature 1..22: note = Description of Artificial Sequence: Syntheticoligonucleotide
  source 1..22: mol_type = other DNA
ccgactcgtgcacgagtcgggc

SEQ ID NO: 8248 - DNA, 22 bp, synthetic construct
  misc_feature 1..22: note = Description of Artificial Sequence: Syntheticoligonucleotide
  source 1..22: mol_type = other DNA
ccgactcgtgcacgagtcgggt

SEQ ID NO: 8249 - DNA, 22 bp, synthetic construct
  misc_feature 1..22: note = Description of Artificial Sequence: Syntheticoligonucleotide
  source 1..22: mol_type = other DNA
ccgactcgtgcacgagtcggtc

SEQ ID NO: 8250 - DNA, 22 bp, synthetic construct
  misc_feature 1..22: note = Description of Artificial Sequence: Syntheticoligonucleotide
  source 1..22: mol_type = other DNA
acgactcgtgcacgagtcgtgc

SEQ ID NO: 8251 - DNA, 22 bp, synthetic construct
  misc_feature 1..22: note = Description of Artificial Sequence: Syntheticoligonucleotide
  source 1..22: mol_type = other DNA
cagactcgtgcacgagtctggc

SEQ ID NO: 8252 - DNA, 22 bp, synthetic construct
  misc_feature 1..22: note = Description of Artificial Sequence: Syntheticoligonucleotide
  source 1..22: mol_type = other DNA
ccgactcgtgcacgagtcggga

SEQ ID NO: 8253 - DNA, 22 bp, synthetic construct
  misc_feature 1..22: note = Description of Artificial Sequence: Syntheticoligonucleotide
  source 1..22: mol_type = other DNA
ccgactcgtgcacgagtcggac

SEQ ID NO: 8254 - DNA, 22 bp, synthetic construct
  misc_feature 1..22: note = Description of Artificial Sequence: Syntheticoligonucleotide
  source 1..22: mol_type = other DNA
ctgactcgtgcacgagtcaggc

SEQ ID NO: 8255 - DNA, 22 bp, synthetic construct
  misc_feature 1..22: note = Description of Artificial Sequence: Syntheticoligonucleotide
  source 1..22: mol_type = other DNA
gcgactcgtgcacgagtcgccc

SEQ ID NO: 8256 - DNA, 22 bp, synthetic construct
  misc_feature 1..22: note = Description of Artificial Sequence: Syntheticoligonucleotide
  source 1..22: mol_type = other DNA
gcgactcgtgcacgagtcgcct

SEQ ID NO: 8257 - DNA, 22 bp, synthetic construct
  misc_feature 1..22: note = Description of Artificial Sequence: Syntheticoligonucleotide
  source 1..22: mol_type = other DNA
gcgactcgtgcacgagtcgctc

SEQ ID NO: 8258 - DNA, 22 bp, synthetic construct
  misc_feature 1..22: note = Description of Artificial Sequence: Syntheticoligonucleotide
  source 1..22: mol_type = other DNA
acgactcgtgcacgagtcgtcc

SEQ ID NO: 8259 - DNA, 22 bp, synthetic construct
  misc_feature 1..22: note = Description of Artificial Sequence: Syntheticoligonucleotide
  source 1..22: mol_type = other DNA
gagactcgtgcacgagtctccc

SEQ ID NO: 8260 - DNA, 22 bp, synthetic construct
  misc_feature 1..22: note = Description of Artificial Sequence: Syntheticoligonucleotide
  source 1..22: mol_type = other DNA
gcgactcgtgcacgagtcgcca

SEQ ID NO: 8261 - DNA, 22 bp, synthetic construct
  misc_feature 1..22: note = Description of Artificial Sequence: Syntheticoligonucleotide
  source 1..22: mol_type = other DNA
gcgactcgtgcacgagtcgcac

SEQ ID NO: 8262 - DNA, 22 bp, synthetic construct
  misc_feature 1..22: note = Description of Artificial Sequence: Syntheticoligonucleotide
  source 1..22: mol_type = other DNA
gtgactcgtgcacgagtcaccc

SEQ ID NO: 8263 - DNA, 22 bp, synthetic construct
  misc_feature 1..22: note = Description of Artificial Sequence: Syntheticoligonucleotide
  source 1..22: mol_type = other DNA
gggactcgtgcacgagtcccgt

SEQ ID NO: 8264 - DNA, 22 bp, synthetic construct
  misc_feature 1..22: note = Description of Artificial Sequence: Syntheticoligonucleotide
  source 1..22: mol_type = other DNA
gggactcgtgcacgagtccctg

SEQ ID NO: 8265 - DNA, 22 bp, synthetic construct
  misc_feature 1..22: note = Description of Artificial Sequence: Syntheticoligonucleotide
  source 1..22: mol_type = other DNA
aggactcgtgcacgagtcctgg

SEQ ID NO: 8266 - DNA, 22 bp, synthetic construct
  misc_feature 1..22: note = Description of Artificial Sequence: Syntheticoligonucleotide
  source 1..22: mol_type = other DNA
gagactcgtgcacgagtctcgg

SEQ ID NO: 8267 - DNA, 22 bp, synthetic construct
  misc_feature 1..22: note = Description of Artificial Sequence: Syntheticoligonucleotide
  source 1..22: mol_type = other DNA
gggactcgtgcacgagtcccga

SEQ ID NO: 8268 - DNA, 22 bp, synthetic construct
  misc_feature 1..22: note = Description of Artificial Sequence: Syntheticoligonucleotide
  source 1..22: mol_type = other DNA
gggactcgtgcacgagtcccag

SEQ ID NO: 8269 - DNA, 22 bp, synthetic construct
  misc_feature 1..22: note = Description of Artificial Sequence: Syntheticoligonucleotide
  source 1..22: mol_type = other DNA
tggactcgtgcacgagtccagg

SEQ ID NO: 8270 - DNA, 22 bp, synthetic construct
  misc_feature 1..22: note = Description of Artificial Sequence: Syntheticoligonucleotide
  source 1..22: mol_type = other DNA
gtgactcgtgcacgagtcacgg

SEQ ID NO: 8271 - DNA, 22 bp, synthetic construct
  misc_feature 1..22: note = Description of Artificial Sequence: Syntheticoligonucleotide
  source 1..22: mol_type = other DNA
gcgactcgtgcacgagtcgccg

SEQ ID NO: 8272 - DNA, 22 bp, synthetic construct
  misc_feature 1..22: note = Description of Artificial Sequence: Syntheticoligonucleotide
  source 1..22: mol_type = other DNA
gcgactcgtgcacgagtcgctg

SEQ ID NO: 8273 - DNA, 22 bp, synthetic construct
  misc_feature 1..22: note = Description of Artificial Sequence: Syntheticoligonucleotide
  source 1..22: mol_type = other DNA
acgactcgtgcacgagtcgtcg

SEQ ID NO: 8274 - DNA, 22 bp, synthetic construct
  misc_feature 1..22: note = Description of Artificial Sequence: Syntheticoligonucleotide
  source 1..22: mol_type = other DNA
gagactcgtgcacgagtctccg

SEQ ID NO: 8275 - DNA, 22 bp, synthetic construct
  misc_feature 1..22: note = Description of Artificial Sequence: Syntheticoligonucleotide
  source 1..22: mol_type = other DNA
gcgactcgtgcacgagtcgcag

SEQ ID NO: 8276 - DNA, 22 bp, synthetic construct
  misc_feature 1..22: note = Description of Artificial Sequence: Syntheticoligonucleotide
  source 1..22: mol_type = other DNA
gtgactcgtgcacgagtcaccg

SEQ ID NO: 8277 - DNA, 22 bp, synthetic construct
  misc_feature 1..22: note = Description of Artificial Sequence: Syntheticoligonucleotide
  source 1..22: mol_type = other DNA
cggactcgtgcacgagtccgtg

SEQ ID NO: 8278 - DNA, 22 bp, synthetic construct
  misc_feature 1..22: note = Description of Artificial Sequence: Syntheticoligonucleotide
  source 1..22: mol_type = other DNA
cagactcgtgcacgagtctggg

SEQ ID NO: 8279 - DNA, 22 bp, synthetic construct
  misc_feature 1..22: note = Description of Artificial Sequence: Syntheticoligonucleotide
  source 1..22: mol_type = other DNA
cggactcgtgcacgagtccgag

SEQ ID NO: 8280 - DNA, 22 bp, synthetic construct
  misc_feature 1..22: note = Description of Artificial Sequence: Syntheticoligonucleotide
  source 1..22: mol_type = other DNA
ctgactcgtgcacgagtcaggg

SEQ ID NO: 8281 - DNA, 22 bp, synthetic construct
  misc_feature 1..22: note = Description of Artificial Sequence: Syntheticoligonucleotide
  source 1..22: mol_type = other DNA
acgactcgtgcacgagtcgtgg

SEQ ID NO: 8282 - DNA, 22 bp, synthetic construct
  misc_feature 1..22: note = Description of Artificial Sequence: Syntheticoligonucleotide
  source 1..22: mol_type = other DNA
ccgactcgtgcacgagtcggct

SEQ ID NO: 8283 - DNA, 22 bp, synthetic construct
  misc_feature 1..22: note = Description of Artificial Sequence: Syntheticoligonucleotide
  source 1..22: mol_type = other DNA
ccgactcgtgcacgagtcggca

SEQ ID NO: 8284 - DNA, 22 bp, synthetic construct
  misc_feature 1..22: note = Description of Artificial Sequence: Syntheticoligonucleotide
  source 1..22: mol_type = other DNA
gagactcgtgcacgagtctcgc

SEQ ID NO: 8285 - DNA, 22 bp, synthetic construct
  misc_feature 1..22: note = Description of Artificial Sequence: Syntheticoligonucleotide
  source 1..22: mol_type = other DNA
gtgactcgtgcacgagtcacgc

SEQ ID NO: 8286 - DNA, 22 bp, synthetic construct
  misc_feature 1..22: note = Description of Artificial Sequence: Syntheticoligonucleotide
  source 1..22: mol_type = other DNA
aggactcgtgcacgagtcctgc

SEQ ID NO: 8287 - DNA, 22 bp, synthetic construct
  misc_feature 1..22: note = Description of Artificial Sequence: Syntheticoligonucleotide
  source 1..22: mol_type = other DNA
tggactcgtgcacgagtccagc

SEQ ID NO: 8288 - DNA, 22 bp, synthetic construct
  misc_feature 1..22: note = Description of Artificial Sequence: Syntheticoligonucleotide
  source 1..22: mol_type = other DNA
aggactcgtgcacgagtcctcg

SEQ ID NO: 8289 - DNA, 22 bp, synthetic construct
  misc_feature 1..22: note = Description of Artificial Sequence: Syntheticoligonucleotide
  source 1..22: mol_type = other DNA
tggactcgtgcacgagtccacg

SEQ ID NO: 8290 - DNA, 22 bp, synthetic construct
  misc_feature 1..22: note = Description of Artificial Sequence: Syntheticoligonucleotide
  source 1..22: mol_type = other DNA
ccgactcgtgcacgagtcggtg

SEQ ID NO: 8291 - DNA, 22 bp, synthetic construct
  misc_feature 1..22: note = Description of Artificial Sequence: Syntheticoligonucleotide
  source 1..22: mol_type = other DNA
ccgactcgtgcacgagtcggag

SEQ ID NO: 8292 - DNA, 22 bp, synthetic construct
  misc_feature 1..22: note = Description of Artificial Sequence: Syntheticoligonucleotide
  source 1..22: mol_type = other DNA
gggactcgtgcacgagtcccgc

SEQ ID NO: 8293 - DNA, 22 bp, synthetic construct
  misc_feature 1..22: note = Description of Artificial Sequence: Syntheticoligonucleotide
  source 1..22: mol_type = other DNA
gggactcgtgcacgagtccctc

SEQ ID NO: 8294 - DNA, 22 bp, synthetic construct
  misc_feature 1..22: note = Description of Artificial Sequence: Syntheticoligonucleotide
  source 1..22: mol_type = other DNA
gggactcgtgcacgagtcccac

SEQ ID NO: 8295 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcgtcgacgagtcnnnn

SEQ ID NO: 8296 - DNA, 22 bp, synthetic construct
  misc_feature 1..22: note = Description of Artificial Sequence: Syntheticoligonucleotide
  source 1..22: mol_type = other DNA
cggactcgtcgacgagtccgcc

SEQ ID NO: 8297 - DNA, 22 bp, synthetic construct
  misc_feature 1..22: note = Description of Artificial Sequence: Syntheticoligonucleotide
  source 1..22: mol_type = other DNA
cggactcgtcgacgagtccgct

SEQ ID NO: 8298 - DNA, 22 bp, synthetic construct
  misc_feature 1..22: note = Description of Artificial Sequence: Syntheticoligonucleotide
  source 1..22: mol_type = other DNA
cggactcgtcgacgagtccgtc

SEQ ID NO: 8299 - DNA, 22 bp, synthetic construct
  misc_feature 1..22: note = Description of Artificial Sequence: Syntheticoligonucleotide
  source 1..22: mol_type = other DNA
aggactcgtcgacgagtcctcc

SEQ ID NO: 8300 - DNA, 22 bp, synthetic construct
  misc_feature 1..22: note = Description of Artificial Sequence: Syntheticoligonucleotide
  source 1..22: mol_type = other DNA
cagactcgtcgacgagtctgcc

SEQ ID NO: 8301 - DNA, 22 bp, synthetic construct
  misc_feature 1..22: note = Description of Artificial Sequence: Syntheticoligonucleotide
  source 1..22: mol_type = other DNA
cggactcgtcgacgagtccgca

SEQ ID NO: 8302 - DNA, 22 bp, synthetic construct
  misc_feature 1..22: note = Description of Artificial Sequence: Syntheticoligonucleotide
  source 1..22: mol_type = other DNA
cggactcgtcgacgagtccgac

SEQ ID NO: 8303 - DNA, 22 bp, synthetic construct
  misc_feature 1..22: note = Description of Artificial Sequence: Syntheticoligonucleotide
  source 1..22: mol_type = other DNA
tggactcgtcgacgagtccacc

SEQ ID NO: 8304 - DNA, 22 bp, synthetic construct
  misc_feature 1..22: note = Description of Artificial Sequence: Syntheticoligonucleotide
  source 1..22: mol_type = other DNA
ctgactcgtcgacgagtcagcc

SEQ ID NO: 8305 - DNA, 22 bp, synthetic construct
  misc_feature 1..22: note = Description of Artificial Sequence: Syntheticoligonucleotide
  source 1..22: mol_type = other DNA
ccgactcgtcgacgagtcgggc

SEQ ID NO: 8306 - DNA, 22 bp, synthetic construct
  misc_feature 1..22: note = Description of Artificial Sequence: Syntheticoligonucleotide
  source 1..22: mol_type = other DNA
ccgactcgtcgacgagtcgggt

SEQ ID NO: 8307 - DNA, 22 bp, synthetic construct
  misc_feature 1..22: note = Description of Artificial Sequence: Syntheticoligonucleotide
  source 1..22: mol_type = other DNA
ccgactcgtcgacgagtcggtc

SEQ ID NO: 8308 - DNA, 22 bp, synthetic construct
  misc_feature 1..22: note = Description of Artificial Sequence: Syntheticoligonucleotide
  source 1..22: mol_type = other DNA
acgactcgtcgacgagtcgtgc

SEQ ID NO: 8309 - DNA, 22 bp, synthetic construct
  misc_feature 1..22: note = Description of Artificial Sequence: Syntheticoligonucleotide
  source 1..22: mol_type = other DNA
cagactcgtcgacgagtctggc

SEQ ID NO: 8310 - DNA, 22 bp, synthetic construct
  misc_feature 1..22: note = Description of Artificial Sequence: Syntheticoligonucleotide
  source 1..22: mol_type = other DNA
ccgactcgtcgacgagtcggga

SEQ ID NO: 8311 - DNA, 22 bp, synthetic construct
  misc_feature 1..22: note = Description of Artificial Sequence: Syntheticoligonucleotide
  source 1..22: mol_type = other DNA
ccgactcgtcgacgagtcggac

SEQ ID NO: 8312 - DNA, 22 bp, synthetic construct
  misc_feature 1..22: note = Description of Artificial Sequence: Syntheticoligonucleotide
  source 1..22: mol_type = other DNA
ctgactcgtcgacgagtcaggc

SEQ ID NO: 8313 - DNA, 22 bp, synthetic construct
  misc_feature 1..22: note = Description of Artificial Sequence: Syntheticoligonucleotide
  source 1..22: mol_type = other DNA
gcgactcgtcgacgagtcgccc

SEQ ID NO: 8314 - DNA, 22 bp, synthetic construct
  misc_feature 1..22: note = Description of Artificial Sequence: Syntheticoligonucleotide
  source 1..22: mol_type = other DNA
gcgactcgtcgacgagtcgcct

SEQ ID NO: 8315 - DNA, 22 bp, synthetic construct
  misc_feature 1..22: note = Description of Artificial Sequence: Syntheticoligonucleotide
  source 1..22: mol_type = other DNA
gcgactcgtcgacgagtcgctc

SEQ ID NO: 8316 - DNA, 22 bp, synthetic construct
  misc_feature 1..22: note = Description of Artificial Sequence: Syntheticoligonucleotide
  source 1..22: mol_type = other DNA
acgactcgtcgacgagtcgtcc

SEQ ID NO: 8317 - DNA, 22 bp, synthetic construct
  misc_feature 1..22: note = Description of Artificial Sequence: Syntheticoligonucleotide
  source 1..22: mol_type = other DNA
gagactcgtcgacgagtctccc

SEQ ID NO: 8318 - DNA, 22 bp, synthetic construct
  misc_feature 1..22: note = Description of Artificial Sequence: Syntheticoligonucleotide
  source 1..22: mol_type = other DNA
gcgactcgtcgacgagtcgcca

SEQ ID NO: 8319 - DNA, 22 bp, synthetic construct
  misc_feature 1..22: note = Description of Artificial Sequence: Syntheticoligonucleotide
  source 1..22: mol_type = other DNA
gcgactcgtcgacgagtcgcac

SEQ ID NO: 8320 - DNA, 22 bp, synthetic construct
  misc_feature 1..22: note = Description of Artificial Sequence: Syntheticoligonucleotide
  source 1..22: mol_type = other DNA
gtgactcgtcgacgagtcaccc

SEQ ID NO: 8321 - DNA, 22 bp, synthetic construct
  misc_feature 1..22: note = Description of Artificial Sequence: Syntheticoligonucleotide
  source 1..22: mol_type = other DNA
gggactcgtcgacgagtcccgt

SEQ ID NO: 8322 - DNA, 22 bp, synthetic construct
  misc_feature 1..22: note = Description of Artificial Sequence: Syntheticoligonucleotide
  source 1..22: mol_type = other DNA
gggactcgtcgacgagtccctg

SEQ ID NO: 8323 - DNA, 22 bp, synthetic construct
  misc_feature 1..22: note = Description of Artificial Sequence: Syntheticoligonucleotide
  source 1..22: mol_type = other DNA
aggactcgtcgacgagtcctgg

SEQ ID NO: 8324 - DNA, 22 bp, synthetic construct
  misc_feature 1..22: note = Description of Artificial Sequence: Syntheticoligonucleotide
  source 1..22: mol_type = other DNA
gagactcgtcgacgagtctcgg

SEQ ID NO: 8325 - DNA, 22 bp, synthetic construct
  misc_feature 1..22: note = Description of Artificial Sequence: Syntheticoligonucleotide
  source 1..22: mol_type = other DNA
gggactcgtcgacgagtcccga

SEQ ID NO: 8326 - DNA, 22 bp, synthetic construct
  misc_feature 1..22: note = Description of Artificial Sequence: Syntheticoligonucleotide
  source 1..22: mol_type = other DNA
gggactcgtcgacgagtcccag

SEQ ID NO: 8327 - DNA, 22 bp, synthetic construct
  misc_feature 1..22: note = Description of Artificial Sequence: Syntheticoligonucleotide
  source 1..22: mol_type = other DNA
tggactcgtcgacgagtccagg

SEQ ID NO: 8328 - DNA, 22 bp, synthetic construct
  misc_feature 1..22: note = Description of Artificial Sequence: Syntheticoligonucleotide
  source 1..22: mol_type = other DNA
gtgactcgtcgacgagtcacgg

SEQ ID NO: 8329 - DNA, 22 bp, synthetic construct
  misc_feature 1..22: note = Description of Artificial Sequence: Syntheticoligonucleotide
  source 1..22: mol_type = other DNA
gcgactcgtcgacgagtcgccg

SEQ ID NO: 8330 - DNA, 22 bp, synthetic construct
  misc_feature 1..22: note = Description of Artificial Sequence: Syntheticoligonucleotide
  source 1..22: mol_type = other DNA
gcgactcgtcgacgagtcgctg

SEQ ID NO: 8331 - DNA, 22 bp, synthetic construct
  misc_feature 1..22: note = Description of Artificial Sequence: Syntheticoligonucleotide
  source 1..22: mol_type = other DNA
acgactcgtcgacgagtcgtcg

SEQ ID NO: 8332 - DNA, 22 bp, synthetic construct
  misc_feature 1..22: note = Description of Artificial Sequence: Syntheticoligonucleotide
  source 1..22: mol_type = other DNA
gagactcgtcgacgagtctccg

SEQ ID NO: 8333 - DNA, 22 bp, synthetic construct
  misc_feature 1..22: note = Description of Artificial Sequence: Syntheticoligonucleotide
  source 1..22: mol_type = other DNA
gcgactcgtcgacgagtcgcag

SEQ ID NO: 8334 - DNA, 22 bp, synthetic construct
  misc_feature 1..22: note = Description of Artificial Sequence: Syntheticoligonucleotide
  source 1..22: mol_type = other DNA
gtgactcgtcgacgagtcaccg

SEQ ID NO: 8335 - DNA, 22 bp, synthetic construct
  misc_feature 1..22: note = Description of Artificial Sequence: Syntheticoligonucleotide
  source 1..22: mol_type = other DNA
cggactcgtcgacgagtccgtg

SEQ ID NO: 8336 - DNA, 22 bp, synthetic construct
  misc_feature 1..22: note = Description of Artificial Sequence: Syntheticoligonucleotide
  source 1..22: mol_type = other DNA
cagactcgtcgacgagtctggg

SEQ ID NO: 8337 - DNA, 22 bp, synthetic construct
  misc_feature 1..22: note = Description of Artificial Sequence: Syntheticoligonucleotide
  source 1..22: mol_type = other DNA
cggactcgtcgacgagtccgag

SEQ ID NO: 8338 - DNA, 22 bp, synthetic construct
  misc_feature 1..22: note = Description of Artificial Sequence: Syntheticoligonucleotide
  source 1..22: mol_type = other DNA
ctgactcgtcgacgagtcaggg

SEQ ID NO: 8339 - DNA, 22 bp, synthetic construct
  misc_feature 1..22: note = Description of Artificial Sequence: Syntheticoligonucleotide
  source 1..22: mol_type = other DNA
acgactcgtcgacgagtcgtgg

SEQ ID NO: 8340 - DNA, 22 bp, synthetic construct
  misc_feature 1..22: note = Description of Artificial Sequence: Syntheticoligonucleotide
  source 1..22: mol_type = other DNA
ccgactcgtcgacgagtcggct

SEQ ID NO: 8341 - DNA, 22 bp, synthetic construct
  misc_feature 1..22: note = Description of Artificial Sequence: Syntheticoligonucleotide
  source 1..22: mol_type = other DNA
ccgactcgtcgacgagtcggca

SEQ ID NO: 8342 - DNA, 22 bp, synthetic construct
  misc_feature 1..22: note = Description of Artificial Sequence: Syntheticoligonucleotide
  source 1..22: mol_type = other DNA
gagactcgtcgacgagtctcgc

SEQ ID NO: 8343 - DNA, 22 bp, synthetic construct
  misc_feature 1..22: note = Description of Artificial Sequence: Syntheticoligonucleotide
  source 1..22: mol_type = other DNA
gtgactcgtcgacgagtcacgc

SEQ ID NO: 8344 - DNA, 22 bp, synthetic construct
  misc_feature 1..22: note = Description of Artificial Sequence: Syntheticoligonucleotide
  source 1..22: mol_type = other DNA
aggactcgtcgacgagtcctgc

SEQ ID NO: 8345 - DNA, 22 bp, synthetic construct
  misc_feature 1..22: note = Description of Artificial Sequence: Syntheticoligonucleotide
  source 1..22: mol_type = other DNA
tggactcgtcgacgagtccagc

SEQ ID NO: 8346 - DNA, 22 bp, synthetic construct
  misc_feature 1..22: note = Description of Artificial Sequence: Syntheticoligonucleotide
  source 1..22: mol_type = other DNA
aggactcgtcgacgagtcctcg

SEQ ID NO: 8347 - DNA, 22 bp, synthetic construct
  misc_feature 1..22: note = Description of Artificial Sequence: Syntheticoligonucleotide
  source 1..22: mol_type = other DNA
tggactcgtcgacgagtccacg

SEQ ID NO: 8348 - DNA, 22 bp, synthetic construct
  misc_feature 1..22: note = Description of Artificial Sequence: Syntheticoligonucleotide
  source 1..22: mol_type = other DNA
ccgactcgtcgacgagtcggtg

SEQ ID NO: 8349 - DNA, 22 bp, synthetic construct
  misc_feature 1..22: note = Description of Artificial Sequence: Syntheticoligonucleotide
  source 1..22: mol_type = other DNA
ccgactcgtcgacgagtcggag

SEQ ID NO: 8350 - DNA, 22 bp, synthetic construct
  misc_feature 1..22: note = Description of Artificial Sequence: Syntheticoligonucleotide
  source 1..22: mol_type = other DNA
gggactcgtcgacgagtcccgc

SEQ ID NO: 8351 - DNA, 22 bp, synthetic construct
  misc_feature 1..22: note = Description of Artificial Sequence: Syntheticoligonucleotide
  source 1..22: mol_type = other DNA
gggactcgtcgacgagtccctc

SEQ ID NO: 8352 - DNA, 22 bp, synthetic construct
  misc_feature 1..22: note = Description of Artificial Sequence: Syntheticoligonucleotide
  source 1..22: mol_type = other DNA
gggactcgtcgacgagtcccac

SEQ ID NO: 8353 - DNA, 22 bp, synthetic construct
  misc_feature 1..22: note = Description of Artificial Sequence: Syntheticoligonucleotide
  source 1..22: mol_type = other DNA
ccgactcctataggagtcggtc

SEQ ID NO: 8354 - DNA, 22 bp, synthetic construct
  misc_feature 1..22: note = Description of Artificial Sequence: Syntheticoligonucleotide
  source 1..22: mol_type = other DNA
acgactcctataggagtcgtgc

SEQ ID NO: 8355 - DNA, 22 bp, synthetic construct
  misc_feature 1..22: note = Description of Artificial Sequence: Syntheticoligonucleotide
  source 1..22: mol_type = other DNA
cagactcctataggagtctggc

SEQ ID NO: 8356 - DNA, 22 bp, synthetic construct
  misc_feature 1..22: note = Description of Artificial Sequence: Syntheticoligonucleotide
  source 1..22: mol_type = other DNA
ccgactcctataggagtcggga

SEQ ID NO: 8357 - DNA, 22 bp, synthetic construct
  misc_feature 1..22: note = Description of Artificial Sequence: Syntheticoligonucleotide
  source 1..22: mol_type = other DNA
ccgactcctataggagtcggac

SEQ ID NO: 8358 - DNA, 22 bp, synthetic construct
  misc_feature 1..22: note = Description of Artificial Sequence: Syntheticoligonucleotide
  source 1..22: mol_type = other DNA
ctgactcctataggagtcaggc

SEQ ID NO: 8359 - DNA, 22 bp, synthetic construct
  misc_feature 1..22: note = Description of Artificial Sequence: Syntheticoligonucleotide
  source 1..22: mol_type = other DNA
gcgactcctataggagtcgccc

SEQ ID NO: 8360 - DNA, 22 bp, synthetic construct
  misc_feature 1..22: note = Description of Artificial Sequence: Syntheticoligonucleotide
  source 1..22: mol_type = other DNA
gcgactcctataggagtcgcct

SEQ ID NO: 8361 - DNA, 22 bp, synthetic construct
  misc_feature 1..22: note = Description of Artificial Sequence: Syntheticoligonucleotide
  source 1..22: mol_type = other DNA
gcgactcctataggagtcgctc

SEQ ID NO: 8362 - DNA, 22 bp, synthetic construct
  misc_feature 1..22: note = Description of Artificial Sequence: Syntheticoligonucleotide
  source 1..22: mol_type = other DNA
acgactcctataggagtcgtcc

SEQ ID NO: 8363 - DNA, 22 bp, synthetic construct
  misc_feature 1..22: note = Description of Artificial Sequence: Syntheticoligonucleotide
  source 1..22: mol_type = other DNA
gagactcctataggagtctccc

SEQ ID NO: 8364 - DNA, 22 bp, synthetic construct
  misc_feature 1..22: note = Description of Artificial Sequence: Syntheticoligonucleotide
  source 1..22: mol_type = other DNA
gcgactcctataggagtcgcca

SEQ ID NO: 8365 - DNA, 22 bp, synthetic construct
  misc_feature 1..22: note = Description of Artificial Sequence: Syntheticoligonucleotide
  source 1..22: mol_type = other DNA
gcgactcctataggagtcgcac

SEQ ID NO: 8366 - DNA, 22 bp, synthetic construct
  misc_feature 1..22: note = Description of Artificial Sequence: Syntheticoligonucleotide
  source 1..22: mol_type = other DNA
gtgactcctataggagtcaccc

SEQ ID NO: 8367 - DNA, 22 bp, synthetic construct
  misc_feature 1..22: note = Description of Artificial Sequence: Syntheticoligonucleotide
  source 1..22: mol_type = other DNA
gggactcctataggagtcccgt

SEQ ID NO: 8368 - DNA, 22 bp, synthetic construct
  misc_feature 1..22: note = Description of Artificial Sequence: Syntheticoligonucleotide
  source 1..22: mol_type = other DNA
gggactcctataggagtccctg

SEQ ID NO: 8369 - DNA, 22 bp, synthetic construct
  misc_feature 1..22: note = Description of Artificial Sequence: Syntheticoligonucleotide
  source 1..22: mol_type = other DNA
aggactcctataggagtcctgg

SEQ ID NO: 8370 - DNA, 22 bp, synthetic construct
  misc_feature 1..22: note = Description of Artificial Sequence: Syntheticoligonucleotide
  source 1..22: mol_type = other DNA
gagactcctataggagtctcgg

SEQ ID NO: 8371 - DNA, 22 bp, synthetic construct
  misc_feature 1..22: note = Description of Artificial Sequence: Syntheticoligonucleotide
  source 1..22: mol_type = other DNA
gggactcctataggagtcccga

SEQ ID NO: 8372 - DNA, 22 bp, synthetic construct
  misc_feature 1..22: note = Description of Artificial Sequence: Syntheticoligonucleotide
  source 1..22: mol_type = other DNA
gggactcctataggagtcccag

SEQ ID NO: 8373 - DNA, 22 bp, synthetic construct
  misc_feature 1..22: note = Description of Artificial Sequence: Syntheticoligonucleotide
  source 1..22: mol_type = other DNA
tggactcctataggagtccagg

SEQ ID NO: 8374 - DNA, 22 bp, synthetic construct
  misc_feature 1..22: note = Description of Artificial Sequence: Syntheticoligonucleotide
  source 1..22: mol_type = other DNA
gtgactcctataggagtcacgg

SEQ ID NO: 8375 - DNA, 22 bp, synthetic construct
  misc_feature 1..22: note = Description of Artificial Sequence: Syntheticoligonucleotide
  source 1..22: mol_type = other DNA
gcgactcctataggagtcgccg

SEQ ID NO: 8376 - DNA, 22 bp, synthetic construct
  misc_feature 1..22: note = Description of Artificial Sequence: Syntheticoligonucleotide
  source 1..22: mol_type = other DNA
gcgactcctataggagtcgctg

SEQ ID NO: 8377 - DNA, 22 bp, synthetic construct
  misc_feature 1..22: note = Description of Artificial Sequence: Syntheticoligonucleotide
  source 1..22: mol_type = other DNA
acgactcctataggagtcgtcg

SEQ ID NO: 8378 - DNA, 22 bp, synthetic construct
  misc_feature 1..22: note = Description of Artificial Sequence: Syntheticoligonucleotide
  source 1..22: mol_type = other DNA
gagactcctataggagtctccg

SEQ ID NO: 8379 - DNA, 22 bp, synthetic construct
  misc_feature 1..22: note = Description of Artificial Sequence: Syntheticoligonucleotide
  source 1..22: mol_type = other DNA
gcgactcctataggagtcgcag

SEQ ID NO: 8380 - DNA, 22 bp, synthetic construct
  misc_feature 1..22: note = Description of Artificial Sequence: Syntheticoligonucleotide
  source 1..22: mol_type = other DNA
gtgactcctataggagtcaccg

SEQ ID NO: 8381 - DNA, 22 bp, synthetic construct
  misc_feature 1..22: note = Description of Artificial Sequence: Syntheticoligonucleotide
  source 1..22: mol_type = other DNA
cggactcctataggagtccgtg

SEQ ID NO: 8382 - DNA, 22 bp, synthetic construct
  misc_feature 1..22: note = Description of Artificial Sequence: Syntheticoligonucleotide
  source 1..22: mol_type = other DNA
cagactcctataggagtctggg

SEQ ID NO: 8383 - DNA, 22 bp, synthetic construct
  misc_feature 1..22: note = Description of Artificial Sequence: Syntheticoligonucleotide
  source 1..22: mol_type = other DNA
cggactcctataggagtccgag

SEQ ID NO: 8384 - DNA, 22 bp, synthetic construct
  misc_feature 1..22: note = Description of Artificial Sequence: Syntheticoligonucleotide
  source 1..22: mol_type = other DNA
ctgactcctataggagtcaggg

SEQ ID NO: 8385 - DNA, 22 bp, synthetic construct
  misc_feature 1..22: note = Description of Artificial Sequence: Syntheticoligonucleotide
  source 1..22: mol_type = other DNA
acgactcctataggagtcgtgg

SEQ ID NO: 8386 - DNA, 22 bp, synthetic construct
  misc_feature 1..22: note = Description of Artificial Sequence: Syntheticoligonucleotide
  source 1..22: mol_type = other DNA
ccgactcctataggagtcggct

SEQ ID NO: 8387 - DNA, 22 bp, synthetic construct
  misc_feature 1..22: note = Description of Artificial Sequence: Syntheticoligonucleotide
  source 1..22: mol_type = other DNA
ccgactcctataggagtcggca

SEQ ID NO: 8388 - DNA, 22 bp, synthetic construct
  misc_feature 1..22: note = Description of Artificial Sequence: Syntheticoligonucleotide
  source 1..22: mol_type = other DNA
gagactcctataggagtctcgc

SEQ ID NO: 8389 - DNA, 22 bp, synthetic construct
  misc_feature 1..22: note = Description of Artificial Sequence: Syntheticoligonucleotide
  source 1..22: mol_type = other DNA
gtgactcctataggagtcacgc

SEQ ID NO: 8390 - DNA, 22 bp, synthetic construct
  misc_feature 1..22: note = Description of Artificial Sequence: Syntheticoligonucleotide
  source 1..22: mol_type = other DNA
aggactcctataggagtcctgc

SEQ ID NO: 8391 - DNA, 22 bp, synthetic construct
  misc_feature 1..22: note = Description of Artificial Sequence: Syntheticoligonucleotide
  source 1..22: mol_type = other DNA
tggactcctataggagtccagc

SEQ ID NO: 8392 - DNA, 22 bp, synthetic construct
  misc_feature 1..22: note = Description of Artificial Sequence: Syntheticoligonucleotide
  source 1..22: mol_type = other DNA
aggactcctataggagtcctcg

SEQ ID NO: 8393 - DNA, 22 bp, synthetic construct
  misc_feature 1..22: note = Description of Artificial Sequence: Syntheticoligonucleotide
  source 1..22: mol_type = other DNA
tggactcctataggagtccacg

SEQ ID NO: 8394 - DNA, 22 bp, synthetic construct
  misc_feature 1..22: note = Description of Artificial Sequence: Syntheticoligonucleotide
  source 1..22: mol_type = other DNA
ccgactcctataggagtcggtg

SEQ ID NO: 8395 - DNA, 22 bp, synthetic construct
  misc_feature 1..22: note = Description of Artificial Sequence: Syntheticoligonucleotide
  source 1..22: mol_type = other DNA
ccgactcctataggagtcggag

SEQ ID NO: 8396 - DNA, 22 bp, synthetic construct
  misc_feature 1..22: note = Description of Artificial Sequence: Syntheticoligonucleotide
  source 1..22: mol_type = other DNA
gggactcctataggagtcccgc

SEQ ID NO: 8397 - DNA, 22 bp, synthetic construct
  misc_feature 1..22: note = Description of Artificial Sequence: Syntheticoligonucleotide
  source 1..22: mol_type = other DNA
gggactcctataggagtccctc

SEQ ID NO: 8398 - DNA, 22 bp, synthetic construct
  misc_feature 1..22: note = Description of Artificial Sequence: Syntheticoligonucleotide
  source 1..22: mol_type = other DNA
gggactcctataggagtcccac

SEQ ID NO: 8399 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactccttaaggagtcnnnn

SEQ ID NO: 8400 - DNA, 22 bp, synthetic construct
  misc_feature 1..22: note = Description of Artificial Sequence: Syntheticoligonucleotide
  source 1..22: mol_type = other DNA
cggactccttaaggagtccgcc

SEQ ID NO: 8401 - DNA, 22 bp, synthetic construct
  misc_feature 1..22: note = Description of Artificial Sequence: Syntheticoligonucleotide
  source 1..22: mol_type = other DNA
cggactccttaaggagtccgct

SEQ ID NO: 8402 - DNA, 22 bp, synthetic construct
  misc_feature 1..22: note = Description of Artificial Sequence: Syntheticoligonucleotide
  source 1..22: mol_type = other DNA
cggactccttaaggagtccgtc

SEQ ID NO: 8403 - DNA, 22 bp, synthetic construct
  misc_feature 1..22: note = Description of Artificial Sequence: Syntheticoligonucleotide
  source 1..22: mol_type = other DNA
aggactccttaaggagtcctcc

SEQ ID NO: 8404 - DNA, 22 bp, synthetic construct
  misc_feature 1..22: note = Description of Artificial Sequence: Syntheticoligonucleotide
  source 1..22: mol_type = other DNA
cagactccttaaggagtctgcc

SEQ ID NO: 8405 - DNA, 22 bp, synthetic construct
  misc_feature 1..22: note = Description of Artificial Sequence: Syntheticoligonucleotide
  source 1..22: mol_type = other DNA
cggactccttaaggagtccgca

SEQ ID NO: 8406 - DNA, 22 bp, synthetic construct
  misc_feature 1..22: note = Description of Artificial Sequence: Syntheticoligonucleotide
  source 1..22: mol_type = other DNA
cggactccttaaggagtccgac

SEQ ID NO: 8407 - DNA, 22 bp, synthetic construct
  misc_feature 1..22: note = Description of Artificial Sequence: Syntheticoligonucleotide
  source 1..22: mol_type = other DNA
tggactccttaaggagtccacc

SEQ ID NO: 8408 - DNA, 22 bp, synthetic construct
  misc_feature 1..22: note = Description of Artificial Sequence: Syntheticoligonucleotide
  source 1..22: mol_type = other DNA
ctgactccttaaggagtcagcc

SEQ ID NO: 8409 - DNA, 22 bp, synthetic construct
  misc_feature 1..22: note = Description of Artificial Sequence: Syntheticoligonucleotide
  source 1..22: mol_type = other DNA
ccgactccttaaggagtcgggc

SEQ ID NO: 8410 - DNA, 22 bp, synthetic construct
  misc_feature 1..22: note = Description of Artificial Sequence: Syntheticoligonucleotide
  source 1..22: mol_type = other DNA
ccgactccttaaggagtcgggt

SEQ ID NO: 8411 - DNA, 22 bp, synthetic construct
  misc_feature 1..22: note = Description of Artificial Sequence: Syntheticoligonucleotide
  source 1..22: mol_type = other DNA
ccgactccttaaggagtcggtc

SEQ ID NO: 8412 - DNA, 22 bp, synthetic construct
  misc_feature 1..22: note = Description of Artificial Sequence: Syntheticoligonucleotide
  source 1..22: mol_type = other DNA
acgactccttaaggagtcgtgc

SEQ ID NO: 8413 - DNA, 22 bp, synthetic construct
  misc_feature 1..22: note = Description of Artificial Sequence: Syntheticoligonucleotide
  source 1..22: mol_type = other DNA
cagactccttaaggagtctggc

SEQ ID NO: 8414 - DNA, 22 bp, synthetic construct
  misc_feature 1..22: note = Description of Artificial Sequence: Syntheticoligonucleotide
  source 1..22: mol_type = other DNA
ccgactccttaaggagtcggga

SEQ ID NO: 8415 - DNA, 22 bp, synthetic construct
  misc_feature 1..22: note = Description of Artificial Sequence: Syntheticoligonucleotide
  source 1..22: mol_type = other DNA
ccgactccttaaggagtcggac

SEQ ID NO: 8416 - DNA, 22 bp, synthetic construct
  misc_feature 1..22: note = Description of Artificial Sequence: Syntheticoligonucleotide
  source 1..22: mol_type = other DNA
ctgactccttaaggagtcaggc

SEQ ID NO: 8417 - DNA, 22 bp, synthetic construct
  misc_feature 1..22: note = Description of Artificial Sequence: Syntheticoligonucleotide
  source 1..22: mol_type = other DNA
gcgactccttaaggagtcgccc

SEQ ID NO: 8418 - DNA, 22 bp, synthetic construct
  misc_feature 1..22: note = Description of Artificial Sequence: Syntheticoligonucleotide
  source 1..22: mol_type = other DNA
gcgactccttaaggagtcgcct

SEQ ID NO: 8419 - DNA, 22 bp, synthetic construct
  misc_feature 1..22: note = Description of Artificial Sequence: Syntheticoligonucleotide
  source 1..22: mol_type = other DNA
gcgactccttaaggagtcgctc

SEQ ID NO: 8420 - DNA, 22 bp, synthetic construct
  misc_feature 1..22: note = Description of Artificial Sequence: Syntheticoligonucleotide
  source 1..22: mol_type = other DNA
acgactccttaaggagtcgtcc

SEQ ID NO: 8421 - DNA, 22 bp, synthetic construct
  misc_feature 1..22: note = Description of Artificial Sequence: Syntheticoligonucleotide
  source 1..22: mol_type = other DNA
gagactccttaaggagtctccc

SEQ ID NO: 8422 - DNA, 22 bp, synthetic construct
  misc_feature 1..22: note = Description of Artificial Sequence: Syntheticoligonucleotide
  source 1..22: mol_type = other DNA
gcgactccttaaggagtcgcca

SEQ ID NO: 8423 - DNA, 22 bp, synthetic construct
  misc_feature 1..22: note = Description of Artificial Sequence: Syntheticoligonucleotide
  source 1..22: mol_type = other DNA
gcgactccttaaggagtcgcac

SEQ ID NO: 8424 - DNA, 22 bp, synthetic construct
  misc_feature 1..22: note = Description of Artificial Sequence: Syntheticoligonucleotide
  source 1..22: mol_type = other DNA
gtgactccttaaggagtcaccc

SEQ ID NO: 8425 - DNA, 22 bp, synthetic construct
  misc_feature 1..22: note = Description of Artificial Sequence: Syntheticoligonucleotide
  source 1..22: mol_type = other DNA
gggactccttaaggagtcccgt

SEQ ID NO: 8426 - DNA, 22 bp, synthetic construct
  misc_feature 1..22: note = Description of Artificial Sequence: Syntheticoligonucleotide
  source 1..22: mol_type = other DNA
gggactccttaaggagtccctg

SEQ ID NO: 8427 - DNA, 22 bp, synthetic construct
  misc_feature 1..22: note = Description of Artificial Sequence: Syntheticoligonucleotide
  source 1..22: mol_type = other DNA
aggactccttaaggagtcctgg

SEQ ID NO: 8428 - DNA, 22 bp, synthetic construct
  misc_feature 1..22: note = Description of Artificial Sequence: Syntheticoligonucleotide
  source 1..22: mol_type = other DNA
gagactccttaaggagtctcgg

SEQ ID NO: 8429 - DNA, 22 bp, synthetic construct
  misc_feature 1..22: note = Description of Artificial Sequence: Syntheticoligonucleotide
  source 1..22: mol_type = other DNA
gggactccttaaggagtcccga

SEQ ID NO: 8430 - DNA, 22 bp, synthetic construct
  misc_feature 1..22: note = Description of Artificial Sequence: Syntheticoligonucleotide
  source 1..22: mol_type = other DNA
gggactccttaaggagtcccag

SEQ ID NO: 8431 - DNA, 22 bp, synthetic construct
  misc_feature 1..22: note = Description of Artificial Sequence: Syntheticoligonucleotide
  source 1..22: mol_type = other DNA
tggactccttaaggagtccagg

SEQ ID NO: 8432 - DNA, 22 bp, synthetic construct
  misc_feature 1..22: note = Description of Artificial Sequence: Syntheticoligonucleotide
  source 1..22: mol_type = other DNA
gtgactccttaaggagtcacgg

SEQ ID NO: 8433 - DNA, 22 bp, synthetic construct
  misc_feature 1..22: note = Description of Artificial Sequence: Syntheticoligonucleotide
  source 1..22: mol_type = other DNA
gcgactccttaaggagtcgccg

SEQ ID NO: 8434 - DNA, 22 bp, synthetic construct
  misc_feature 1..22: note = Description of Artificial Sequence: Syntheticoligonucleotide
  source 1..22: mol_type = other DNA
gcgactccttaaggagtcgctg

SEQ ID NO: 8435 - DNA, 22 bp, synthetic construct
  misc_feature 1..22: note = Description of Artificial Sequence: Syntheticoligonucleotide
  source 1..22: mol_type = other DNA
acgactccttaaggagtcgtcg

SEQ ID NO: 8436 - DNA, 22 bp, synthetic construct
  misc_feature 1..22: note = Description of Artificial Sequence: Syntheticoligonucleotide
  source 1..22: mol_type = other DNA
gagactccttaaggagtctccg

SEQ ID NO: 8437 - DNA, 22 bp, synthetic construct
  misc_feature 1..22: note = Description of Artificial Sequence: Syntheticoligonucleotide
  source 1..22: mol_type = other DNA
gcgactccttaaggagtcgcag

SEQ ID NO: 8438 - DNA, 22 bp, synthetic construct
  misc_feature 1..22: note = Description of Artificial Sequence: Syntheticoligonucleotide
  source 1..22: mol_type = other DNA
gtgactccttaaggagtcaccg

SEQ ID NO: 8439 - DNA, 22 bp, synthetic construct
  misc_feature 1..22: note = Description of Artificial Sequence: Syntheticoligonucleotide
  source 1..22: mol_type = other DNA
cggactccttaaggagtccgtg

SEQ ID NO: 8440 - DNA, 22 bp, synthetic construct
  misc_feature 1..22: note = Description of Artificial Sequence: Syntheticoligonucleotide
  source 1..22: mol_type = other DNA
cagactccttaaggagtctggg

SEQ ID NO: 8441 - DNA, 22 bp, synthetic construct
  misc_feature 1..22: note = Description of Artificial Sequence: Syntheticoligonucleotide
  source 1..22: mol_type = other DNA
cggactccttaaggagtccgag

SEQ ID NO: 8442 - DNA, 22 bp, synthetic construct
  misc_feature 1..22: note = Description of Artificial Sequence: Syntheticoligonucleotide
  source 1..22: mol_type = other DNA
ctgactccttaaggagtcaggg

SEQ ID NO: 8443 - DNA, 22 bp, synthetic construct
  misc_feature 1..22: note = Description of Artificial Sequence: Syntheticoligonucleotide
  source 1..22: mol_type = other DNA
acgactccttaaggagtcgtgg

SEQ ID NO: 8444 - DNA, 22 bp, synthetic construct
  misc_feature 1..22: note = Description of Artificial Sequence: Syntheticoligonucleotide
  source 1..22: mol_type = other DNA
ccgactccttaaggagtcggct

SEQ ID NO: 8445 - DNA, 22 bp, synthetic construct
  misc_feature 1..22: note = Description of Artificial Sequence: Syntheticoligonucleotide
  source 1..22: mol_type = other DNA
ccgactccttaaggagtcggca

SEQ ID NO: 8446 - DNA, 22 bp, synthetic construct
  misc_feature 1..22: note = Description of Artificial Sequence: Syntheticoligonucleotide
  source 1..22: mol_type = other DNA
gagactccttaaggagtctcgc

SEQ ID NO: 8447 - DNA, 22 bp, synthetic construct
  misc_feature 1..22: note = Description of Artificial Sequence: Syntheticoligonucleotide
  source 1..22: mol_type = other DNA
gtgactccttaaggagtcacgc

SEQ ID NO: 8448 - DNA, 22 bp, synthetic construct
  misc_feature 1..22: note = Description of Artificial Sequence: Syntheticoligonucleotide
  source 1..22: mol_type = other DNA
aggactccttaaggagtcctgc

SEQ ID NO: 8449 - DNA, 22 bp, synthetic construct
  misc_feature 1..22: note = Description of Artificial Sequence: Syntheticoligonucleotide
  source 1..22: mol_type = other DNA
tggactccttaaggagtccagc

SEQ ID NO: 8450 - DNA, 22 bp, synthetic construct
  misc_feature 1..22: note = Description of Artificial Sequence: Syntheticoligonucleotide
  source 1..22: mol_type = other DNA
aggactccttaaggagtcctcg

SEQ ID NO: 8451 - DNA, 22 bp, synthetic construct
  misc_feature 1..22: note = Description of Artificial Sequence: Syntheticoligonucleotide
  source 1..22: mol_type = other DNA
tggactccttaaggagtccacg

SEQ ID NO: 8452 - DNA, 22 bp, synthetic construct
  misc_feature 1..22: note = Description of Artificial Sequence: Syntheticoligonucleotide
  source 1..22: mol_type = other DNA
ccgactccttaaggagtcggtg

SEQ ID NO: 8453 - DNA, 22 bp, synthetic construct
  misc_feature 1..22: note = Description of Artificial Sequence: Syntheticoligonucleotide
  source 1..22: mol_type = other DNA
ccgactccttaaggagtcggag

SEQ ID NO: 8454 - DNA, 22 bp, synthetic construct
  misc_feature 1..22: note = Description of Artificial Sequence: Syntheticoligonucleotide
  source 1..22: mol_type = other DNA
gggactccttaaggagtcccgc

SEQ ID NO: 8455 - DNA, 22 bp, synthetic construct
  misc_feature 1..22: note = Description of Artificial Sequence: Syntheticoligonucleotide
  source 1..22: mol_type = other DNA
gggactccttaaggagtccctc

SEQ ID NO: 8456 - DNA, 22 bp, synthetic construct
  misc_feature 1..22: note = Description of Artificial Sequence: Syntheticoligonucleotide
  source 1..22: mol_type = other DNA
gggactccttaaggagtcccac

SEQ ID NO: 8457 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcctgcaggagtcnnnn

SEQ ID NO: 8458 - DNA, 22 bp, synthetic construct
  misc_feature 1..22: note = Description of Artificial Sequence: Syntheticoligonucleotide
  source 1..22: mol_type = other DNA
cggactcctgcaggagtccgcc

SEQ ID NO: 8459 - DNA, 22 bp, synthetic construct
  misc_feature 1..22: note = Description of Artificial Sequence: Syntheticoligonucleotide
  source 1..22: mol_type = other DNA
cggactcctgcaggagtccgct

SEQ ID NO: 8460 - DNA, 22 bp, synthetic construct
  misc_feature 1..22: note = Description of Artificial Sequence: Syntheticoligonucleotide
  source 1..22: mol_type = other DNA
cggactcctgcaggagtccgtc

SEQ ID NO: 8461 - DNA, 22 bp, synthetic construct
  misc_feature 1..22: note = Description of Artificial Sequence: Syntheticoligonucleotide
  source 1..22: mol_type = other DNA
aggactcctgcaggagtcctcc

SEQ ID NO: 8462 - DNA, 22 bp, synthetic construct
  misc_feature 1..22: note = Description of Artificial Sequence: Syntheticoligonucleotide
  source 1..22: mol_type = other DNA
cagactcctgcaggagtctgcc

SEQ ID NO: 8463 - DNA, 22 bp, synthetic construct
  misc_feature 1..22: note = Description of Artificial Sequence: Syntheticoligonucleotide
  source 1..22: mol_type = other DNA
cggactcctgcaggagtccgca

SEQ ID NO: 8464 - DNA, 22 bp, synthetic construct
  misc_feature 1..22: note = Description of Artificial Sequence: Syntheticoligonucleotide
  source 1..22: mol_type = other DNA
cggactcctgcaggagtccgac

SEQ ID NO: 8465 - DNA, 22 bp, synthetic construct
  misc_feature 1..22: note = Description of Artificial Sequence: Syntheticoligonucleotide
  source 1..22: mol_type = other DNA
tggactcctgcaggagtccacc

SEQ ID NO: 8466 - DNA, 22 bp, synthetic construct
  misc_feature 1..22: note = Description of Artificial Sequence: Syntheticoligonucleotide
  source 1..22: mol_type = other DNA
ctgactcctgcaggagtcagcc

SEQ ID NO: 8467 - DNA, 22 bp, synthetic construct
  misc_feature 1..22: note = Description of Artificial Sequence: Syntheticoligonucleotide
  source 1..22: mol_type = other DNA
ccgactcctgcaggagtcgggc

SEQ ID NO: 8468 - DNA, 22 bp, synthetic construct
  misc_feature 1..22: note = Description of Artificial Sequence: Syntheticoligonucleotide
  source 1..22: mol_type = other DNA
ccgactcctgcaggagtcgggt

SEQ ID NO: 8469 - DNA, 22 bp, synthetic construct
  misc_feature 1..22: note = Description of Artificial Sequence: Syntheticoligonucleotide
  source 1..22: mol_type = other DNA
ccgactcctgcaggagtcggtc

SEQ ID NO: 8470 - DNA, 22 bp, synthetic construct
  misc_feature 1..22: note = Description of Artificial Sequence: Syntheticoligonucleotide
  source 1..22: mol_type = other DNA
acgactcctgcaggagtcgtgc

SEQ ID NO: 8471 - DNA, 22 bp, synthetic construct
  misc_feature 1..22: note = Description of Artificial Sequence: Syntheticoligonucleotide
  source 1..22: mol_type = other DNA
cagactcctgcaggagtctggc

SEQ ID NO: 8472 - DNA, 22 bp, synthetic construct
  misc_feature 1..22: note = Description of Artificial Sequence: Syntheticoligonucleotide
  source 1..22: mol_type = other DNA
ccgactcctgcaggagtcggga

SEQ ID NO: 8473 - DNA, 22 bp, synthetic construct
  misc_feature 1..22: note = Description of Artificial Sequence: Syntheticoligonucleotide
  source 1..22: mol_type = other DNA
ccgactcctgcaggagtcggac

SEQ ID NO: 8474 - DNA, 22 bp, synthetic construct
  misc_feature 1..22: note = Description of Artificial Sequence: Syntheticoligonucleotide
  source 1..22: mol_type = other DNA
ctgactcctgcaggagtcaggc

SEQ ID NO: 8475 - DNA, 22 bp, synthetic construct
  misc_feature 1..22: note = Description of Artificial Sequence: Syntheticoligonucleotide
  source 1..22: mol_type = other DNA
gcgactcctgcaggagtcgccc

SEQ ID NO: 8476 - DNA, 22 bp, synthetic construct
  misc_feature 1..22: note = Description of Artificial Sequence: Syntheticoligonucleotide
  source 1..22: mol_type = other DNA
gcgactcctgcaggagtcgcct

SEQ ID NO: 8477 - DNA, 22 bp, synthetic construct
  misc_feature 1..22: note = Description of Artificial Sequence: Syntheticoligonucleotide
  source 1..22: mol_type = other DNA
gcgactcctgcaggagtcgctc

SEQ ID NO: 8478 - DNA, 22 bp, synthetic construct
  misc_feature 1..22: note = Description of Artificial Sequence: Syntheticoligonucleotide
  source 1..22: mol_type = other DNA
acgactcctgcaggagtcgtcc

SEQ ID NO: 8479 - DNA, 22 bp, synthetic construct
  misc_feature 1..22: note = Description of Artificial Sequence: Syntheticoligonucleotide
  source 1..22: mol_type = other DNA
gagactcctgcaggagtctccc

SEQ ID NO: 8480 - DNA, 22 bp, synthetic construct
  misc_feature 1..22: note = Description of Artificial Sequence: Syntheticoligonucleotide
  source 1..22: mol_type = other DNA
gcgactcctgcaggagtcgcca

SEQ ID NO: 8481 - DNA, 22 bp, synthetic construct
  misc_feature 1..22: note = Description of Artificial Sequence: Syntheticoligonucleotide
  source 1..22: mol_type = other DNA
gcgactcctgcaggagtcgcac

SEQ ID NO: 8482 - DNA, 22 bp, synthetic construct
  misc_feature 1..22: note = Description of Artificial Sequence: Syntheticoligonucleotide
  source 1..22: mol_type = other DNA
gtgactcctgcaggagtcaccc

SEQ ID NO: 8483 - DNA, 22 bp, synthetic construct
  misc_feature 1..22: note = Description of Artificial Sequence: Syntheticoligonucleotide
  source 1..22: mol_type = other DNA
gggactcctgcaggagtcccgt

SEQ ID NO: 8484 - DNA, 22 bp, synthetic construct
  misc_feature 1..22: note = Description of Artificial Sequence: Syntheticoligonucleotide
  source 1..22: mol_type = other DNA
gggactcctgcaggagtccctg

SEQ ID NO: 8485 - DNA, 22 bp, synthetic construct
  misc_feature 1..22: note = Description of Artificial Sequence: Syntheticoligonucleotide
  source 1..22: mol_type = other DNA
aggactcctgcaggagtcctgg

SEQ ID NO: 8486 - DNA, 22 bp, synthetic construct
  misc_feature 1..22: note = Description of Artificial Sequence: Syntheticoligonucleotide
  source 1..22: mol_type = other DNA
gagactcctgcaggagtctcgg

SEQ ID NO: 8487 - DNA, 22 bp, synthetic construct
  misc_feature 1..22: note = Description of Artificial Sequence: Syntheticoligonucleotide
  source 1..22: mol_type = other DNA
gggactcctgcaggagtcccga

SEQ ID NO: 8488 - DNA, 22 bp, synthetic construct
  misc_feature 1..22: note = Description of Artificial Sequence: Syntheticoligonucleotide
  source 1..22: mol_type = other DNA
gggactcctgcaggagtcccag

SEQ ID NO: 8489 - DNA, 22 bp, synthetic construct
  misc_feature 1..22: note = Description of Artificial Sequence: Syntheticoligonucleotide
  source 1..22: mol_type = other DNA
tggactcctgcaggagtccagg

SEQ ID NO: 8490 - DNA, 22 bp, synthetic construct
  misc_feature 1..22: note = Description of Artificial Sequence: Syntheticoligonucleotide
  source 1..22: mol_type = other DNA
gtgactcctgcaggagtcacgg

SEQ ID NO: 8491 - DNA, 22 bp, synthetic construct
  misc_feature 1..22: note = Description of Artificial Sequence: Syntheticoligonucleotide
  source 1..22: mol_type = other DNA
gcgactcctgcaggagtcgccg

SEQ ID NO: 8492 - DNA, 22 bp, synthetic construct
  misc_feature 1..22: note = Description of Artificial Sequence: Syntheticoligonucleotide
  source 1..22: mol_type = other DNA
gcgactcctgcaggagtcgctg

SEQ ID NO: 8493 - DNA, 22 bp, synthetic construct
  misc_feature 1..22: note = Description of Artificial Sequence: Syntheticoligonucleotide
  source 1..22: mol_type = other DNA
acgactcctgcaggagtcgtcg

SEQ ID NO: 8494 - DNA, 22 bp, synthetic construct
  misc_feature 1..22: note = Description of Artificial Sequence: Syntheticoligonucleotide
  source 1..22: mol_type = other DNA
gagactcctgcaggagtctccg

SEQ ID NO: 8495 - DNA, 22 bp, synthetic construct
  misc_feature 1..22: note = Description of Artificial Sequence: Syntheticoligonucleotide
  source 1..22: mol_type = other DNA
gcgactcctgcaggagtcgcag

SEQ ID NO: 8496 - DNA, 22 bp, synthetic construct
  misc_feature 1..22: note = Description of Artificial Sequence: Syntheticoligonucleotide
  source 1..22: mol_type = other DNA
gtgactcctgcaggagtcaccg

SEQ ID NO: 8497 - DNA, 22 bp, synthetic construct
  misc_feature 1..22: note = Description of Artificial Sequence: Syntheticoligonucleotide
  source 1..22: mol_type = other DNA
cggactcctgcaggagtccgtg

SEQ ID NO: 8498 - DNA, 22 bp, synthetic construct
  misc_feature 1..22: note = Description of Artificial Sequence: Syntheticoligonucleotide
  source 1..22: mol_type = other DNA
cagactcctgcaggagtctggg

SEQ ID NO: 8499 - DNA, 22 bp, synthetic construct
  misc_feature 1..22: note = Description of Artificial Sequence: Syntheticoligonucleotide
  source 1..22: mol_type = other DNA
cggactcctgcaggagtccgag

SEQ ID NO: 8500 - DNA, 22 bp, synthetic construct
  misc_feature 1..22: note = Description of Artificial Sequence: Syntheticoligonucleotide
  source 1..22: mol_type = other DNA
ctgactcctgcaggagtcaggg

SEQ ID NO: 8501 - DNA, 22 bp, synthetic construct
  misc_feature 1..22: note = Description of Artificial Sequence: Syntheticoligonucleotide
  source 1..22: mol_type = other DNA
acgactcctgcaggagtcgtgg

SEQ ID NO: 8502 - DNA, 22 bp, synthetic construct
  misc_feature 1..22: note = Description of Artificial Sequence: Syntheticoligonucleotide
  source 1..22: mol_type = other DNA
ccgactcctgcaggagtcggct

SEQ ID NO: 8503 - DNA, 22 bp, synthetic construct
  misc_feature 1..22: note = Description of Artificial Sequence: Syntheticoligonucleotide
  source 1..22: mol_type = other DNA
ccgactcctgcaggagtcggca

SEQ ID NO: 8504 - DNA, 22 bp, synthetic construct
  misc_feature 1..22: note = Description of Artificial Sequence: Syntheticoligonucleotide
  source 1..22: mol_type = other DNA
gagactcctgcaggagtctcgc

SEQ ID NO: 8505 - DNA, 22 bp, synthetic construct
  misc_feature 1..22: note = Description of Artificial Sequence: Syntheticoligonucleotide
  source 1..22: mol_type = other DNA
gtgactcctgcaggagtcacgc

SEQ ID NO: 8506 - DNA, 22 bp, synthetic construct
  misc_feature 1..22: note = Description of Artificial Sequence: Syntheticoligonucleotide
  source 1..22: mol_type = other DNA
aggactcctgcaggagtcctgc

SEQ ID NO: 8507 - DNA, 22 bp, synthetic construct
  misc_feature 1..22: note = Description of Artificial Sequence: Syntheticoligonucleotide
  source 1..22: mol_type = other DNA
tggactcctgcaggagtccagc

SEQ ID NO: 8508 - DNA, 22 bp, synthetic construct
  misc_feature 1..22: note = Description of Artificial Sequence: Syntheticoligonucleotide
  source 1..22: mol_type = other DNA
aggactcctgcaggagtcctcg

SEQ ID NO: 8509 - DNA, 22 bp, synthetic construct
  misc_feature 1..22: note = Description of Artificial Sequence: Syntheticoligonucleotide
  source 1..22: mol_type = other DNA
tggactcctgcaggagtccacg

SEQ ID NO: 8510 - DNA, 22 bp, synthetic construct
  misc_feature 1..22: note = Description of Artificial Sequence: Syntheticoligonucleotide
  source 1..22: mol_type = other DNA
ccgactcctgcaggagtcggtg

SEQ ID NO: 8511 - DNA, 22 bp, synthetic construct
  misc_feature 1..22: note = Description of Artificial Sequence: Syntheticoligonucleotide
  source 1..22: mol_type = other DNA
ccgactcctgcaggagtcggag

SEQ ID NO: 8512 - DNA, 22 bp, synthetic construct
  misc_feature 1..22: note = Description of Artificial Sequence: Syntheticoligonucleotide
  source 1..22: mol_type = other DNA
gggactcctgcaggagtcccgc

SEQ ID NO: 8513 - DNA, 22 bp, synthetic construct
  misc_feature 1..22: note = Description of Artificial Sequence: Syntheticoligonucleotide
  source 1..22: mol_type = other DNA
gggactcctgcaggagtccctc

SEQ ID NO: 8514 - DNA, 22 bp, synthetic construct
  misc_feature 1..22: note = Description of Artificial Sequence: Syntheticoligonucleotide
  source 1..22: mol_type = other DNA
gggactcctgcaggagtcccac

SEQ ID NO: 8515 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcctcgaggagtcnnnn

SEQ ID NO: 8516 - DNA, 22 bp, synthetic construct
  misc_feature 1..22: note = Description of Artificial Sequence: Syntheticoligonucleotide
  source 1..22: mol_type = other DNA
cggactcctcgaggagtccgcc

SEQ ID NO: 8517 - DNA, 22 bp, synthetic construct
  misc_feature 1..22: note = Description of Artificial Sequence: Syntheticoligonucleotide
  source 1..22: mol_type = other DNA
cggactcctcgaggagtccgct

SEQ ID NO: 8518 - DNA, 22 bp, synthetic construct
  misc_feature 1..22: note = Description of Artificial Sequence: Syntheticoligonucleotide
  source 1..22: mol_type = other DNA
cggactcctcgaggagtccgtc

SEQ ID NO: 8519 - DNA, 22 bp, synthetic construct
  misc_feature 1..22: note = Description of Artificial Sequence: Syntheticoligonucleotide
  source 1..22: mol_type = other DNA
aggactcctcgaggagtcctcc

SEQ ID NO: 8520 - DNA, 22 bp, synthetic construct
  misc_feature 1..22: note = Description of Artificial Sequence: Syntheticoligonucleotide
  source 1..22: mol_type = other DNA
cagactcctcgaggagtctgcc

SEQ ID NO: 8521 - DNA, 22 bp, synthetic construct
  misc_feature 1..22: note = Description of Artificial Sequence: Syntheticoligonucleotide
  source 1..22: mol_type = other DNA
cggactcctcgaggagtccgca

SEQ ID NO: 8522 - DNA, 22 bp, synthetic construct
  misc_feature 1..22: note = Description of Artificial Sequence: Syntheticoligonucleotide
  source 1..22: mol_type = other DNA
cggactcctcgaggagtccgac

SEQ ID NO: 8523 - DNA, 22 bp, synthetic construct
  misc_feature 1..22: note = Description of Artificial Sequence: Syntheticoligonucleotide
  source 1..22: mol_type = other DNA
tggactcctcgaggagtccacc

SEQ ID NO: 8524 - DNA, 22 bp, synthetic construct
  misc_feature 1..22: note = Description of Artificial Sequence: Syntheticoligonucleotide
  source 1..22: mol_type = other DNA
ctgactcctcgaggagtcagcc

SEQ ID NO: 8525 - DNA, 22 bp, synthetic construct
  misc_feature 1..22: note = Description of Artificial Sequence: Syntheticoligonucleotide
  source 1..22: mol_type = other DNA
ccgactcctcgaggagtcgggc

SEQ ID NO: 8526 - DNA, 22 bp, synthetic construct
  misc_feature 1..22: note = Description of Artificial Sequence: Syntheticoligonucleotide
  source 1..22: mol_type = other DNA
ccgactcctcgaggagtcgggt

SEQ ID NO: 8527 - DNA, 22 bp, synthetic construct
  misc_feature 1..22: note = Description of Artificial Sequence: Syntheticoligonucleotide
  source 1..22: mol_type = other DNA
ccgactcctcgaggagtcggtc

SEQ ID NO: 8528 - DNA, 22 bp, synthetic construct
  misc_feature 1..22: note = Description of Artificial Sequence: Syntheticoligonucleotide
  source 1..22: mol_type = other DNA
acgactcctcgaggagtcgtgc

SEQ ID NO: 8529 - DNA, 22 bp, synthetic construct
  misc_feature 1..22: note = Description of Artificial Sequence: Syntheticoligonucleotide
  source 1..22: mol_type = other DNA
cagactcctcgaggagtctggc

SEQ ID NO: 8530 - DNA, 22 bp, synthetic construct
  misc_feature 1..22: note = Description of Artificial Sequence: Syntheticoligonucleotide
  source 1..22: mol_type = other DNA
ccgactcctcgaggagtcggga

SEQ ID NO: 8531 - DNA, 22 bp, synthetic construct
  misc_feature 1..22: note = Description of Artificial Sequence: Syntheticoligonucleotide
  source 1..22: mol_type = other DNA
ccgactcctcgaggagtcggac

SEQ ID NO: 8532 - DNA, 22 bp, synthetic construct
  misc_feature 1..22: note = Description of Artificial Sequence: Syntheticoligonucleotide
  source 1..22: mol_type = other DNA
ctgactcctcgaggagtcaggc

SEQ ID NO: 8533 - DNA, 22 bp, synthetic construct
  misc_feature 1..22: note = Description of Artificial Sequence: Syntheticoligonucleotide
  source 1..22: mol_type = other DNA
gcgactcctcgaggagtcgccc

SEQ ID NO: 8534 - DNA, 22 bp, synthetic construct
  misc_feature 1..22: note = Description of Artificial Sequence: Syntheticoligonucleotide
  source 1..22: mol_type = other DNA
gcgactcctcgaggagtcgcct

SEQ ID NO: 8535 - DNA, 22 bp, synthetic construct
  misc_feature 1..22: note = Description of Artificial Sequence: Syntheticoligonucleotide
  source 1..22: mol_type = other DNA
gcgactcctcgaggagtcgctc

SEQ ID NO: 8536 - DNA, 22 bp, synthetic construct
  misc_feature 1..22: note = Description of Artificial Sequence: Syntheticoligonucleotide
  source 1..22: mol_type = other DNA
acgactcctcgaggagtcgtcc

SEQ ID NO: 8537 - DNA, 22 bp, synthetic construct
  misc_feature 1..22: note = Description of Artificial Sequence: Syntheticoligonucleotide
  source 1..22: mol_type = other DNA
gagactcctcgaggagtctccc

SEQ ID NO: 8538 - DNA, 22 bp, synthetic construct
  misc_feature 1..22: note = Description of Artificial Sequence: Syntheticoligonucleotide
  source 1..22: mol_type = other DNA
gcgactcctcgaggagtcgcca

SEQ ID NO: 8539 - DNA, 22 bp, synthetic construct
  misc_feature 1..22: note = Description of Artificial Sequence: Syntheticoligonucleotide
  source 1..22: mol_type = other DNA
gcgactcctcgaggagtcgcac

SEQ ID NO: 8540 - DNA, 22 bp, synthetic construct
  misc_feature 1..22: note = Description of Artificial Sequence: Syntheticoligonucleotide
  source 1..22: mol_type = other DNA
gtgactcctcgaggagtcaccc

SEQ ID NO: 8541 - DNA, 22 bp, synthetic construct
  misc_feature 1..22: note = Description of Artificial Sequence: Syntheticoligonucleotide
  source 1..22: mol_type = other DNA
gggactcctcgaggagtcccgt

SEQ ID NO: 8542 - DNA, 22 bp, synthetic construct
  misc_feature 1..22: note = Description of Artificial Sequence: Syntheticoligonucleotide
  source 1..22: mol_type = other DNA
gggactcctcgaggagtccctg

SEQ ID NO: 8543 - DNA, 22 bp, synthetic construct
  misc_feature 1..22: note = Description of Artificial Sequence: Syntheticoligonucleotide
  source 1..22: mol_type = other DNA
aggactcctcgaggagtcctgg

SEQ ID NO: 8544 - DNA, 22 bp, synthetic construct
  misc_feature 1..22: note = Description of Artificial Sequence: Syntheticoligonucleotide
  source 1..22: mol_type = other DNA
gagactcctcgaggagtctcgg

SEQ ID NO: 8545 - DNA, 22 bp, synthetic construct
  misc_feature 1..22: note = Description of Artificial Sequence: Syntheticoligonucleotide
  source 1..22: mol_type = other DNA
gggactcctcgaggagtcccga

SEQ ID NO: 8546 - DNA, 22 bp, synthetic construct
  misc_feature 1..22: note = Description of Artificial Sequence: Syntheticoligonucleotide
  source 1..22: mol_type = other DNA
gggactcctcgaggagtcccag

SEQ ID NO: 8547 - DNA, 22 bp, synthetic construct
  misc_feature 1..22: note = Description of Artificial Sequence: Syntheticoligonucleotide
  source 1..22: mol_type = other DNA
tggactcctcgaggagtccagg

SEQ ID NO: 8548 - DNA, 22 bp, synthetic construct
  misc_feature 1..22: note = Description of Artificial Sequence: Syntheticoligonucleotide
  source 1..22: mol_type = other DNA
gtgactcctcgaggagtcacgg

SEQ ID NO: 8549 - DNA, 22 bp, synthetic construct
  misc_feature 1..22: note = Description of Artificial Sequence: Syntheticoligonucleotide
  source 1..22: mol_type = other DNA
gcgactcctcgaggagtcgccg

SEQ ID NO: 8550 - DNA, 22 bp, synthetic construct
  misc_feature 1..22: note = Description of Artificial Sequence: Syntheticoligonucleotide
  source 1..22: mol_type = other DNA
gcgactcctcgaggagtcgctg

SEQ ID NO: 8551 - DNA, 22 bp, synthetic construct
  misc_feature 1..22: note = Description of Artificial Sequence: Syntheticoligonucleotide
  source 1..22: mol_type = other DNA
acgactcctcgaggagtcgtcg

SEQ ID NO: 8552 - DNA, 22 bp, synthetic construct
  misc_feature 1..22: note = Description of Artificial Sequence: Syntheticoligonucleotide
  source 1..22: mol_type = other DNA
gagactcctcgaggagtctccg

SEQ ID NO: 8553 - DNA, 22 bp, synthetic construct
  misc_feature 1..22: note = Description of Artificial Sequence: Syntheticoligonucleotide
  source 1..22: mol_type = other DNA
gcgactcctcgaggagtcgcag

SEQ ID NO: 8554 - DNA, 22 bp, synthetic construct
  misc_feature 1..22: note = Description of Artificial Sequence: Syntheticoligonucleotide
  source 1..22: mol_type = other DNA
gtgactcctcgaggagtcaccg

SEQ ID NO: 8555 - DNA, 22 bp, synthetic construct
  misc_feature 1..22: note = Description of Artificial Sequence: Syntheticoligonucleotide
  source 1..22: mol_type = other DNA
cggactcctcgaggagtccgtg

SEQ ID NO: 8556 - DNA, 22 bp, synthetic construct
  misc_feature 1..22: note = Description of Artificial Sequence: Syntheticoligonucleotide
  source 1..22: mol_type = other DNA
cagactcctcgaggagtctggg

SEQ ID NO: 8557 - DNA, 22 bp, synthetic construct
  misc_feature 1..22: note = Description of Artificial Sequence: Syntheticoligonucleotide
  source 1..22: mol_type = other DNA
cggactcctcgaggagtccgag

SEQ ID NO: 8558 - DNA, 22 bp, synthetic construct
  misc_feature 1..22: note = Description of Artificial Sequence: Syntheticoligonucleotide
  source 1..22: mol_type = other DNA
ctgactcctcgaggagtcaggg

SEQ ID NO: 8559 - DNA, 22 bp, synthetic construct
  misc_feature 1..22: note = Description of Artificial Sequence: Syntheticoligonucleotide
  source 1..22: mol_type = other DNA
acgactcctcgaggagtcgtgg

SEQ ID NO: 8560 - DNA, 22 bp, synthetic construct
  misc_feature 1..22: note = Description of Artificial Sequence: Syntheticoligonucleotide
  source 1..22: mol_type = other DNA
ccgactcctcgaggagtcggct

SEQ ID NO: 8561 - DNA, 22 bp, synthetic construct
  misc_feature 1..22: note = Description of Artificial Sequence: Syntheticoligonucleotide
  source 1..22: mol_type = other DNA
ccgactcctcgaggagtcggca

SEQ ID NO: 8562 - DNA, 22 bp, synthetic construct
  misc_feature 1..22: note = Description of Artificial Sequence: Syntheticoligonucleotide
  source 1..22: mol_type = other DNA
gagactcctcgaggagtctcgc

SEQ ID NO: 8563 - DNA, 22 bp, synthetic construct
  misc_feature 1..22: note = Description of Artificial Sequence: Syntheticoligonucleotide
  source 1..22: mol_type = other DNA
gtgactcctcgaggagtcacgc

SEQ ID NO: 8564 - DNA, 22 bp, synthetic construct
  misc_feature 1..22: note = Description of Artificial Sequence: Syntheticoligonucleotide
  source 1..22: mol_type = other DNA
aggactcctcgaggagtcctgc

SEQ ID NO: 8565 - DNA, 22 bp, synthetic construct
  misc_feature 1..22: note = Description of Artificial Sequence: Syntheticoligonucleotide
  source 1..22: mol_type = other DNA
tggactcctcgaggagtccagc

SEQ ID NO: 8566 - DNA, 22 bp, synthetic construct
  misc_feature 1..22: note = Description of Artificial Sequence: Syntheticoligonucleotide
  source 1..22: mol_type = other DNA
aggactcctcgaggagtcctcg

SEQ ID NO: 8567 - DNA, 22 bp, synthetic construct
  misc_feature 1..22: note = Description of Artificial Sequence: Syntheticoligonucleotide
  source 1..22: mol_type = other DNA
tggactcctcgaggagtccacg

SEQ ID NO: 8568 - DNA, 22 bp, synthetic construct
  misc_feature 1..22: note = Description of Artificial Sequence: Syntheticoligonucleotide
  source 1..22: mol_type = other DNA
ccgactcctcgaggagtcggtg

SEQ ID NO: 8569 - DNA, 22 bp, synthetic construct
  misc_feature 1..22: note = Description of Artificial Sequence: Syntheticoligonucleotide
  source 1..22: mol_type = other DNA
ccgactcctcgaggagtcggag

SEQ ID NO: 8570 - DNA, 22 bp, synthetic construct
  misc_feature 1..22: note = Description of Artificial Sequence: Syntheticoligonucleotide
  source 1..22: mol_type = other DNA
gggactcctcgaggagtcccgc

SEQ ID NO: 8571 - DNA, 22 bp, synthetic construct
  misc_feature 1..22: note = Description of Artificial Sequence: Syntheticoligonucleotide
  source 1..22: mol_type = other DNA
gggactcctcgaggagtccctc

SEQ ID NO: 8572 - DNA, 22 bp, synthetic construct
  misc_feature 1..22: note = Description of Artificial Sequence: Syntheticoligonucleotide
  source 1..22: mol_type = other DNA
gggactcctcgaggagtcccac

SEQ ID NO: 8573 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactccaattggagtcnnnn

SEQ ID NO: 8574 - DNA, 22 bp, synthetic construct
  misc_feature 1..22: note = Description of Artificial Sequence: Syntheticoligonucleotide
  source 1..22: mol_type = other DNA
cggactccaattggagtccgcc

SEQ ID NO: 8575 - DNA, 22 bp, synthetic construct
  misc_feature 1..22: note = Description of Artificial Sequence: Syntheticoligonucleotide
  source 1..22: mol_type = other DNA
cggactccaattggagtccgct

SEQ ID NO: 8576 - DNA, 22 bp, synthetic construct
  misc_feature 1..22: note = Description of Artificial Sequence: Syntheticoligonucleotide
  source 1..22: mol_type = other DNA
cggactccaattggagtccgtc

SEQ ID NO: 8577 - DNA, 22 bp, synthetic construct
  misc_feature 1..22: note = Description of Artificial Sequence: Syntheticoligonucleotide
  source 1..22: mol_type = other DNA
aggactccaattggagtcctcc

SEQ ID NO: 8578 - DNA, 22 bp, synthetic construct
  misc_feature 1..22: note = Description of Artificial Sequence: Syntheticoligonucleotide
  source 1..22: mol_type = other DNA
cagactccaattggagtctgcc

SEQ ID NO: 8579 - DNA, 22 bp, synthetic construct
  misc_feature 1..22: note = Description of Artificial Sequence: Syntheticoligonucleotide
  source 1..22: mol_type = other DNA
cggactccaattggagtccgca

SEQ ID NO: 8580 - DNA, 22 bp, synthetic construct
  misc_feature 1..22: note = Description of Artificial Sequence: Syntheticoligonucleotide
  source 1..22: mol_type = other DNA
cggactccaattggagtccgac

SEQ ID NO: 8581 - DNA, 22 bp, synthetic construct
  misc_feature 1..22: note = Description of Artificial Sequence: Syntheticoligonucleotide
  source 1..22: mol_type = other DNA
tggactccaattggagtccacc

SEQ ID NO: 8582 - DNA, 22 bp, synthetic construct
  misc_feature 1..22: note = Description of Artificial Sequence: Syntheticoligonucleotide
  source 1..22: mol_type = other DNA
ctgactccaattggagtcagcc

SEQ ID NO: 8583 - DNA, 22 bp, synthetic construct
  misc_feature 1..22: note = Description of Artificial Sequence: Syntheticoligonucleotide
  source 1..22: mol_type = other DNA
ccgactccaattggagtcgggc

SEQ ID NO: 8584 - DNA, 22 bp, synthetic construct
  misc_feature 1..22: note = Description of Artificial Sequence: Syntheticoligonucleotide
  source 1..22: mol_type = other DNA
ccgactccaattggagtcgggt

SEQ ID NO: 8585 - DNA, 22 bp, synthetic construct
  misc_feature 1..22: note = Description of Artificial Sequence: Syntheticoligonucleotide
  source 1..22: mol_type = other DNA
ccgactccaattggagtcggtc

SEQ ID NO: 8586 - DNA, 22 bp, synthetic construct
  misc_feature 1..22: note = Description of Artificial Sequence: Syntheticoligonucleotide
  source 1..22: mol_type = other DNA
acgactccaattggagtcgtgc

SEQ ID NO: 8587 - DNA, 22 bp, synthetic construct
  misc_feature 1..22: note = Description of Artificial Sequence: Syntheticoligonucleotide
  source 1..22: mol_type = other DNA
cagactccaattggagtctggc

SEQ ID NO: 8588 - DNA, 22 bp, synthetic construct
  misc_feature 1..22: note = Description of Artificial Sequence: Syntheticoligonucleotide
  source 1..22: mol_type = other DNA
ccgactccaattggagtcggga

SEQ ID NO: 8589 - DNA, 22 bp, synthetic construct
  misc_feature 1..22: note = Description of Artificial Sequence: Syntheticoligonucleotide
  source 1..22: mol_type = other DNA
ccgactccaattggagtcggac

SEQ ID NO: 8590 - DNA, 22 bp, synthetic construct
  misc_feature 1..22: note = Description of Artificial Sequence: Syntheticoligonucleotide
  source 1..22: mol_type = other DNA
ctgactccaattggagtcaggc

SEQ ID NO: 8591 - DNA, 22 bp, synthetic construct
  misc_feature 1..22: note = Description of Artificial Sequence: Syntheticoligonucleotide
  source 1..22: mol_type = other DNA
gcgactccaattggagtcgccc

SEQ ID NO: 8592 - DNA, 22 bp, synthetic construct
  misc_feature 1..22: note = Description of Artificial Sequence: Syntheticoligonucleotide
  source 1..22: mol_type = other DNA
gcgactccaattggagtcgcct

SEQ ID NO: 8593 - DNA, 22 bp, synthetic construct
  misc_feature 1..22: note = Description of Artificial Sequence: Syntheticoligonucleotide
  source 1..22: mol_type = other DNA
gcgactccaattggagtcgctc

SEQ ID NO: 8594 - DNA, 22 bp, synthetic construct
  misc_feature 1..22: note = Description of Artificial Sequence: Syntheticoligonucleotide
  source 1..22: mol_type = other DNA
acgactccaattggagtcgtcc

SEQ ID NO: 8595 - DNA, 22 bp, synthetic construct
  misc_feature 1..22: note = Description of Artificial Sequence: Syntheticoligonucleotide
  source 1..22: mol_type = other DNA
gagactccaattggagtctccc

SEQ ID NO: 8596 - DNA, 22 bp, synthetic construct
  misc_feature 1..22: note = Description of Artificial Sequence: Syntheticoligonucleotide
  source 1..22: mol_type = other DNA
gcgactccaattggagtcgcca

SEQ ID NO: 8597 - DNA, 22 bp, synthetic construct
  misc_feature 1..22: note = Description of Artificial Sequence: Syntheticoligonucleotide
  source 1..22: mol_type = other DNA
gcgactccaattggagtcgcac

SEQ ID NO: 8598 - DNA, 22 bp, synthetic construct
  misc_feature 1..22: note = Description of Artificial Sequence: Syntheticoligonucleotide
  source 1..22: mol_type = other DNA
gtgactccaattggagtcaccc

SEQ ID NO: 8599 - DNA, 22 bp, synthetic construct
  misc_feature 1..22: note = Description of Artificial Sequence: Syntheticoligonucleotide
  source 1..22: mol_type = other DNA
gggactccaattggagtcccgt

SEQ ID NO: 8600 - DNA, 22 bp, synthetic construct
  misc_feature 1..22: note = Description of Artificial Sequence: Syntheticoligonucleotide
  source 1..22: mol_type = other DNA
gggactccaattggagtccctg

SEQ ID NO: 8601 - DNA, 22 bp, synthetic construct
  misc_feature 1..22: note = Description of Artificial Sequence: Syntheticoligonucleotide
  source 1..22: mol_type = other DNA
aggactccaattggagtcctgg

SEQ ID NO: 8602 - DNA, 22 bp, synthetic construct
  misc_feature 1..22: note = Description of Artificial Sequence: Syntheticoligonucleotide
  source 1..22: mol_type = other DNA
gagactccaattggagtctcgg

SEQ ID NO: 8603 - DNA, 22 bp, synthetic construct
  misc_feature 1..22: note = Description of Artificial Sequence: Syntheticoligonucleotide
  source 1..22: mol_type = other DNA
gggactccaattggagtcccga

SEQ ID NO: 8604 - DNA, 22 bp, synthetic construct
  misc_feature 1..22: note = Description of Artificial Sequence: Syntheticoligonucleotide
  source 1..22: mol_type = other DNA
gggactccaattggagtcccag

SEQ ID NO: 8605 - DNA, 22 bp, synthetic construct
  misc_feature 1..22: note = Description of Artificial Sequence: Syntheticoligonucleotide
  source 1..22: mol_type = other DNA
tggactccaattggagtccagg

SEQ ID NO: 8606 - DNA, 22 bp, synthetic construct
  misc_feature 1..22: note = Description of Artificial Sequence: Syntheticoligonucleotide
  source 1..22: mol_type = other DNA
gtgactccaattggagtcacgg

SEQ ID NO: 8607 - DNA, 22 bp, synthetic construct
  misc_feature 1..22: note = Description of Artificial Sequence: Syntheticoligonucleotide
  source 1..22: mol_type = other DNA
gcgactccaattggagtcgccg

SEQ ID NO: 8608 - DNA, 22 bp, synthetic construct
  misc_feature 1..22: note = Description of Artificial Sequence: Syntheticoligonucleotide
  source 1..22: mol_type = other DNA
gcgactccaattggagtcgctg

SEQ ID NO: 8609 - DNA, 22 bp, synthetic construct
  misc_feature 1..22: note = Description of Artificial Sequence: Syntheticoligonucleotide
  source 1..22: mol_type = other DNA
acgactccaattggagtcgtcg

SEQ ID NO: 8610 - DNA, 22 bp, synthetic construct
  misc_feature 1..22: note = Description of Artificial Sequence: Syntheticoligonucleotide
  source 1..22: mol_type = other DNA
gagactccaattggagtctccg

SEQ ID NO: 8611 - DNA, 22 bp, synthetic construct
  misc_feature 1..22: note = Description of Artificial Sequence: Syntheticoligonucleotide
  source 1..22: mol_type = other DNA
gcgactccaattggagtcgcag

SEQ ID NO: 8612 - DNA, 22 bp, synthetic construct
  misc_feature 1..22: note = Description of Artificial Sequence: Syntheticoligonucleotide
  source 1..22: mol_type = other DNA
gtgactccaattggagtcaccg

SEQ ID NO: 8613 - DNA, 22 bp, synthetic construct
  misc_feature 1..22: note = Description of Artificial Sequence: Syntheticoligonucleotide
  source 1..22: mol_type = other DNA
cggactccaattggagtccgtg

SEQ ID NO: 8614 - DNA, 22 bp, synthetic construct
  misc_feature 1..22: note = Description of Artificial Sequence: Syntheticoligonucleotide
  source 1..22: mol_type = other DNA
cagactccaattggagtctggg

SEQ ID NO: 8615 - DNA, 22 bp, synthetic construct
  misc_feature 1..22: note = Description of Artificial Sequence: Syntheticoligonucleotide
  source 1..22: mol_type = other DNA
cggactccaattggagtccgag

SEQ ID NO: 8616 - DNA, 22 bp, synthetic construct
  misc_feature 1..22: note = Description of Artificial Sequence: Syntheticoligonucleotide
  source 1..22: mol_type = other DNA
ctgactccaattggagtcaggg

SEQ ID NO: 8617 - DNA, 22 bp, synthetic construct
  misc_feature 1..22: note = Description of Artificial Sequence: Syntheticoligonucleotide
  source 1..22: mol_type = other DNA
acgactccaattggagtcgtgg

SEQ ID NO: 8618 - DNA, 22 bp, synthetic construct
  misc_feature 1..22: note = Description of Artificial Sequence: Syntheticoligonucleotide
  source 1..22: mol_type = other DNA
ccgactccaattggagtcggct

SEQ ID NO: 8619 - DNA, 22 bp, synthetic construct
  misc_feature 1..22: note = Description of Artificial Sequence: Syntheticoligonucleotide
  source 1..22: mol_type = other DNA
ccgactccaattggagtcggca

SEQ ID NO: 8620 - DNA, 22 bp, synthetic construct
  misc_feature 1..22: note = Description of Artificial Sequence: Syntheticoligonucleotide
  source 1..22: mol_type = other DNA
gagactccaattggagtctcgc

SEQ ID NO: 8621 - DNA, 22 bp, synthetic construct
  misc_feature 1..22: note = Description of Artificial Sequence: Syntheticoligonucleotide
  source 1..22: mol_type = other DNA
gtgactccaattggagtcacgc

SEQ ID NO: 8622 - DNA, 22 bp, synthetic construct
  misc_feature 1..22: note = Description of Artificial Sequence: Syntheticoligonucleotide
  source 1..22: mol_type = other DNA
aggactccaattggagtcctgc

SEQ ID NO: 8623 - DNA, 22 bp, synthetic construct
  misc_feature 1..22: note = Description of Artificial Sequence: Syntheticoligonucleotide
  source 1..22: mol_type = other DNA
tggactccaattggagtccagc

SEQ ID NO: 8624 - DNA, 22 bp, synthetic construct
  misc_feature 1..22: note = Description of Artificial Sequence: Syntheticoligonucleotide
  source 1..22: mol_type = other DNA
aggactccaattggagtcctcg

SEQ ID NO: 8625 - DNA, 22 bp, synthetic construct
  misc_feature 1..22: note = Description of Artificial Sequence: Syntheticoligonucleotide
  source 1..22: mol_type = other DNA
tggactccaattggagtccacg

SEQ ID NO: 8626 - DNA, 22 bp, synthetic construct
  misc_feature 1..22: note = Description of Artificial Sequence: Syntheticoligonucleotide
  source 1..22: mol_type = other DNA
ccgactccaattggagtcggtg

SEQ ID NO: 8627 - DNA, 22 bp, synthetic construct
  misc_feature 1..22: note = Description of Artificial Sequence: Syntheticoligonucleotide
  source 1..22: mol_type = other DNA
ccgactccaattggagtcggag

SEQ ID NO: 8628 - DNA, 22 bp, synthetic construct
  misc_feature 1..22: note = Description of Artificial Sequence: Syntheticoligonucleotide
  source 1..22: mol_type = other DNA
gggactccaattggagtcccgc

SEQ ID NO: 8629 - DNA, 22 bp, synthetic construct
  misc_feature 1..22: note = Description of Artificial Sequence: Syntheticoligonucleotide
  source 1..22: mol_type = other DNA
gggactccaattggagtccctc

SEQ ID NO: 8630 - DNA, 22 bp, synthetic construct
  misc_feature 1..22: note = Description of Artificial Sequence: Syntheticoligonucleotide
  source 1..22: mol_type = other DNA
gggactccaattggagtcccac

SEQ ID NO: 8631 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactccatatggagtcnnnn

SEQ ID NO: 8632 - DNA, 22 bp, synthetic construct
  misc_feature 1..22: note = Description of Artificial Sequence: Syntheticoligonucleotide
  source 1..22: mol_type = other DNA
cggactccatatggagtccgcc

SEQ ID NO: 8633 - DNA, 22 bp, synthetic construct
  misc_feature 1..22: note = Description of Artificial Sequence: Syntheticoligonucleotide
  source 1..22: mol_type = other DNA
cggactccatatggagtccgct

SEQ ID NO: 8634 - DNA, 22 bp, synthetic construct
  misc_feature 1..22: note = Description of Artificial Sequence: Syntheticoligonucleotide
  source 1..22: mol_type = other DNA
cggactccatatggagtccgtc

SEQ ID NO: 8635 - DNA, 22 bp, synthetic construct
  misc_feature 1..22: note = Description of Artificial Sequence: Syntheticoligonucleotide
  source 1..22: mol_type = other DNA
aggactccatatggagtcctcc

SEQ ID NO: 8636 - DNA, 22 bp, synthetic construct
  misc_feature 1..22: note = Description of Artificial Sequence: Syntheticoligonucleotide
  source 1..22: mol_type = other DNA
cagactccatatggagtctgcc

SEQ ID NO: 8637 - DNA, 22 bp, synthetic construct
  misc_feature 1..22: note = Description of Artificial Sequence: Syntheticoligonucleotide
  source 1..22: mol_type = other DNA
cggactccatatggagtccgca

SEQ ID NO: 8638 - DNA, 22 bp, synthetic construct
  misc_feature 1..22: note = Description of Artificial Sequence: Syntheticoligonucleotide
  source 1..22: mol_type = other DNA
cggactccatatggagtccgac

SEQ ID NO: 8639 - DNA, 22 bp, synthetic construct
  misc_feature 1..22: note = Description of Artificial Sequence: Syntheticoligonucleotide
  source 1..22: mol_type = other DNA
tggactccatatggagtccacc

SEQ ID NO: 8640 - DNA, 22 bp, synthetic construct
  misc_feature 1..22: note = Description of Artificial Sequence: Syntheticoligonucleotide
  source 1..22: mol_type = other DNA
ctgactccatatggagtcagcc

SEQ ID NO: 8641 - DNA, 22 bp, synthetic construct
  misc_feature 1..22: note = Description of Artificial Sequence: Syntheticoligonucleotide
  source 1..22: mol_type = other DNA
ccgactccatatggagtcgggc

SEQ ID NO: 8642 - DNA, 22 bp, synthetic construct
  misc_feature 1..22: note = Description of Artificial Sequence: Syntheticoligonucleotide
  source 1..22: mol_type = other DNA
ccgactccatatggagtcgggt

SEQ ID NO: 8643 - DNA, 22 bp, synthetic construct
  misc_feature 1..22: note = Description of Artificial Sequence: Syntheticoligonucleotide
  source 1..22: mol_type = other DNA
ccgactccatatggagtcggtc

SEQ ID NO: 8644 - DNA, 22 bp, synthetic construct
  misc_feature 1..22: note = Description of Artificial Sequence: Syntheticoligonucleotide
  source 1..22: mol_type = other DNA
acgactccatatggagtcgtgc

SEQ ID NO: 8645 - DNA, 22 bp, synthetic construct
  misc_feature 1..22: note = Description of Artificial Sequence: Syntheticoligonucleotide
  source 1..22: mol_type = other DNA
cagactccatatggagtctggc

SEQ ID NO: 8646 - DNA, 22 bp, synthetic construct
  misc_feature 1..22: note = Description of Artificial Sequence: Syntheticoligonucleotide
  source 1..22: mol_type = other DNA
ccgactccatatggagtcggga

SEQ ID NO: 8647 - DNA, 22 bp, synthetic construct
  misc_feature 1..22: note = Description of Artificial Sequence: Syntheticoligonucleotide
  source 1..22: mol_type = other DNA
ccgactccatatggagtcggac

SEQ ID NO: 8648 - DNA, 22 bp, synthetic construct
  misc_feature 1..22: note = Description of Artificial Sequence: Syntheticoligonucleotide
  source 1..22: mol_type = other DNA
ctgactccatatggagtcaggc

SEQ ID NO: 8649 - DNA, 22 bp, synthetic construct
  misc_feature 1..22: note = Description of Artificial Sequence: Syntheticoligonucleotide
  source 1..22: mol_type = other DNA
gcgactccatatggagtcgccc

SEQ ID NO: 8650 - DNA, 22 bp, synthetic construct
  misc_feature 1..22: note = Description of Artificial Sequence: Syntheticoligonucleotide
  source 1..22: mol_type = other DNA
gcgactccatatggagtcgcct

SEQ ID NO: 8651 - DNA, 22 bp, synthetic construct
  misc_feature 1..22: note = Description of Artificial Sequence: Syntheticoligonucleotide
  source 1..22: mol_type = other DNA
gcgactccatatggagtcgctc

SEQ ID NO: 8652 - DNA, 22 bp, synthetic construct
  misc_feature 1..22: note = Description of Artificial Sequence: Syntheticoligonucleotide
  source 1..22: mol_type = other DNA
acgactccatatggagtcgtcc

SEQ ID NO: 8653 - DNA, 22 bp, synthetic construct
  misc_feature 1..22: note = Description of Artificial Sequence: Syntheticoligonucleotide
  source 1..22: mol_type = other DNA
gagactccatatggagtctccc

SEQ ID NO: 8654 - DNA, 22 bp, synthetic construct
  misc_feature 1..22: note = Description of Artificial Sequence: Syntheticoligonucleotide
  source 1..22: mol_type = other DNA
gcgactccatatggagtcgcca

SEQ ID NO: 8655 - DNA, 22 bp, synthetic construct
  misc_feature 1..22: note = Description of Artificial Sequence: Syntheticoligonucleotide
  source 1..22: mol_type = other DNA
gcgactccatatggagtcgcac

SEQ ID NO: 8656 - DNA, 22 bp, synthetic construct
  misc_feature 1..22: note = Description of Artificial Sequence: Syntheticoligonucleotide
  source 1..22: mol_type = other DNA
gtgactccatatggagtcaccc

SEQ ID NO: 8657 - DNA, 22 bp, synthetic construct
  misc_feature 1..22: note = Description of Artificial Sequence: Syntheticoligonucleotide
  source 1..22: mol_type = other DNA
gggactccatatggagtcccgt

SEQ ID NO: 8658 - DNA, 22 bp, synthetic construct
  misc_feature 1..22: note = Description of Artificial Sequence: Syntheticoligonucleotide
  source 1..22: mol_type = other DNA
gggactccatatggagtccctg

SEQ ID NO: 8659 - DNA, 22 bp, synthetic construct
  misc_feature 1..22: note = Description of Artificial Sequence: Syntheticoligonucleotide
  source 1..22: mol_type = other DNA
aggactccatatggagtcctgg

SEQ ID NO: 8660 - DNA, 22 bp, synthetic construct
  misc_feature 1..22: note = Description of Artificial Sequence: Syntheticoligonucleotide
  source 1..22: mol_type = other DNA
gagactccatatggagtctcgg

SEQ ID NO: 8661 - DNA, 22 bp, synthetic construct
  misc_feature 1..22: note = Description of Artificial Sequence: Syntheticoligonucleotide
  source 1..22: mol_type = other DNA
gggactccatatggagtcccga

SEQ ID NO: 8662 - DNA, 22 bp, synthetic construct
  misc_feature 1..22: note = Description of Artificial Sequence: Syntheticoligonucleotide
  source 1..22: mol_type = other DNA
gggactccatatggagtcccag

SEQ ID NO: 8663 - DNA, 22 bp, synthetic construct
  misc_feature 1..22: note = Description of Artificial Sequence: Syntheticoligonucleotide
  source 1..22: mol_type = other DNA
tggactccatatggagtccagg

SEQ ID NO: 8664 - DNA, 22 bp, synthetic construct
  misc_feature 1..22: note = Description of Artificial Sequence: Syntheticoligonucleotide
  source 1..22: mol_type = other DNA
gtgactccatatggagtcacgg

SEQ ID NO: 8665 - DNA, 22 bp, synthetic construct
  misc_feature 1..22: note = Description of Artificial Sequence: Syntheticoligonucleotide
  source 1..22: mol_type = other DNA
gcgactccatatggagtcgccg

SEQ ID NO: 8666 - DNA, 22 bp, synthetic construct
  misc_feature 1..22: note = Description of Artificial Sequence: Syntheticoligonucleotide
  source 1..22: mol_type = other DNA
gcgactccatatggagtcgctg

SEQ ID NO: 8667 - DNA, 22 bp, synthetic construct
  misc_feature 1..22: note = Description of Artificial Sequence: Syntheticoligonucleotide
  source 1..22: mol_type = other DNA
acgactccatatggagtcgtcg

SEQ ID NO: 8668 - DNA, 22 bp, synthetic construct
  misc_feature 1..22: note = Description of Artificial Sequence: Syntheticoligonucleotide
  source 1..22: mol_type = other DNA
gagactccatatggagtctccg

SEQ ID NO: 8669 - DNA, 22 bp, synthetic construct
  misc_feature 1..22: note = Description of Artificial Sequence: Syntheticoligonucleotide
  source 1..22: mol_type = other DNA
gcgactccatatggagtcgcag

SEQ ID NO: 8670 - DNA, 22 bp, synthetic construct
  misc_feature 1..22: note = Description of Artificial Sequence: Syntheticoligonucleotide
  source 1..22: mol_type = other DNA
gtgactccatatggagtcaccg

SEQ ID NO: 8671 - DNA, 22 bp, synthetic construct
  misc_feature 1..22: note = Description of Artificial Sequence: Syntheticoligonucleotide
  source 1..22: mol_type = other DNA
cggactccatatggagtccgtg

SEQ ID NO: 8672 - DNA, 22 bp, synthetic construct
  misc_feature 1..22: note = Description of Artificial Sequence: Syntheticoligonucleotide
  source 1..22: mol_type = other DNA
cagactccatatggagtctggg

SEQ ID NO: 8673 - DNA, 22 bp, synthetic construct
  misc_feature 1..22: note = Description of Artificial Sequence: Syntheticoligonucleotide
  source 1..22: mol_type = other DNA
cggactccatatggagtccgag

SEQ ID NO: 8674 - DNA, 22 bp, synthetic construct
  misc_feature 1..22: note = Description of Artificial Sequence: Syntheticoligonucleotide
  source 1..22: mol_type = other DNA
ctgactccatatggagtcaggg

SEQ ID NO: 8675 - DNA, 22 bp, synthetic construct
  misc_feature 1..22: note = Description of Artificial Sequence: Syntheticoligonucleotide
  source 1..22: mol_type = other DNA
acgactccatatggagtcgtgg

SEQ ID NO: 8676 - DNA, 22 bp, synthetic construct
  misc_feature 1..22: note = Description of Artificial Sequence: Syntheticoligonucleotide
  source 1..22: mol_type = other DNA
ccgactccatatggagtcggct

SEQ ID NO: 8677 - DNA, 22 bp, synthetic construct
  misc_feature 1..22: note = Description of Artificial Sequence: Syntheticoligonucleotide
  source 1..22: mol_type = other DNA
ccgactccatatggagtcggca

SEQ ID NO: 8678 - DNA, 22 bp, synthetic construct
  misc_feature 1..22: note = Description of Artificial Sequence: Syntheticoligonucleotide
  source 1..22: mol_type = other DNA
gagactccatatggagtctcgc

SEQ ID NO: 8679 - DNA, 22 bp, synthetic construct
  misc_feature 1..22: note = Description of Artificial Sequence: Syntheticoligonucleotide
  source 1..22: mol_type = other DNA
gtgactccatatggagtcacgc

SEQ ID NO: 8680 - DNA, 22 bp, synthetic construct
  misc_feature 1..22: note = Description of Artificial Sequence: Syntheticoligonucleotide
  source 1..22: mol_type = other DNA
aggactccatatggagtcctgc

SEQ ID NO: 8681 - DNA, 22 bp, synthetic construct
  misc_feature 1..22: note = Description of Artificial Sequence: Syntheticoligonucleotide
  source 1..22: mol_type = other DNA
tggactccatatggagtccagc

SEQ ID NO: 8682 - DNA, 22 bp, synthetic construct
  misc_feature 1..22: note = Description of Artificial Sequence: Syntheticoligonucleotide
  source 1..22: mol_type = other DNA
aggactccatatggagtcctcg

SEQ ID NO: 8683 - DNA, 22 bp, synthetic construct
  misc_feature 1..22: note = Description of Artificial Sequence: Syntheticoligonucleotide
  source 1..22: mol_type = other DNA
tggactccatatggagtccacg

SEQ ID NO: 8684 - DNA, 22 bp, synthetic construct
  misc_feature 1..22: note = Description of Artificial Sequence: Syntheticoligonucleotide
  source 1..22: mol_type = other DNA
ccgactccatatggagtcggtg

SEQ ID NO: 8685 - DNA, 22 bp, synthetic construct
  misc_feature 1..22: note = Description of Artificial Sequence: Syntheticoligonucleotide
  source 1..22: mol_type = other DNA
ccgactccatatggagtcggag

SEQ ID NO: 8686 - DNA, 22 bp, synthetic construct
  misc_feature 1..22: note = Description of Artificial Sequence: Syntheticoligonucleotide
  source 1..22: mol_type = other DNA
gggactccatatggagtcccgc

SEQ ID NO: 8687 - DNA, 22 bp, synthetic construct
  misc_feature 1..22: note = Description of Artificial Sequence: Syntheticoligonucleotide
  source 1..22: mol_type = other DNA
gggactccatatggagtccctc

SEQ ID NO: 8688 - DNA, 22 bp, synthetic construct
  misc_feature 1..22: note = Description of Artificial Sequence: Syntheticoligonucleotide
  source 1..22: mol_type = other DNA
gggactccatatggagtcccac

SEQ ID NO: 8689 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactccagctggagtcnnnn

SEQ ID NO: 8690 - DNA, 22 bp, synthetic construct
  misc_feature 1..22: note = Description of Artificial Sequence: Syntheticoligonucleotide
  source 1..22: mol_type = other DNA
cggactccagctggagtccgcc

SEQ ID NO: 8691 - DNA, 22 bp, synthetic construct
  misc_feature 1..22: note = Description of Artificial Sequence: Syntheticoligonucleotide
  source 1..22: mol_type = other DNA
cggactccagctggagtccgct

SEQ ID NO: 8692 - DNA, 22 bp, synthetic construct
  misc_feature 1..22: note = Description of Artificial Sequence: Syntheticoligonucleotide
  source 1..22: mol_type = other DNA
cggactccagctggagtccgtc

SEQ ID NO: 8693 - DNA, 22 bp, synthetic construct
  misc_feature 1..22: note = Description of Artificial Sequence: Syntheticoligonucleotide
  source 1..22: mol_type = other DNA
aggactccagctggagtcctcc

SEQ ID NO: 8694 - DNA, 22 bp, synthetic construct
  misc_feature 1..22: note = Description of Artificial Sequence: Syntheticoligonucleotide
  source 1..22: mol_type = other DNA
cagactccagctggagtctgcc

SEQ ID NO: 8695 - DNA, 22 bp, synthetic construct
  misc_feature 1..22: note = Description of Artificial Sequence: Syntheticoligonucleotide
  source 1..22: mol_type = other DNA
cggactccagctggagtccgca

SEQ ID NO: 8696 - DNA, 22 bp, synthetic construct
  misc_feature 1..22: note = Description of Artificial Sequence: Syntheticoligonucleotide
  source 1..22: mol_type = other DNA
cggactccagctggagtccgac

SEQ ID NO: 8697 - DNA, 22 bp, synthetic construct
  misc_feature 1..22: note = Description of Artificial Sequence: Syntheticoligonucleotide
  source 1..22: mol_type = other DNA
tggactccagctggagtccacc

SEQ ID NO: 8698 - DNA, 22 bp, synthetic construct
  misc_feature 1..22: note = Description of Artificial Sequence: Syntheticoligonucleotide
  source 1..22: mol_type = other DNA
ctgactccagctggagtcagcc

SEQ ID NO: 8699 - DNA, 22 bp, synthetic construct
  misc_feature 1..22: note = Description of Artificial Sequence: Syntheticoligonucleotide
  source 1..22: mol_type = other DNA
ccgactccagctggagtcgggc

SEQ ID NO: 8700 - DNA, 22 bp, synthetic construct
  misc_feature 1..22: note = Description of Artificial Sequence: Syntheticoligonucleotide
  source 1..22: mol_type = other DNA
ccgactccagctggagtcgggt

SEQ ID NO: 8701 - DNA, 22 bp, synthetic construct
  misc_feature 1..22: note = Description of Artificial Sequence: Syntheticoligonucleotide
  source 1..22: mol_type = other DNA
ccgactccagctggagtcggtc

SEQ ID NO: 8702 - DNA, 22 bp, synthetic construct
  misc_feature 1..22: note = Description of Artificial Sequence: Syntheticoligonucleotide
  source 1..22: mol_type = other DNA
acgactccagctggagtcgtgc

SEQ ID NO: 8703 - DNA, 22 bp, synthetic construct
  misc_feature 1..22: note = Description of Artificial Sequence: Syntheticoligonucleotide
  source 1..22: mol_type = other DNA
cagactccagctggagtctggc

SEQ ID NO: 8704 - DNA, 22 bp, synthetic construct
  misc_feature 1..22: note = Description of Artificial Sequence: Syntheticoligonucleotide
  source 1..22: mol_type = other DNA
ccgactccagctggagtcggga

SEQ ID NO: 8705 - DNA, 22 bp, synthetic construct
  misc_feature 1..22: note = Description of Artificial Sequence: Syntheticoligonucleotide
  source 1..22: mol_type = other DNA
ccgactccagctggagtcggac

SEQ ID NO: 8706 - DNA, 22 bp, synthetic construct
  misc_feature 1..22: note = Description of Artificial Sequence: Syntheticoligonucleotide
  source 1..22: mol_type = other DNA
ctgactccagctggagtcaggc

SEQ ID NO: 8707 - DNA, 22 bp, synthetic construct
  misc_feature 1..22: note = Description of Artificial Sequence: Syntheticoligonucleotide
  source 1..22: mol_type = other DNA
gcgactccagctggagtcgccc

SEQ ID NO: 8708 - DNA, 22 bp, synthetic construct
  misc_feature 1..22: note = Description of Artificial Sequence: Syntheticoligonucleotide
  source 1..22: mol_type = other DNA
gcgactccagctggagtcgcct

SEQ ID NO: 8709 - DNA, 22 bp, synthetic construct
  misc_feature 1..22: note = Description of Artificial Sequence: Syntheticoligonucleotide
  source 1..22: mol_type = other DNA
gcgactccagctggagtcgctc

SEQ ID NO: 8710 - DNA, 22 bp, synthetic construct
  misc_feature 1..22: note = Description of Artificial Sequence: Syntheticoligonucleotide
  source 1..22: mol_type = other DNA
acgactccagctggagtcgtcc

SEQ ID NO: 8711 - DNA, 22 bp, synthetic construct
  misc_feature 1..22: note = Description of Artificial Sequence: Syntheticoligonucleotide
  source 1..22: mol_type = other DNA
gagactccagctggagtctccc

SEQ ID NO: 8712 - DNA, 22 bp, synthetic construct
  misc_feature 1..22: note = Description of Artificial Sequence: Syntheticoligonucleotide
  source 1..22: mol_type = other DNA
gcgactccagctggagtcgcca

SEQ ID NO: 8713 - DNA, 22 bp, synthetic construct
  misc_feature 1..22: note = Description of Artificial Sequence: Syntheticoligonucleotide
  source 1..22: mol_type = other DNA
gcgactccagctggagtcgcac

SEQ ID NO: 8714 - DNA, 22 bp, synthetic construct
  misc_feature 1..22: note = Description of Artificial Sequence: Syntheticoligonucleotide
  source 1..22: mol_type = other DNA
gtgactccagctggagtcaccc

SEQ ID NO: 8715 - DNA, 22 bp, synthetic construct
  misc_feature 1..22: note = Description of Artificial Sequence: Syntheticoligonucleotide
  source 1..22: mol_type = other DNA
gggactccagctggagtcccgt

SEQ ID NO: 8716 - DNA, 22 bp, synthetic construct
  misc_feature 1..22: note = Description of Artificial Sequence: Syntheticoligonucleotide
  source 1..22: mol_type = other DNA
gggactccagctggagtccctg

SEQ ID NO: 8717 - DNA, 22 bp, synthetic construct
  misc_feature 1..22: note = Description of Artificial Sequence: Syntheticoligonucleotide
  source 1..22: mol_type = other DNA
aggactccagctggagtcctgg

SEQ ID NO: 8718 - DNA, 22 bp, synthetic construct
  misc_feature 1..22: note = Description of Artificial Sequence: Syntheticoligonucleotide
  source 1..22: mol_type = other DNA
gagactccagctggagtctcgg

SEQ ID NO: 8719 - DNA, 22 bp, synthetic construct
  misc_feature 1..22: note = Description of Artificial Sequence: Syntheticoligonucleotide
  source 1..22: mol_type = other DNA
gggactccagctggagtcccga

SEQ ID NO: 8720 - DNA, 22 bp, synthetic construct
  misc_feature 1..22: note = Description of Artificial Sequence: Syntheticoligonucleotide
  source 1..22: mol_type = other DNA
gggactccagctggagtcccag

SEQ ID NO: 8721 - DNA, 22 bp, synthetic construct
  misc_feature 1..22: note = Description of Artificial Sequence: Syntheticoligonucleotide
  source 1..22: mol_type = other DNA
tggactccagctggagtccagg

SEQ ID NO: 8722 - DNA, 22 bp, synthetic construct
  misc_feature 1..22: note = Description of Artificial Sequence: Syntheticoligonucleotide
  source 1..22: mol_type = other DNA
gtgactccagctggagtcacgg

SEQ ID NO: 8723 - DNA, 22 bp, synthetic construct
  misc_feature 1..22: note = Description of Artificial Sequence: Syntheticoligonucleotide
  source 1..22: mol_type = other DNA
gcgactccagctggagtcgccg

SEQ ID NO: 8724 - DNA, 22 bp, synthetic construct
  misc_feature 1..22: note = Description of Artificial Sequence: Syntheticoligonucleotide
  source 1..22: mol_type = other DNA
gcgactccagctggagtcgctg

SEQ ID NO: 8725 - DNA, 22 bp, synthetic construct
  misc_feature 1..22: note = Description of Artificial Sequence: Syntheticoligonucleotide
  source 1..22: mol_type = other DNA
acgactccagctggagtcgtcg

SEQ ID NO: 8726 - DNA, 22 bp, synthetic construct
  misc_feature 1..22: note = Description of Artificial Sequence: Syntheticoligonucleotide
  source 1..22: mol_type = other DNA
gagactccagctggagtctccg

SEQ ID NO: 8727 - DNA, 22 bp, synthetic construct
  misc_feature 1..22: note = Description of Artificial Sequence: Syntheticoligonucleotide
  source 1..22: mol_type = other DNA
gcgactccagctggagtcgcag

SEQ ID NO: 8728 - DNA, 22 bp, synthetic construct
  misc_feature 1..22: note = Description of Artificial Sequence: Syntheticoligonucleotide
  source 1..22: mol_type = other DNA
gtgactccagctggagtcaccg

SEQ ID NO: 8729 - DNA, 22 bp, synthetic construct
  misc_feature 1..22: note = Description of Artificial Sequence: Syntheticoligonucleotide
  source 1..22: mol_type = other DNA
cggactccagctggagtccgtg

SEQ ID NO: 8730 - DNA, 22 bp, synthetic construct
  misc_feature 1..22: note = Description of Artificial Sequence: Syntheticoligonucleotide
  source 1..22: mol_type = other DNA
cagactccagctggagtctggg

SEQ ID NO: 8731 - DNA, 22 bp, synthetic construct
  misc_feature 1..22: note = Description of Artificial Sequence: Syntheticoligonucleotide
  source 1..22: mol_type = other DNA
cggactccagctggagtccgag

SEQ ID NO: 8732 - DNA, 22 bp, synthetic construct
  misc_feature 1..22: note = Description of Artificial Sequence: Syntheticoligonucleotide
  source 1..22: mol_type = other DNA
ctgactccagctggagtcaggg

SEQ ID NO: 8733 - DNA, 22 bp, synthetic construct
  misc_feature 1..22: note = Description of Artificial Sequence: Syntheticoligonucleotide
  source 1..22: mol_type = other DNA
acgactccagctggagtcgtgg

SEQ ID NO: 8734 - DNA, 22 bp, synthetic construct
  misc_feature 1..22: note = Description of Artificial Sequence: Syntheticoligonucleotide
  source 1..22: mol_type = other DNA
ccgactccagctggagtcggct

SEQ ID NO: 8735 - DNA, 22 bp, synthetic construct
  misc_feature 1..22: note = Description of Artificial Sequence: Syntheticoligonucleotide
  source 1..22: mol_type = other DNA
ccgactccagctggagtcggca

SEQ ID NO: 8736 - DNA, 22 bp, synthetic construct
  misc_feature 1..22: note = Description of Artificial Sequence: Syntheticoligonucleotide
  source 1..22: mol_type = other DNA
gagactccagctggagtctcgc

SEQ ID NO: 8737 - DNA, 22 bp, synthetic construct
  misc_feature 1..22: note = Description of Artificial Sequence: Syntheticoligonucleotide
  source 1..22: mol_type = other DNA
gtgactccagctggagtcacgc

SEQ ID NO: 8738 - DNA, 22 bp, synthetic construct
  misc_feature 1..22: note = Description of Artificial Sequence: Syntheticoligonucleotide
  source 1..22: mol_type = other DNA
aggactccagctggagtcctgc

SEQ ID NO: 8739 - DNA, 22 bp, synthetic construct
  misc_feature 1..22: note = Description of Artificial Sequence: Syntheticoligonucleotide
  source 1..22: mol_type = other DNA
tggactccagctggagtccagc

SEQ ID NO: 8740 - DNA, 22 bp, synthetic construct
  misc_feature 1..22: note = Description of Artificial Sequence: Syntheticoligonucleotide
  source 1..22: mol_type = other DNA
aggactccagctggagtcctcg

SEQ ID NO: 8741 - DNA, 22 bp, synthetic construct
  misc_feature 1..22: note = Description of Artificial Sequence: Syntheticoligonucleotide
  source 1..22: mol_type = other DNA
tggactccagctggagtccacg

SEQ ID NO: 8742 - DNA, 22 bp, synthetic construct
  misc_feature 1..22: note = Description of Artificial Sequence: Syntheticoligonucleotide
  source 1..22: mol_type = other DNA
ccgactccagctggagtcggtg

SEQ ID NO: 8743 - DNA, 22 bp, synthetic construct
  misc_feature 1..22: note = Description of Artificial Sequence: Syntheticoligonucleotide
  source 1..22: mol_type = other DNA
ccgactccagctggagtcggag

SEQ ID NO: 8744 - DNA, 22 bp, synthetic construct
  misc_feature 1..22: note = Description of Artificial Sequence: Syntheticoligonucleotide
  source 1..22: mol_type = other DNA
gggactccagctggagtcccgc

SEQ ID NO: 8745 - DNA, 22 bp, synthetic construct
  misc_feature 1..22: note = Description of Artificial Sequence: Syntheticoligonucleotide
  source 1..22: mol_type = other DNA
gggactccagctggagtccctc

SEQ ID NO: 8746 - DNA, 22 bp, synthetic construct
  misc_feature 1..22: note = Description of Artificial Sequence: Syntheticoligonucleotide
  source 1..22: mol_type = other DNA
gggactccagctggagtcccac

SEQ ID NO: 8747 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactccacgtggagtcnnnn

SEQ ID NO: 8748 - DNA, 22 bp, synthetic construct
  misc_feature 1..22: note = Description of Artificial Sequence: Syntheticoligonucleotide
  source 1..22: mol_type = other DNA
cggactccacgtggagtccgcc

SEQ ID NO: 8749 - DNA, 22 bp, synthetic construct
  misc_feature 1..22: note = Description of Artificial Sequence: Syntheticoligonucleotide
  source 1..22: mol_type = other DNA
cggactccacgtggagtccgct

SEQ ID NO: 8750 - DNA, 22 bp, synthetic construct
  misc_feature 1..22: note = Description of Artificial Sequence: Syntheticoligonucleotide
  source 1..22: mol_type = other DNA
cggactccacgtggagtccgtc

SEQ ID NO: 8751 - DNA, 22 bp, synthetic construct
  misc_feature 1..22: note = Description of Artificial Sequence: Syntheticoligonucleotide
  source 1..22: mol_type = other DNA
aggactccacgtggagtcctcc

SEQ ID NO: 8752 - DNA, 22 bp, synthetic construct
  misc_feature 1..22: note = Description of Artificial Sequence: Syntheticoligonucleotide
  source 1..22: mol_type = other DNA
cagactccacgtggagtctgcc

SEQ ID NO: 8753 - DNA, 22 bp, synthetic construct
  misc_feature 1..22: note = Description of Artificial Sequence: Syntheticoligonucleotide
  source 1..22: mol_type = other DNA
cggactccacgtggagtccgca

SEQ ID NO: 8754 - DNA, 22 bp, synthetic construct
  misc_feature 1..22: note = Description of Artificial Sequence: Syntheticoligonucleotide
  source 1..22: mol_type = other DNA
cggactccacgtggagtccgac

SEQ ID NO: 8755 - DNA, 22 bp, synthetic construct
  misc_feature 1..22: note = Description of Artificial Sequence: Syntheticoligonucleotide
  source 1..22: mol_type = other DNA
tggactccacgtggagtccacc

SEQ ID NO: 8756 - DNA, 22 bp, synthetic construct
  misc_feature 1..22: note = Description of Artificial Sequence: Syntheticoligonucleotide
  source 1..22: mol_type = other DNA
ctgactccacgtggagtcagcc

SEQ ID NO: 8757 - DNA, 22 bp, synthetic construct
  misc_feature 1..22: note = Description of Artificial Sequence: Syntheticoligonucleotide
  source 1..22: mol_type = other DNA
ccgactccacgtggagtcgggc

SEQ ID NO: 8758 - DNA, 22 bp, synthetic construct
  misc_feature 1..22: note = Description of Artificial Sequence: Syntheticoligonucleotide
  source 1..22: mol_type = other DNA
ccgactccacgtggagtcgggt

SEQ ID NO: 8759 - DNA, 22 bp, synthetic construct
  misc_feature 1..22: note = Description of Artificial Sequence: Syntheticoligonucleotide
  source 1..22: mol_type = other DNA
ccgactccacgtggagtcggtc

SEQ ID NO: 8760 - DNA, 22 bp, synthetic construct
  misc_feature 1..22: note = Description of Artificial Sequence: Syntheticoligonucleotide
  source 1..22: mol_type = other DNA
acgactccacgtggagtcgtgc

SEQ ID NO: 8761 - DNA, 22 bp, synthetic construct
  misc_feature 1..22: note = Description of Artificial Sequence: Syntheticoligonucleotide
  source 1..22: mol_type = other DNA
cagactccacgtggagtctggc

SEQ ID NO: 8762 - DNA, 22 bp, synthetic construct
  misc_feature 1..22: note = Description of Artificial Sequence: Syntheticoligonucleotide
  source 1..22: mol_type = other DNA
ccgactccacgtggagtcggga

SEQ ID NO: 8763 - DNA, 22 bp, synthetic construct
  misc_feature 1..22: note = Description of Artificial Sequence: Syntheticoligonucleotide
  source 1..22: mol_type = other DNA
ccgactccacgtggagtcggac

SEQ ID NO: 8764 - DNA, 22 bp, synthetic construct
  misc_feature 1..22: note = Description of Artificial Sequence: Syntheticoligonucleotide
  source 1..22: mol_type = other DNA
ctgactccacgtggagtcaggc

SEQ ID NO: 8765 - DNA, 22 bp, synthetic construct
  misc_feature 1..22: note = Description of Artificial Sequence: Syntheticoligonucleotide
  source 1..22: mol_type = other DNA
gcgactccacgtggagtcgccc

SEQ ID NO: 8766 - DNA, 22 bp, synthetic construct
  misc_feature 1..22: note = Description of Artificial Sequence: Syntheticoligonucleotide
  source 1..22: mol_type = other DNA
gcgactccacgtggagtcgcct

SEQ ID NO: 8767 - DNA, 22 bp, synthetic construct
  misc_feature 1..22: note = Description of Artificial Sequence: Syntheticoligonucleotide
  source 1..22: mol_type = other DNA
gcgactccacgtggagtcgctc

SEQ ID NO: 8768 - DNA, 22 bp, synthetic construct
  misc_feature 1..22: note = Description of Artificial Sequence: Syntheticoligonucleotide
  source 1..22: mol_type = other DNA
acgactccacgtggagtcgtcc

SEQ ID NO: 8769 - DNA, 22 bp, synthetic construct
  misc_feature 1..22: note = Description of Artificial Sequence: Syntheticoligonucleotide
  source 1..22: mol_type = other DNA
gagactccacgtggagtctccc

SEQ ID NO: 8770 - DNA, 22 bp, synthetic construct
  misc_feature 1..22: note = Description of Artificial Sequence: Syntheticoligonucleotide
  source 1..22: mol_type = other DNA
gcgactccacgtggagtcgcca

SEQ ID NO: 8771 - DNA, 22 bp, synthetic construct
  misc_feature 1..22: note = Description of Artificial Sequence: Syntheticoligonucleotide
  source 1..22: mol_type = other DNA
gcgactccacgtggagtcgcac

SEQ ID NO: 8772 - DNA, 22 bp, synthetic construct
  misc_feature 1..22: note = Description of Artificial Sequence: Syntheticoligonucleotide
  source 1..22: mol_type = other DNA
gtgactccacgtggagtcaccc

SEQ ID NO: 8773 - DNA, 22 bp, synthetic construct
  misc_feature 1..22: note = Description of Artificial Sequence: Syntheticoligonucleotide
  source 1..22: mol_type = other DNA
gggactccacgtggagtcccgt

SEQ ID NO: 8774 - DNA, 22 bp, synthetic construct
  misc_feature 1..22: note = Description of Artificial Sequence: Syntheticoligonucleotide
  source 1..22: mol_type = other DNA
gggactccacgtggagtccctg

SEQ ID NO: 8775 - DNA, 22 bp, synthetic construct
  misc_feature 1..22: note = Description of Artificial Sequence: Syntheticoligonucleotide
  source 1..22: mol_type = other DNA
aggactccacgtggagtcctgg

SEQ ID NO: 8776 - DNA, 22 bp, synthetic construct
  misc_feature 1..22: note = Description of Artificial Sequence: Syntheticoligonucleotide
  source 1..22: mol_type = other DNA
gagactccacgtggagtctcgg

SEQ ID NO: 8777 - DNA, 22 bp, synthetic construct
  misc_feature 1..22: note = Description of Artificial Sequence: Syntheticoligonucleotide
  source 1..22: mol_type = other DNA
gggactccacgtggagtcccga

SEQ ID NO: 8778 - DNA, 22 bp, synthetic construct
  misc_feature 1..22: note = Description of Artificial Sequence: Syntheticoligonucleotide
  source 1..22: mol_type = other DNA
gggactccacgtggagtcccag

SEQ ID NO: 8779 - DNA, 22 bp, synthetic construct
  misc_feature 1..22: note = Description of Artificial Sequence: Syntheticoligonucleotide
  source 1..22: mol_type = other DNA
tggactccacgtggagtccagg

SEQ ID NO: 8780 - DNA, 22 bp, synthetic construct
  misc_feature 1..22: note = Description of Artificial Sequence: Syntheticoligonucleotide
  source 1..22: mol_type = other DNA
gtgactccacgtggagtcacgg

SEQ ID NO: 8781 - DNA, 22 bp, synthetic construct
  misc_feature 1..22: note = Description of Artificial Sequence: Syntheticoligonucleotide
  source 1..22: mol_type = other DNA
gcgactccacgtggagtcgccg

SEQ ID NO: 8782 - DNA, 22 bp, synthetic construct
  misc_feature 1..22: note = Description of Artificial Sequence: Syntheticoligonucleotide
  source 1..22: mol_type = other DNA
gcgactccacgtggagtcgctg

SEQ ID NO: 8783 - DNA, 22 bp, synthetic construct
  misc_feature 1..22: note = Description of Artificial Sequence: Syntheticoligonucleotide
  source 1..22: mol_type = other DNA
acgactccacgtggagtcgtcg

SEQ ID NO: 8784 - DNA, 22 bp, synthetic construct
  misc_feature 1..22: note = Description of Artificial Sequence: Syntheticoligonucleotide
  source 1..22: mol_type = other DNA
gagactccacgtggagtctccg

SEQ ID NO: 8785 - DNA, 22 bp, synthetic construct
  misc_feature 1..22: note = Description of Artificial Sequence: Syntheticoligonucleotide
  source 1..22: mol_type = other DNA
gcgactccacgtggagtcgcag

SEQ ID NO: 8786 - DNA, 22 bp, synthetic construct
  misc_feature 1..22: note = Description of Artificial Sequence: Syntheticoligonucleotide
  source 1..22: mol_type = other DNA
gtgactccacgtggagtcaccg

SEQ ID NO: 8787 - DNA, 22 bp, synthetic construct
  misc_feature 1..22: note = Description of Artificial Sequence: Syntheticoligonucleotide
  source 1..22: mol_type = other DNA
cggactccacgtggagtccgtg

SEQ ID NO: 8788 - DNA, 22 bp, synthetic construct
  misc_feature 1..22: note = Description of Artificial Sequence: Syntheticoligonucleotide
  source 1..22: mol_type = other DNA
cagactccacgtggagtctggg

SEQ ID NO: 8789 - DNA, 22 bp, synthetic construct
  misc_feature 1..22: note = Description of Artificial Sequence: Syntheticoligonucleotide
  source 1..22: mol_type = other DNA
cggactccacgtggagtccgag

SEQ ID NO: 8790 - DNA, 22 bp, synthetic construct
  misc_feature 1..22: note = Description of Artificial Sequence: Syntheticoligonucleotide
  source 1..22: mol_type = other DNA
ctgactccacgtggagtcaggg

SEQ ID NO: 8791 - DNA, 22 bp, synthetic construct
  misc_feature 1..22: note = Description of Artificial Sequence: Syntheticoligonucleotide
  source 1..22: mol_type = other DNA
acgactccacgtggagtcgtgg

SEQ ID NO: 8792 - DNA, 22 bp, synthetic construct
  misc_feature 1..22: note = Description of Artificial Sequence: Syntheticoligonucleotide
  source 1..22: mol_type = other DNA
ccgactccacgtggagtcggct

SEQ ID NO: 8793 - DNA, 22 bp, synthetic construct
  misc_feature 1..22: note = Description of Artificial Sequence: Syntheticoligonucleotide
  source 1..22: mol_type = other DNA
ccgactccacgtggagtcggca

SEQ ID NO: 8794 - DNA, 22 bp, synthetic construct
  misc_feature 1..22: note = Description of Artificial Sequence: Syntheticoligonucleotide
  source 1..22: mol_type = other DNA
gagactccacgtggagtctcgc

SEQ ID NO: 8795 - DNA, 22 bp, synthetic construct
  misc_feature 1..22: note = Description of Artificial Sequence: Syntheticoligonucleotide
  source 1..22: mol_type = other DNA
gtgactccacgtggagtcacgc

SEQ ID NO: 8796 - DNA, 22 bp, synthetic construct
  misc_feature 1..22: note = Description of Artificial Sequence: Syntheticoligonucleotide
  source 1..22: mol_type = other DNA
aggactccacgtggagtcctgc

SEQ ID NO: 8797 - DNA, 22 bp, synthetic construct
  misc_feature 1..22: note = Description of Artificial Sequence: Syntheticoligonucleotide
  source 1..22: mol_type = other DNA
tggactccacgtggagtccagc

SEQ ID NO: 8798 - DNA, 22 bp, synthetic construct
  misc_feature 1..22: note = Description of Artificial Sequence: Syntheticoligonucleotide
  source 1..22: mol_type = other DNA
aggactccacgtggagtcctcg

SEQ ID NO: 8799 - DNA, 22 bp, synthetic construct
  misc_feature 1..22: note = Description of Artificial Sequence: Syntheticoligonucleotide
  source 1..22: mol_type = other DNA
tggactccacgtggagtccacg

SEQ ID NO: 8800 - DNA, 22 bp, synthetic construct
  misc_feature 1..22: note = Description of Artificial Sequence: Syntheticoligonucleotide
  source 1..22: mol_type = other DNA
ccgactccacgtggagtcggtg

SEQ ID NO: 8801 - DNA, 22 bp, synthetic construct
  misc_feature 1..22: note = Description of Artificial Sequence: Syntheticoligonucleotide
  source 1..22: mol_type = other DNA
ccgactccacgtggagtcggag

SEQ ID NO: 8802 - DNA, 22 bp, synthetic construct
  misc_feature 1..22: note = Description of Artificial Sequence: Syntheticoligonucleotide
  source 1..22: mol_type = other DNA
gggactccacgtggagtcccgc

SEQ ID NO: 8803 - DNA, 22 bp, synthetic construct
  misc_feature 1..22: note = Description of Artificial Sequence: Syntheticoligonucleotide
  source 1..22: mol_type = other DNA
gggactccacgtggagtccctc

SEQ ID NO: 8804 - DNA, 22 bp, synthetic construct
  misc_feature 1..22: note = Description of Artificial Sequence: Syntheticoligonucleotide
  source 1..22: mol_type = other DNA
gggactccacgtggagtcccac

SEQ ID NO: 8805 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactctcatgagagtcnnnn

SEQ ID NO: 8806 - DNA, 22 bp, synthetic construct
  misc_feature 1..22: note = Description of Artificial Sequence: Syntheticoligonucleotide
  source 1..22: mol_type = other DNA
cggactctcatgagagtccgcc

SEQ ID NO: 8807 - DNA, 22 bp, synthetic construct
  misc_feature 1..22: note = Description of Artificial Sequence: Syntheticoligonucleotide
  source 1..22: mol_type = other DNA
cggactctcatgagagtccgct

SEQ ID NO: 8808 - DNA, 22 bp, synthetic construct
  misc_feature 1..22: note = Description of Artificial Sequence: Syntheticoligonucleotide
  source 1..22: mol_type = other DNA
cggactctcatgagagtccgtc

SEQ ID NO: 8809 - DNA, 22 bp, synthetic construct
  misc_feature 1..22: note = Description of Artificial Sequence: Syntheticoligonucleotide
  source 1..22: mol_type = other DNA
aggactctcatgagagtcctcc

SEQ ID NO: 8810 - DNA, 22 bp, synthetic construct
  misc_feature 1..22: note = Description of Artificial Sequence: Syntheticoligonucleotide
  source 1..22: mol_type = other DNA
cagactctcatgagagtctgcc

SEQ ID NO: 8811 - DNA, 22 bp, synthetic construct
  misc_feature 1..22: note = Description of Artificial Sequence: Syntheticoligonucleotide
  source 1..22: mol_type = other DNA
cggactctcatgagagtccgca

SEQ ID NO: 8812 - DNA, 22 bp, synthetic construct
  misc_feature 1..22: note = Description of Artificial Sequence: Syntheticoligonucleotide
  source 1..22: mol_type = other DNA
cggactctcatgagagtccgac

SEQ ID NO: 8813 - DNA, 22 bp, synthetic construct
  misc_feature 1..22: note = Description of Artificial Sequence: Syntheticoligonucleotide
  source 1..22: mol_type = other DNA
tggactctcatgagagtccacc

SEQ ID NO: 8814 - DNA, 22 bp, synthetic construct
  misc_feature 1..22: note = Description of Artificial Sequence: Syntheticoligonucleotide
  source 1..22: mol_type = other DNA
ctgactctcatgagagtcagcc

SEQ ID NO: 8815 - DNA, 22 bp, synthetic construct
  misc_feature 1..22: note = Description of Artificial Sequence: Syntheticoligonucleotide
  source 1..22: mol_type = other DNA
ccgactctcatgagagtcgggc

SEQ ID NO: 8816 - DNA, 22 bp, synthetic construct
  misc_feature 1..22: note = Description of Artificial Sequence: Syntheticoligonucleotide
  source 1..22: mol_type = other DNA
ccgactctcatgagagtcgggt

SEQ ID NO: 8817 - DNA, 22 bp, synthetic construct
  misc_feature 1..22: note = Description of Artificial Sequence: Syntheticoligonucleotide
  source 1..22: mol_type = other DNA
ccgactctcatgagagtcggtc

SEQ ID NO: 8818 - DNA, 22 bp, synthetic construct
  misc_feature 1..22: note = Description of Artificial Sequence: Syntheticoligonucleotide
  source 1..22: mol_type = other DNA
acgactctcatgagagtcgtgc

SEQ ID NO: 8819 - DNA, 22 bp, synthetic construct
  misc_feature 1..22: note = Description of Artificial Sequence: Syntheticoligonucleotide
  source 1..22: mol_type = other DNA
cagactctcatgagagtctggc

SEQ ID NO: 8820 - DNA, 22 bp, synthetic construct
  misc_feature 1..22: note = Description of Artificial Sequence: Syntheticoligonucleotide
  source 1..22: mol_type = other DNA
ccgactctcatgagagtcggga

SEQ ID NO: 8821 - DNA, 22 bp, synthetic construct
  misc_feature 1..22: note = Description of Artificial Sequence: Syntheticoligonucleotide
  source 1..22: mol_type = other DNA
ccgactctcatgagagtcggac

SEQ ID NO: 8822 - DNA, 22 bp, synthetic construct
  misc_feature 1..22: note = Description of Artificial Sequence: Syntheticoligonucleotide
  source 1..22: mol_type = other DNA
ctgactctcatgagagtcaggc

SEQ ID NO: 8823 - DNA, 22 bp, synthetic construct
  misc_feature 1..22: note = Description of Artificial Sequence: Syntheticoligonucleotide
  source 1..22: mol_type = other DNA
gcgactctcatgagagtcgccc

SEQ ID NO: 8824 - DNA, 22 bp, synthetic construct
  misc_feature 1..22: note = Description of Artificial Sequence: Syntheticoligonucleotide
  source 1..22: mol_type = other DNA
gcgactctcatgagagtcgcct

SEQ ID NO: 8825 - DNA, 22 bp, synthetic construct
  misc_feature 1..22: note = Description of Artificial Sequence: Syntheticoligonucleotide
  source 1..22: mol_type = other DNA
gcgactctcatgagagtcgctc

SEQ ID NO: 8826 - DNA, 22 bp, synthetic construct
  misc_feature 1..22: note = Description of Artificial Sequence: Syntheticoligonucleotide
  source 1..22: mol_type = other DNA
acgactctcatgagagtcgtcc

SEQ ID NO: 8827 - DNA, 22 bp, synthetic construct
  misc_feature 1..22: note = Description of Artificial Sequence: Syntheticoligonucleotide
  source 1..22: mol_type = other DNA
gagactctcatgagagtctccc

SEQ ID NO: 8828 - DNA, 22 bp, synthetic construct
  misc_feature 1..22: note = Description of Artificial Sequence: Syntheticoligonucleotide
  source 1..22: mol_type = other DNA
gcgactctcatgagagtcgcca

SEQ ID NO: 8829 - DNA, 22 bp, synthetic construct
  misc_feature 1..22: note = Description of Artificial Sequence: Syntheticoligonucleotide
  source 1..22: mol_type = other DNA
gcgactctcatgagagtcgcac

SEQ ID NO: 8830 - DNA, 22 bp, synthetic construct
  misc_feature 1..22: note = Description of Artificial Sequence: Syntheticoligonucleotide
  source 1..22: mol_type = other DNA
gtgactctcatgagagtcaccc

SEQ ID NO: 8831 - DNA, 22 bp, synthetic construct
  misc_feature 1..22: note = Description of Artificial Sequence: Syntheticoligonucleotide
  source 1..22: mol_type = other DNA
gggactctcatgagagtcccgt

SEQ ID NO: 8832 - DNA, 22 bp, synthetic construct
  misc_feature 1..22: note = Description of Artificial Sequence: Syntheticoligonucleotide
  source 1..22: mol_type = other DNA
gggactctcatgagagtccctg

SEQ ID NO: 8833 - DNA, 22 bp, synthetic construct
  misc_feature 1..22: note = Description of Artificial Sequence: Syntheticoligonucleotide
  source 1..22: mol_type = other DNA
aggactctcatgagagtcctgg

SEQ ID NO: 8834 - DNA, 22 bp, synthetic construct
  misc_feature 1..22: note = Description of Artificial Sequence: Syntheticoligonucleotide
  source 1..22: mol_type = other DNA
gagactctcatgagagtctcgg

SEQ ID NO: 8835 - DNA, 22 bp, synthetic construct
  misc_feature 1..22: note = Description of Artificial Sequence: Syntheticoligonucleotide
  source 1..22: mol_type = other DNA
gggactctcatgagagtcccga

SEQ ID NO: 8836 - DNA, 22 bp, synthetic construct
  misc_feature 1..22: note = Description of Artificial Sequence: Syntheticoligonucleotide
  source 1..22: mol_type = other DNA
gggactctcatgagagtcccag

SEQ ID NO: 8837 - DNA, 22 bp, synthetic construct
  misc_feature 1..22: note = Description of Artificial Sequence: Syntheticoligonucleotide
  source 1..22: mol_type = other DNA
tggactctcatgagagtccagg

SEQ ID NO: 8838 - DNA, 22 bp, synthetic construct
  misc_feature 1..22: note = Description of Artificial Sequence: Syntheticoligonucleotide
  source 1..22: mol_type = other DNA
gtgactctcatgagagtcacgg

SEQ ID NO: 8839 - DNA, 22 bp, synthetic construct
  misc_feature 1..22: note = Description of Artificial Sequence: Syntheticoligonucleotide
  source 1..22: mol_type = other DNA
gcgactctcatgagagtcgccg

SEQ ID NO: 8840 - DNA, 22 bp, synthetic construct
  misc_feature 1..22: note = Description of Artificial Sequence: Syntheticoligonucleotide
  source 1..22: mol_type = other DNA
gcgactctcatgagagtcgctg

SEQ ID NO: 8841 - DNA, 22 bp, synthetic construct
  misc_feature 1..22: note = Description of Artificial Sequence: Syntheticoligonucleotide
  source 1..22: mol_type = other DNA
acgactctcatgagagtcgtcg

SEQ ID NO: 8842 - DNA, 22 bp, synthetic construct
  misc_feature 1..22: note = Description of Artificial Sequence: Syntheticoligonucleotide
  source 1..22: mol_type = other DNA
gagactctcatgagagtctccg

SEQ ID NO: 8843 - DNA, 22 bp, synthetic construct
  misc_feature 1..22: note = Description of Artificial Sequence: Syntheticoligonucleotide
  source 1..22: mol_type = other DNA
gcgactctcatgagagtcgcag

SEQ ID NO: 8844 - DNA, 22 bp, synthetic construct
  misc_feature 1..22: note = Description of Artificial Sequence: Syntheticoligonucleotide
  source 1..22: mol_type = other DNA
gtgactctcatgagagtcaccg

SEQ ID NO: 8845 - DNA, 22 bp, synthetic construct
  misc_feature 1..22: note = Description of Artificial Sequence: Syntheticoligonucleotide
  source 1..22: mol_type = other DNA
cggactctcatgagagtccgtg

SEQ ID NO: 8846 - DNA, 22 bp, synthetic construct
  misc_feature 1..22: note = Description of Artificial Sequence: Syntheticoligonucleotide
  source 1..22: mol_type = other DNA
cagactctcatgagagtctggg

SEQ ID NO: 8847 - DNA, 22 bp, synthetic construct
  misc_feature 1..22: note = Description of Artificial Sequence: Syntheticoligonucleotide
  source 1..22: mol_type = other DNA
cggactctcatgagagtccgag

SEQ ID NO: 8848 - DNA, 22 bp, synthetic construct
  misc_feature 1..22: note = Description of Artificial Sequence: Syntheticoligonucleotide
  source 1..22: mol_type = other DNA
ctgactctcatgagagtcaggg

SEQ ID NO: 8849 - DNA, 22 bp, synthetic construct
  misc_feature 1..22: note = Description of Artificial Sequence: Syntheticoligonucleotide
  source 1..22: mol_type = other DNA
acgactctcatgagagtcgtgg

SEQ ID NO: 8850 - DNA, 22 bp, synthetic construct
  misc_feature 1..22: note = Description of Artificial Sequence: Syntheticoligonucleotide
  source 1..22: mol_type = other DNA
ccgactctcatgagagtcggct

SEQ ID NO: 8851 - DNA, 22 bp, synthetic construct
  misc_feature 1..22: note = Description of Artificial Sequence: Syntheticoligonucleotide
  source 1..22: mol_type = other DNA
ccgactctcatgagagtcggca

SEQ ID NO: 8852 - DNA, 22 bp, synthetic construct
  misc_feature 1..22: note = Description of Artificial Sequence: Syntheticoligonucleotide
  source 1..22: mol_type = other DNA
gagactctcatgagagtctcgc

SEQ ID NO: 8853 - DNA, 22 bp, synthetic construct
  misc_feature 1..22: note = Description of Artificial Sequence: Syntheticoligonucleotide
  source 1..22: mol_type = other DNA
gtgactctcatgagagtcacgc

SEQ ID NO: 8854 - DNA, 22 bp, synthetic construct
  misc_feature 1..22: note = Description of Artificial Sequence: Syntheticoligonucleotide
  source 1..22: mol_type = other DNA
aggactctcatgagagtcctgc

SEQ ID NO: 8855 - DNA, 22 bp, synthetic construct
  misc_feature 1..22: note = Description of Artificial Sequence: Syntheticoligonucleotide
  source 1..22: mol_type = other DNA
tggactctcatgagagtccagc

SEQ ID NO: 8856 - DNA, 22 bp, synthetic construct
  misc_feature 1..22: note = Description of Artificial Sequence: Syntheticoligonucleotide
  source 1..22: mol_type = other DNA
aggactctcatgagagtcctcg

SEQ ID NO: 8857 - DNA, 22 bp, synthetic construct
  misc_feature 1..22: note = Description of Artificial Sequence: Syntheticoligonucleotide
  source 1..22: mol_type = other DNA
tggactctcatgagagtccacg

SEQ ID NO: 8858 - DNA, 22 bp, synthetic construct
  misc_feature 1..22: note = Description of Artificial Sequence: Syntheticoligonucleotide
  source 1..22: mol_type = other DNA
ccgactctcatgagagtcggtg

SEQ ID NO: 8859 - DNA, 22 bp, synthetic construct
  misc_feature 1..22: note = Description of Artificial Sequence: Syntheticoligonucleotide
  source 1..22: mol_type = other DNA
ccgactctcatgagagtcggag

SEQ ID NO: 8860 - DNA, 22 bp, synthetic construct
  misc_feature 1..22: note = Description of Artificial Sequence: Syntheticoligonucleotide
  source 1..22: mol_type = other DNA
gggactctcatgagagtcccgc

SEQ ID NO: 8861 - DNA, 22 bp, synthetic construct
  misc_feature 1..22: note = Description of Artificial Sequence: Syntheticoligonucleotide
  source 1..22: mol_type = other DNA
gggactctcatgagagtccctc

SEQ ID NO: 8862 - DNA, 22 bp, synthetic construct
  misc_feature 1..22: note = Description of Artificial Sequence: Syntheticoligonucleotide
  source 1..22: mol_type = other DNA
gggactctcatgagagtcccac

SEQ ID NO: 8863 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactctctagagagtcnnnn

SEQ ID NO: 8864 - DNA, 22 bp, synthetic construct
  misc_feature 1..22: note = Description of Artificial Sequence: Syntheticoligonucleotide
  source 1..22: mol_type = other DNA
cggactctctagagagtccgcc

SEQ ID NO: 8865 - DNA, 22 bp, synthetic construct
  misc_feature 1..22: note = Description of Artificial Sequence: Syntheticoligonucleotide
  source 1..22: mol_type = other DNA
cggactctctagagagtccgct

SEQ ID NO: 8866 - DNA, 22 bp, synthetic construct
  misc_feature 1..22: note = Description of Artificial Sequence: Syntheticoligonucleotide
  source 1..22: mol_type = other DNA
cggactctctagagagtccgtc

SEQ ID NO: 8867 - DNA, 22 bp, synthetic construct
  misc_feature 1..22: note = Description of Artificial Sequence: Syntheticoligonucleotide
  source 1..22: mol_type = other DNA
aggactctctagagagtcctcc

SEQ ID NO: 8868 - DNA, 22 bp, synthetic construct
  misc_feature 1..22: note = Description of Artificial Sequence: Syntheticoligonucleotide
  source 1..22: mol_type = other DNA
cagactctctagagagtctgcc

SEQ ID NO: 8869 - DNA, 22 bp, synthetic construct
  misc_feature 1..22: note = Description of Artificial Sequence: Syntheticoligonucleotide
  source 1..22: mol_type = other DNA
cggactctctagagagtccgca

SEQ ID NO: 8870 - DNA, 22 bp, synthetic construct
  misc_feature 1..22: note = Description of Artificial Sequence: Syntheticoligonucleotide
  source 1..22: mol_type = other DNA
cggactctctagagagtccgac

SEQ ID NO: 8871 - DNA, 22 bp, synthetic construct
  misc_feature 1..22: note = Description of Artificial Sequence: Syntheticoligonucleotide
  source 1..22: mol_type = other DNA
tggactctctagagagtccacc

SEQ ID NO: 8872 - DNA, 22 bp, synthetic construct
  misc_feature 1..22: note = Description of Artificial Sequence: Syntheticoligonucleotide
  source 1..22: mol_type = other DNA
ctgactctctagagagtcagcc

SEQ ID NO: 8873 - DNA, 22 bp, synthetic construct
  misc_feature 1..22: note = Description of Artificial Sequence: Syntheticoligonucleotide
  source 1..22: mol_type = other DNA
ccgactctctagagagtcgggc

SEQ ID NO: 8874 - DNA, 22 bp, synthetic construct
  misc_feature 1..22: note = Description of Artificial Sequence: Syntheticoligonucleotide
  source 1..22: mol_type = other DNA
ccgactctctagagagtcgggt

SEQ ID NO: 8875 - DNA, 22 bp, synthetic construct
  misc_feature 1..22: note = Description of Artificial Sequence: Syntheticoligonucleotide
  source 1..22: mol_type = other DNA
ccgactctctagagagtcggtc

SEQ ID NO: 8876 - DNA, 22 bp, synthetic construct
  misc_feature 1..22: note = Description of Artificial Sequence: Syntheticoligonucleotide
  source 1..22: mol_type = other DNA
acgactctctagagagtcgtgc

SEQ ID NO: 8877 - DNA, 22 bp, synthetic construct
  misc_feature 1..22: note = Description of Artificial Sequence: Syntheticoligonucleotide
  source 1..22: mol_type = other DNA
cagactctctagagagtctggc

SEQ ID NO: 8878 - DNA, 22 bp, synthetic construct
  misc_feature 1..22: note = Description of Artificial Sequence: Syntheticoligonucleotide
  source 1..22: mol_type = other DNA
ccgactctctagagagtcggga

SEQ ID NO: 8879 - DNA, 22 bp, synthetic construct
  misc_feature 1..22: note = Description of Artificial Sequence: Syntheticoligonucleotide
  source 1..22: mol_type = other DNA
ccgactctctagagagtcggac

SEQ ID NO: 8880 - DNA, 22 bp, synthetic construct
  misc_feature 1..22: note = Description of Artificial Sequence: Syntheticoligonucleotide
  source 1..22: mol_type = other DNA
ctgactctctagagagtcaggc

SEQ ID NO: 8881 - DNA, 22 bp, synthetic construct
  misc_feature 1..22: note = Description of Artificial Sequence: Syntheticoligonucleotide
  source 1..22: mol_type = other DNA
gcgactctctagagagtcgccc

SEQ ID NO: 8882 - DNA, 22 bp, synthetic construct
  misc_feature 1..22: note = Description of Artificial Sequence: Syntheticoligonucleotide
  source 1..22: mol_type = other DNA
gcgactctctagagagtcgcct

SEQ ID NO: 8883 - DNA, 22 bp, synthetic construct
  misc_feature 1..22: note = Description of Artificial Sequence: Syntheticoligonucleotide
  source 1..22: mol_type = other DNA
gcgactctctagagagtcgctc

SEQ ID NO: 8884 - DNA, 22 bp, synthetic construct
  misc_feature 1..22: note = Description of Artificial Sequence: Syntheticoligonucleotide
  source 1..22: mol_type = other DNA
acgactctctagagagtcgtcc

SEQ ID NO: 8885 - DNA, 22 bp, synthetic construct
  misc_feature 1..22: note = Description of Artificial Sequence: Syntheticoligonucleotide
  source 1..22: mol_type = other DNA
gagactctctagagagtctccc

SEQ ID NO: 8886 - DNA, 22 bp, synthetic construct
  misc_feature 1..22: note = Description of Artificial Sequence: Syntheticoligonucleotide
  source 1..22: mol_type = other DNA
gcgactctctagagagtcgcca

SEQ ID NO: 8887 - DNA, 22 bp, synthetic construct
  misc_feature 1..22: note = Description of Artificial Sequence: Syntheticoligonucleotide
  source 1..22: mol_type = other DNA
gcgactctctagagagtcgcac

SEQ ID NO: 8888 - DNA, 22 bp, synthetic construct
  misc_feature 1..22: note = Description of Artificial Sequence: Syntheticoligonucleotide
  source 1..22: mol_type = other DNA
gtgactctctagagagtcaccc

SEQ ID NO: 8889 - DNA, 22 bp, synthetic construct
  misc_feature 1..22: note = Description of Artificial Sequence: Syntheticoligonucleotide
  source 1..22: mol_type = other DNA
gggactctctagagagtcccgt

SEQ ID NO: 8890 - DNA, 22 bp, synthetic construct
  misc_feature 1..22: note = Description of Artificial Sequence: Syntheticoligonucleotide
  source 1..22: mol_type = other DNA
gggactctctagagagtccctg

SEQ ID NO: 8891 - DNA, 22 bp, synthetic construct
  misc_feature 1..22: note = Description of Artificial Sequence: Syntheticoligonucleotide
  source 1..22: mol_type = other DNA
aggactctctagagagtcctgg

SEQ ID NO: 8892 - DNA, 22 bp, synthetic construct
  misc_feature 1..22: note = Description of Artificial Sequence: Syntheticoligonucleotide
  source 1..22: mol_type = other DNA
gagactctctagagagtctcgg

SEQ ID NO: 8893 - DNA, 22 bp, synthetic construct
  misc_feature 1..22: note = Description of Artificial Sequence: Syntheticoligonucleotide
  source 1..22: mol_type = other DNA
gggactctctagagagtcccga

SEQ ID NO: 8894 - DNA, 22 bp, synthetic construct
  misc_feature 1..22: note = Description of Artificial Sequence: Syntheticoligonucleotide
  source 1..22: mol_type = other DNA
gggactctctagagagtcccag

SEQ ID NO: 8895 - DNA, 22 bp, synthetic construct
  misc_feature 1..22: note = Description of Artificial Sequence: Syntheticoligonucleotide
  source 1..22: mol_type = other DNA
tggactctctagagagtccagg

SEQ ID NO: 8896 - DNA, 22 bp, synthetic construct
  misc_feature 1..22: note = Description of Artificial Sequence: Syntheticoligonucleotide
  source 1..22: mol_type = other DNA
gtgactctctagagagtcacgg

SEQ ID NO: 8897 - DNA, 22 bp, synthetic construct
  misc_feature 1..22: note = Description of Artificial Sequence: Syntheticoligonucleotide
  source 1..22: mol_type = other DNA
gcgactctctagagagtcgccg

SEQ ID NO: 8898 - DNA, 22 bp, synthetic construct
  misc_feature 1..22: note = Description of Artificial Sequence: Syntheticoligonucleotide
  source 1..22: mol_type = other DNA
gcgactctctagagagtcgctg

SEQ ID NO: 8899 - DNA, 22 bp, synthetic construct
  misc_feature 1..22: note = Description of Artificial Sequence: Syntheticoligonucleotide
  source 1..22: mol_type = other DNA
acgactctctagagagtcgtcg

SEQ ID NO: 8900 - DNA, 22 bp, synthetic construct
  misc_feature 1..22: note = Description of Artificial Sequence: Syntheticoligonucleotide
  source 1..22: mol_type = other DNA
gagactctctagagagtctccg

SEQ ID NO: 8901 - DNA, 22 bp, synthetic construct
  misc_feature 1..22: note = Description of Artificial Sequence: Syntheticoligonucleotide
  source 1..22: mol_type = other DNA
gcgactctctagagagtcgcag

SEQ ID NO: 8902 - DNA, 22 bp, synthetic construct
  misc_feature 1..22: note = Description of Artificial Sequence: Syntheticoligonucleotide
  source 1..22: mol_type = other DNA
gtgactctctagagagtcaccg

SEQ ID NO: 8903 - DNA, 22 bp, synthetic construct
  misc_feature 1..22: note = Description of Artificial Sequence: Syntheticoligonucleotide
  source 1..22: mol_type = other DNA
cggactctctagagagtccgtg

SEQ ID NO: 8904 - DNA, 22 bp, synthetic construct
  misc_feature 1..22: note = Description of Artificial Sequence: Syntheticoligonucleotide
  source 1..22: mol_type = other DNA
cagactctctagagagtctggg

SEQ ID NO: 8905 - DNA, 22 bp, synthetic construct
  misc_feature 1..22: note = Description of Artificial Sequence: Syntheticoligonucleotide
  source 1..22: mol_type = other DNA
cggactctctagagagtccgag

SEQ ID NO: 8906 - DNA, 22 bp, synthetic construct
  misc_feature 1..22: note = Description of Artificial Sequence: Syntheticoligonucleotide
  source 1..22: mol_type = other DNA
ctgactctctagagagtcaggg

SEQ ID NO: 8907 - DNA, 22 bp, synthetic construct
  misc_feature 1..22: note = Description of Artificial Sequence: Syntheticoligonucleotide
  source 1..22: mol_type = other DNA
acgactctctagagagtcgtgg

SEQ ID NO: 8908 - DNA, 22 bp, synthetic construct
  misc_feature 1..22: note = Description of Artificial Sequence: Syntheticoligonucleotide
  source 1..22: mol_type = other DNA
ccgactctctagagagtcggct

SEQ ID NO: 8909 - DNA, 22 bp, synthetic construct
  misc_feature 1..22: note = Description of Artificial Sequence: Syntheticoligonucleotide
  source 1..22: mol_type = other DNA
ccgactctctagagagtcggca

SEQ ID NO: 8910 - DNA, 22 bp, synthetic construct
  misc_feature 1..22: note = Description of Artificial Sequence: Syntheticoligonucleotide
  source 1..22: mol_type = other DNA
gagactctctagagagtctcgc

SEQ ID NO: 8911 - DNA, 22 bp, synthetic construct
  misc_feature 1..22: note = Description of Artificial Sequence: Syntheticoligonucleotide
  source 1..22: mol_type = other DNA
gtgactctctagagagtcacgc

SEQ ID NO: 8912 - DNA, 22 bp, synthetic construct
  misc_feature 1..22: note = Description of Artificial Sequence: Syntheticoligonucleotide
  source 1..22: mol_type = other DNA
aggactctctagagagtcctgc

SEQ ID NO: 8913 - DNA, 22 bp, synthetic construct
  misc_feature 1..22: note = Description of Artificial Sequence: Syntheticoligonucleotide
  source 1..22: mol_type = other DNA
tggactctctagagagtccagc

SEQ ID NO: 8914 - DNA, 22 bp, synthetic construct
  misc_feature 1..22: note = Description of Artificial Sequence: Syntheticoligonucleotide
  source 1..22: mol_type = other DNA
aggactctctagagagtcctcg

SEQ ID NO: 8915 - DNA, 22 bp, synthetic construct
  misc_feature 1..22: note = Description of Artificial Sequence: Syntheticoligonucleotide
  source 1..22: mol_type = other DNA
tggactctctagagagtccacg

SEQ ID NO: 8916 - DNA, 22 bp, synthetic construct
  misc_feature 1..22: note = Description of Artificial Sequence: Syntheticoligonucleotide
  source 1..22: mol_type = other DNA
ccgactctctagagagtcggtg

SEQ ID NO: 8917 - DNA, 22 bp, synthetic construct
  misc_feature 1..22: note = Description of Artificial Sequence: Syntheticoligonucleotide
  source 1..22: mol_type = other DNA
ccgactctctagagagtcggag

SEQ ID NO: 8918 - DNA, 22 bp, synthetic construct
  misc_feature 1..22: note = Description of Artificial Sequence: Syntheticoligonucleotide
  source 1..22: mol_type = other DNA
gggactctctagagagtcccgc

SEQ ID NO: 8919 - DNA, 22 bp, synthetic construct
  misc_feature 1..22: note = Description of Artificial Sequence: Syntheticoligonucleotide
  source 1..22: mol_type = other DNA
gggactctctagagagtccctc

SEQ ID NO: 8920 - DNA, 22 bp, synthetic construct
  misc_feature 1..22: note = Description of Artificial Sequence: Syntheticoligonucleotide
  source 1..22: mol_type = other DNA
gggactctctagagagtcccac

SEQ ID NO: 8921 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactctcgcgagagtcnnnn

SEQ ID NO: 8922 - DNA, 22 bp, synthetic construct
  misc_feature 1..22: note = Description of Artificial Sequence: Syntheticoligonucleotide
  source 1..22: mol_type = other DNA
cggactctcgcgagagtccgcc

SEQ ID NO: 8923 - DNA, 22 bp, synthetic construct
  misc_feature 1..22: note = Description of Artificial Sequence: Syntheticoligonucleotide
  source 1..22: mol_type = other DNA
cggactctcgcgagagtccgct

SEQ ID NO: 8924 - DNA, 22 bp, synthetic construct
  misc_feature 1..22: note = Description of Artificial Sequence: Syntheticoligonucleotide
  source 1..22: mol_type = other DNA
cggactctcgcgagagtccgtc

SEQ ID NO: 8925 - DNA, 22 bp, synthetic construct
  misc_feature 1..22: note = Description of Artificial Sequence: Syntheticoligonucleotide
  source 1..22: mol_type = other DNA
aggactctcgcgagagtcctcc

SEQ ID NO: 8926 - DNA, 22 bp, synthetic construct
  misc_feature 1..22: note = Description of Artificial Sequence: Syntheticoligonucleotide
  source 1..22: mol_type = other DNA
cagactctcgcgagagtctgcc

SEQ ID NO: 8927 - DNA, 22 bp, synthetic construct
  misc_feature 1..22: note = Description of Artificial Sequence: Syntheticoligonucleotide
  source 1..22: mol_type = other DNA
cggactctcgcgagagtccgca

SEQ ID NO: 8928 - DNA, 22 bp, synthetic construct
  misc_feature 1..22: note = Description of Artificial Sequence: Syntheticoligonucleotide
  source 1..22: mol_type = other DNA
cggactctcgcgagagtccgac

SEQ ID NO: 8929 - DNA, 22 bp, synthetic construct
  misc_feature 1..22: note = Description of Artificial Sequence: Syntheticoligonucleotide
  source 1..22: mol_type = other DNA
tggactctcgcgagagtccacc

SEQ ID NO: 8930 - DNA, 22 bp, synthetic construct
  misc_feature 1..22: note = Description of Artificial Sequence: Syntheticoligonucleotide
  source 1..22: mol_type = other DNA
ctgactctcgcgagagtcagcc

SEQ ID NO: 8931 - DNA, 22 bp, synthetic construct
  misc_feature 1..22: note = Description of Artificial Sequence: Syntheticoligonucleotide
  source 1..22: mol_type = other DNA
ccgactctcgcgagagtcgggc

SEQ ID NO: 8932 - DNA, 22 bp, synthetic construct
  misc_feature 1..22: note = Description of Artificial Sequence: Syntheticoligonucleotide
  source 1..22: mol_type = other DNA
ccgactctcgcgagagtcgggt

SEQ ID NO: 8933 - DNA, 22 bp, synthetic construct
  misc_feature 1..22: note = Description of Artificial Sequence: Syntheticoligonucleotide
  source 1..22: mol_type = other DNA
ccgactctcgcgagagtcggtc

SEQ ID NO: 8934 - DNA, 22 bp, synthetic construct
  misc_feature 1..22: note = Description of Artificial Sequence: Syntheticoligonucleotide
  source 1..22: mol_type = other DNA
acgactctcgcgagagtcgtgc

SEQ ID NO: 8935 - DNA, 22 bp, synthetic construct
  misc_feature 1..22: note = Description of Artificial Sequence: Syntheticoligonucleotide
  source 1..22: mol_type = other DNA
cagactctcgcgagagtctggc

SEQ ID NO: 8936 - DNA, 22 bp, synthetic construct
  misc_feature 1..22: note = Description of Artificial Sequence: Syntheticoligonucleotide
  source 1..22: mol_type = other DNA
ccgactctcgcgagagtcggga

SEQ ID NO: 8937 - DNA, 22 bp, synthetic construct
  misc_feature 1..22: note = Description of Artificial Sequence: Syntheticoligonucleotide
  source 1..22: mol_type = other DNA
ccgactctcgcgagagtcggac

SEQ ID NO: 8938 - DNA, 22 bp, synthetic construct
  misc_feature 1..22: note = Description of Artificial Sequence: Syntheticoligonucleotide
  source 1..22: mol_type = other DNA
ctgactctcgcgagagtcaggc

SEQ ID NO: 8939 - DNA, 22 bp, synthetic construct
  misc_feature 1..22: note = Description of Artificial Sequence: Syntheticoligonucleotide
  source 1..22: mol_type = other DNA
gcgactctcgcgagagtcgccc

SEQ ID NO: 8940 - DNA, 22 bp, synthetic construct
  misc_feature 1..22: note = Description of Artificial Sequence: Syntheticoligonucleotide
  source 1..22: mol_type = other DNA
gcgactctcgcgagagtcgcct

SEQ ID NO: 8941 - DNA, 22 bp, synthetic construct
  misc_feature 1..22: note = Description of Artificial Sequence: Syntheticoligonucleotide
  source 1..22: mol_type = other DNA
gcgactctcgcgagagtcgctc

SEQ ID NO: 8942 - DNA, 22 bp, synthetic construct
  misc_feature 1..22: note = Description of Artificial Sequence: Syntheticoligonucleotide
  source 1..22: mol_type = other DNA
acgactctcgcgagagtcgtcc

SEQ ID NO: 8943 - DNA, 22 bp, synthetic construct
  misc_feature 1..22: note = Description of Artificial Sequence: Syntheticoligonucleotide
  source 1..22: mol_type = other DNA
gagactctcgcgagagtctccc

SEQ ID NO: 8944 - DNA, 22 bp, synthetic construct
  misc_feature 1..22: note = Description of Artificial Sequence: Syntheticoligonucleotide
  source 1..22: mol_type = other DNA
gcgactctcgcgagagtcgcca

SEQ ID NO: 8945 - DNA, 22 bp, synthetic construct
  misc_feature 1..22: note = Description of Artificial Sequence: Syntheticoligonucleotide
  source 1..22: mol_type = other DNA
gcgactctcgcgagagtcgcac

SEQ ID NO: 8946 - DNA, 22 bp, synthetic construct
  misc_feature 1..22: note = Description of Artificial Sequence: Syntheticoligonucleotide
  source 1..22: mol_type = other DNA
gtgactctcgcgagagtcaccc

SEQ ID NO: 8947 - DNA, 22 bp, synthetic construct
  misc_feature 1..22: note = Description of Artificial Sequence: Syntheticoligonucleotide
  source 1..22: mol_type = other DNA
gggactctcgcgagagtcccgt

SEQ ID NO: 8948 - DNA, 22 bp, synthetic construct
  misc_feature 1..22: note = Description of Artificial Sequence: Syntheticoligonucleotide
  source 1..22: mol_type = other DNA
gggactctcgcgagagtccctg

SEQ ID NO: 8949 - DNA, 22 bp, synthetic construct
  misc_feature 1..22: note = Description of Artificial Sequence: Syntheticoligonucleotide
  source 1..22: mol_type = other DNA
aggactctcgcgagagtcctgg

SEQ ID NO: 8950 - DNA, 22 bp, synthetic construct
  misc_feature 1..22: note = Description of Artificial Sequence: Syntheticoligonucleotide
  source 1..22: mol_type = other DNA
gagactctcgcgagagtctcgg

SEQ ID NO: 8951 - DNA, 22 bp, synthetic construct
  misc_feature 1..22: note = Description of Artificial Sequence: Syntheticoligonucleotide
  source 1..22: mol_type = other DNA
gggactctcgcgagagtcccga

SEQ ID NO: 8952 - DNA, 22 bp, synthetic construct
  misc_feature 1..22: note = Description of Artificial Sequence: Syntheticoligonucleotide
  source 1..22: mol_type = other DNA
gggactctcgcgagagtcccag

SEQ ID NO: 8953 - DNA, 22 bp, synthetic construct
  misc_feature 1..22: note = Description of Artificial Sequence: Syntheticoligonucleotide
  source 1..22: mol_type = other DNA
tggactctcgcgagagtccagg

SEQ ID NO: 8954 - DNA, 22 bp, synthetic construct
  misc_feature 1..22: note = Description of Artificial Sequence: Syntheticoligonucleotide
  source 1..22: mol_type = other DNA
gtgactctcgcgagagtcacgg

SEQ ID NO: 8955 - DNA, 22 bp, synthetic construct
  misc_feature 1..22: note = Description of Artificial Sequence: Syntheticoligonucleotide
  source 1..22: mol_type = other DNA
gcgactctcgcgagagtcgccg

SEQ ID NO: 8956 - DNA, 22 bp, synthetic construct
  misc_feature 1..22: note = Description of Artificial Sequence: Syntheticoligonucleotide
  source 1..22: mol_type = other DNA
gcgactctcgcgagagtcgctg

SEQ ID NO: 8957 - DNA, 22 bp, synthetic construct
  misc_feature 1..22: note = Description of Artificial Sequence: Syntheticoligonucleotide
  source 1..22: mol_type = other DNA
acgactctcgcgagagtcgtcg

SEQ ID NO: 8958 - DNA, 22 bp, synthetic construct
  misc_feature 1..22: note = Description of Artificial Sequence: Syntheticoligonucleotide
  source 1..22: mol_type = other DNA
gagactctcgcgagagtctccg

SEQ ID NO: 8959 - DNA, 22 bp, synthetic construct
  misc_feature 1..22: note = Description of Artificial Sequence: Syntheticoligonucleotide
  source 1..22: mol_type = other DNA
gcgactctcgcgagagtcgcag

SEQ ID NO: 8960 - DNA, 22 bp, synthetic construct
  misc_feature 1..22: note = Description of Artificial Sequence: Syntheticoligonucleotide
  source 1..22: mol_type = other DNA
gtgactctcgcgagagtcaccg

SEQ ID NO: 8961 - DNA, 22 bp, synthetic construct
  misc_feature 1..22: note = Description of Artificial Sequence: Syntheticoligonucleotide
  source 1..22: mol_type = other DNA
cggactctcgcgagagtccgtg

SEQ ID NO: 8962 - DNA, 22 bp, synthetic construct
  misc_feature 1..22: note = Description of Artificial Sequence: Syntheticoligonucleotide
  source 1..22: mol_type = other DNA
cagactctcgcgagagtctggg

SEQ ID NO: 8963 - DNA, 22 bp, synthetic construct
  misc_feature 1..22: note = Description of Artificial Sequence: Syntheticoligonucleotide
  source 1..22: mol_type = other DNA
cggactctcgcgagagtccgag

SEQ ID NO: 8964 - DNA, 22 bp, synthetic construct
  misc_feature 1..22: note = Description of Artificial Sequence: Syntheticoligonucleotide
  source 1..22: mol_type = other DNA
ctgactctcgcgagagtcaggg

SEQ ID NO: 8965 - DNA, 22 bp, synthetic construct
  misc_feature 1..22: note = Description of Artificial Sequence: Syntheticoligonucleotide
  source 1..22: mol_type = other DNA
acgactctcgcgagagtcgtgg

SEQ ID NO: 8966 - DNA, 22 bp, synthetic construct
  misc_feature 1..22: note = Description of Artificial Sequence: Syntheticoligonucleotide
  source 1..22: mol_type = other DNA
ccgactctcgcgagagtcggct

SEQ ID NO: 8967 - DNA, 22 bp, synthetic construct
  misc_feature 1..22: note = Description of Artificial Sequence: Syntheticoligonucleotide
  source 1..22: mol_type = other DNA
ccgactctcgcgagagtcggca

SEQ ID NO: 8968 - DNA, 22 bp, synthetic construct
  misc_feature 1..22: note = Description of Artificial Sequence: Syntheticoligonucleotide
  source 1..22: mol_type = other DNA
gagactctcgcgagagtctcgc

SEQ ID NO: 8969 - DNA, 22 bp, synthetic construct
  misc_feature 1..22: note = Description of Artificial Sequence: Syntheticoligonucleotide
  source 1..22: mol_type = other DNA
gtgactctcgcgagagtcacgc

SEQ ID NO: 8970 - DNA, 22 bp, synthetic construct
  misc_feature 1..22: note = Description of Artificial Sequence: Syntheticoligonucleotide
  source 1..22: mol_type = other DNA
aggactctcgcgagagtcctgc

SEQ ID NO: 8971 - DNA, 22 bp, synthetic construct
  misc_feature 1..22: note = Description of Artificial Sequence: Syntheticoligonucleotide
  source 1..22: mol_type = other DNA
tggactctcgcgagagtccagc

SEQ ID NO: 8972 - DNA, 22 bp, synthetic construct
  misc_feature 1..22: note = Description of Artificial Sequence: Syntheticoligonucleotide
  source 1..22: mol_type = other DNA
aggactctcgcgagagtcctcg

SEQ ID NO: 8973 - DNA, 22 bp, synthetic construct
  misc_feature 1..22: note = Description of Artificial Sequence: Syntheticoligonucleotide
  source 1..22: mol_type = other DNA
tggactctcgcgagagtccacg

SEQ ID NO: 8974 - DNA, 22 bp, synthetic construct
  misc_feature 1..22: note = Description of Artificial Sequence: Syntheticoligonucleotide
  source 1..22: mol_type = other DNA
ccgactctcgcgagagtcggtg

SEQ ID NO: 8975 - DNA, 22 bp, synthetic construct
  misc_feature 1..22: note = Description of Artificial Sequence: Syntheticoligonucleotide
  source 1..22: mol_type = other DNA
ccgactctcgcgagagtcggag

SEQ ID NO: 8976 - DNA, 22 bp, synthetic construct
  misc_feature 1..22: note = Description of Artificial Sequence: Syntheticoligonucleotide
  source 1..22: mol_type = other DNA
gggactctcgcgagagtcccgc

SEQ ID NO: 8977 - DNA, 22 bp, synthetic construct
  misc_feature 1..22: note = Description of Artificial Sequence: Syntheticoligonucleotide
  source 1..22: mol_type = other DNA
gggactctcgcgagagtccctc

SEQ ID NO: 8978 - DNA, 22 bp, synthetic construct
  misc_feature 1..22: note = Description of Artificial Sequence: Syntheticoligonucleotide
  source 1..22: mol_type = other DNA
gggactctcgcgagagtcccac

SEQ ID NO: 8979 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactctccggagagtcnnnn

SEQ ID NO: 8980 - DNA, 22 bp, synthetic construct
  misc_feature 1..22: note = Description of Artificial Sequence: Syntheticoligonucleotide
  source 1..22: mol_type = other DNA
cggactctccggagagtccgcc

SEQ ID NO: 8981 - DNA, 22 bp, synthetic construct
  misc_feature 1..22: note = Description of Artificial Sequence: Syntheticoligonucleotide
  source 1..22: mol_type = other DNA
cggactctccggagagtccgct

SEQ ID NO: 8982 - DNA, 22 bp, synthetic construct
  misc_feature 1..22: note = Description of Artificial Sequence: Syntheticoligonucleotide
  source 1..22: mol_type = other DNA
cggactctccggagagtccgtc

SEQ ID NO: 8983 - DNA, 22 bp, synthetic construct
  misc_feature 1..22: note = Description of Artificial Sequence: Syntheticoligonucleotide
  source 1..22: mol_type = other DNA
aggactctccggagagtcctcc

SEQ ID NO: 8984 - DNA, 22 bp, synthetic construct
  misc_feature 1..22: note = Description of Artificial Sequence: Syntheticoligonucleotide
  source 1..22: mol_type = other DNA
cagactctccggagagtctgcc

SEQ ID NO: 8985 - DNA, 22 bp, synthetic construct
  misc_feature 1..22: note = Description of Artificial Sequence: Syntheticoligonucleotide
  source 1..22: mol_type = other DNA
cggactctccggagagtccgca

SEQ ID NO: 8986 - DNA, 22 bp, synthetic construct
  misc_feature 1..22: note = Description of Artificial Sequence: Syntheticoligonucleotide
  source 1..22: mol_type = other DNA
cggactctccggagagtccgac

SEQ ID NO: 8987 - DNA, 22 bp, synthetic construct
  misc_feature 1..22: note = Description of Artificial Sequence: Syntheticoligonucleotide
  source 1..22: mol_type = other DNA
tggactctccggagagtccacc

SEQ ID NO: 8988 - DNA, 22 bp, synthetic construct
  misc_feature 1..22: note = Description of Artificial Sequence: Syntheticoligonucleotide
  source 1..22: mol_type = other DNA
ctgactctccggagagtcagcc

SEQ ID NO: 8989 - DNA, 22 bp, synthetic construct
  misc_feature 1..22: note = Description of Artificial Sequence: Syntheticoligonucleotide
  source 1..22: mol_type = other DNA
ccgactctccggagagtcgggc

SEQ ID NO: 8990 - DNA, 22 bp, synthetic construct
  misc_feature 1..22: note = Description of Artificial Sequence: Syntheticoligonucleotide
  source 1..22: mol_type = other DNA
ccgactctccggagagtcgggt

SEQ ID NO: 8991 - DNA, 22 bp, synthetic construct
  misc_feature 1..22: note = Description of Artificial Sequence: Syntheticoligonucleotide
  source 1..22: mol_type = other DNA
ccgactctccggagagtcggtc

SEQ ID NO: 8992 - DNA, 22 bp, synthetic construct
  misc_feature 1..22: note = Description of Artificial Sequence: Syntheticoligonucleotide
  source 1..22: mol_type = other DNA
acgactctccggagagtcgtgc

SEQ ID NO: 8993 - DNA, 22 bp, synthetic construct
  misc_feature 1..22: note = Description of Artificial Sequence: Syntheticoligonucleotide
  source 1..22: mol_type = other DNA
cagactctccggagagtctggc

SEQ ID NO: 8994 - DNA, 22 bp, synthetic construct
  misc_feature 1..22: note = Description of Artificial Sequence: Syntheticoligonucleotide
  source 1..22: mol_type = other DNA
ccgactctccggagagtcggga

SEQ ID NO: 8995 - DNA, 22 bp, synthetic construct
  misc_feature 1..22: note = Description of Artificial Sequence: Syntheticoligonucleotide
  source 1..22: mol_type = other DNA
ccgactctccggagagtcggac

SEQ ID NO: 8996 - DNA, 22 bp, synthetic construct
  misc_feature 1..22: note = Description of Artificial Sequence: Syntheticoligonucleotide
  source 1..22: mol_type = other DNA
ctgactctccggagagtcaggc

SEQ ID NO: 8997 - DNA, 22 bp, synthetic construct
  misc_feature 1..22: note = Description of Artificial Sequence: Syntheticoligonucleotide
  source 1..22: mol_type = other DNA
gcgactctccggagagtcgccc

SEQ ID NO: 8998 - DNA, 22 bp, synthetic construct
  misc_feature 1..22: note = Description of Artificial Sequence: Syntheticoligonucleotide
  source 1..22: mol_type = other DNA
gcgactctccggagagtcgcct

SEQ ID NO: 8999 - DNA, 22 bp, synthetic construct
  misc_feature 1..22: note = Description of Artificial Sequence: Syntheticoligonucleotide
  source 1..22: mol_type = other DNA
gcgactctccggagagtcgctc

SEQ ID NO: 9000 - DNA, 22 bp, synthetic construct
  misc_feature 1..22: note = Description of Artificial Sequence: Syntheticoligonucleotide
  source 1..22: mol_type = other DNA
acgactctccggagagtcgtcc

SEQ ID NO: 9001 - DNA, 22 bp, synthetic construct
  misc_feature 1..22: note = Description of Artificial Sequence: Syntheticoligonucleotide
  source 1..22: mol_type = other DNA
gagactctccggagagtctccc

SEQ ID NO: 9002 - DNA, 22 bp, synthetic construct
  misc_feature 1..22: note = Description of Artificial Sequence: Syntheticoligonucleotide
  source 1..22: mol_type = other DNA
gcgactctccggagagtcgcca

SEQ ID NO: 9003 - DNA, 22 bp, synthetic construct
  misc_feature 1..22: note = Description of Artificial Sequence: Syntheticoligonucleotide
  source 1..22: mol_type = other DNA
gcgactctccggagagtcgcac

SEQ ID NO: 9004 - DNA, 22 bp, synthetic construct
  misc_feature 1..22: note = Description of Artificial Sequence: Syntheticoligonucleotide
  source 1..22: mol_type = other DNA
gtgactctccggagagtcaccc

SEQ ID NO: 9005 - DNA, 22 bp, synthetic construct
  misc_feature 1..22: note = Description of Artificial Sequence: Syntheticoligonucleotide
  source 1..22: mol_type = other DNA
gggactctccggagagtcccgt

SEQ ID NO: 9006 - DNA, 22 bp, synthetic construct
  misc_feature 1..22: note = Description of Artificial Sequence: Syntheticoligonucleotide
  source 1..22: mol_type = other DNA
gggactctccggagagtccctg

SEQ ID NO: 9007 - DNA, 22 bp, synthetic construct
  misc_feature 1..22: note = Description of Artificial Sequence: Syntheticoligonucleotide
  source 1..22: mol_type = other DNA
aggactctccggagagtcctgg

SEQ ID NO: 9008 - DNA, 22 bp, synthetic construct
  misc_feature 1..22: note = Description of Artificial Sequence: Syntheticoligonucleotide
  source 1..22: mol_type = other DNA
gagactctccggagagtctcgg

SEQ ID NO: 9009 - DNA, 22 bp, synthetic construct
  misc_feature 1..22: note = Description of Artificial Sequence: Syntheticoligonucleotide
  source 1..22: mol_type = other DNA
gggactctccggagagtcccga

SEQ ID NO: 9010 - DNA, 22 bp, synthetic construct
  misc_feature 1..22: note = Description of Artificial Sequence: Syntheticoligonucleotide
  source 1..22: mol_type = other DNA
gggactctccggagagtcccag

SEQ ID NO: 9011 - DNA, 22 bp, synthetic construct
  misc_feature 1..22: note = Description of Artificial Sequence: Syntheticoligonucleotide
  source 1..22: mol_type = other DNA
tggactctccggagagtccagg

SEQ ID NO: 9012 - DNA, 22 bp, synthetic construct
  misc_feature 1..22: note = Description of Artificial Sequence: Syntheticoligonucleotide
  source 1..22: mol_type = other DNA
gtgactctccggagagtcacgg

SEQ ID NO: 9013 - DNA, 22 bp, synthetic construct
  misc_feature 1..22: note = Description of Artificial Sequence: Syntheticoligonucleotide
  source 1..22: mol_type = other DNA
gcgactctccggagagtcgccg

SEQ ID NO: 9014 - DNA, 22 bp, synthetic construct
  misc_feature 1..22: note = Description of Artificial Sequence: Syntheticoligonucleotide
  source 1..22: mol_type = other DNA
gcgactctccggagagtcgctg

SEQ ID NO: 9015 - DNA, 22 bp, synthetic construct
  misc_feature 1..22: note = Description of Artificial Sequence: Syntheticoligonucleotide
  source 1..22: mol_type = other DNA
acgactctccggagagtcgtcg

SEQ ID NO: 9016 - DNA, 22 bp, synthetic construct
  misc_feature 1..22: note = Description of Artificial Sequence: Syntheticoligonucleotide
  source 1..22: mol_type = other DNA
gagactctccggagagtctccg

SEQ ID NO: 9017 - DNA, 22 bp, synthetic construct
  misc_feature 1..22: note = Description of Artificial Sequence: Syntheticoligonucleotide
  source 1..22: mol_type = other DNA
gcgactctccggagagtcgcag

SEQ ID NO: 9018 - DNA, 22 bp, synthetic construct
  misc_feature 1..22: note = Description of Artificial Sequence: Syntheticoligonucleotide
  source 1..22: mol_type = other DNA
gtgactctccggagagtcaccg

SEQ ID NO: 9019 - DNA, 22 bp, synthetic construct
  misc_feature 1..22: note = Description of Artificial Sequence: Syntheticoligonucleotide
  source 1..22: mol_type = other DNA
cggactctccggagagtccgtg

SEQ ID NO: 9020 - DNA, 22 bp, synthetic construct
  misc_feature 1..22: note = Description of Artificial Sequence: Syntheticoligonucleotide
  source 1..22: mol_type = other DNA
cagactctccggagagtctggg

SEQ ID NO: 9021 - DNA, 22 bp, synthetic construct
  misc_feature 1..22: note = Description of Artificial Sequence: Syntheticoligonucleotide
  source 1..22: mol_type = other DNA
cggactctccggagagtccgag

SEQ ID NO: 9022 - DNA, 22 bp, synthetic construct
  misc_feature 1..22: note = Description of Artificial Sequence: Syntheticoligonucleotide
  source 1..22: mol_type = other DNA
ctgactctccggagagtcaggg

SEQ ID NO: 9023 - DNA, 22 bp, synthetic construct
  misc_feature 1..22: note = Description of Artificial Sequence: Syntheticoligonucleotide
  source 1..22: mol_type = other DNA
acgactctccggagagtcgtgg

SEQ ID NO: 9024 - DNA, 22 bp, synthetic construct
  misc_feature 1..22: note = Description of Artificial Sequence: Syntheticoligonucleotide
  source 1..22: mol_type = other DNA
ccgactctccggagagtcggct

SEQ ID NO: 9025 - DNA, 22 bp, synthetic construct
  misc_feature 1..22: note = Description of Artificial Sequence: Syntheticoligonucleotide
  source 1..22: mol_type = other DNA
ccgactctccggagagtcggca

SEQ ID NO: 9026 - DNA, 22 bp, synthetic construct
  misc_feature 1..22: note = Description of Artificial Sequence: Syntheticoligonucleotide
  source 1..22: mol_type = other DNA
gagactctccggagagtctcgc

SEQ ID NO: 9027 - DNA, 22 bp, synthetic construct
  misc_feature 1..22: note = Description of Artificial Sequence: Syntheticoligonucleotide
  source 1..22: mol_type = other DNA
gtgactctccggagagtcacgc

SEQ ID NO: 9028 - DNA, 22 bp, synthetic construct
  misc_feature 1..22: note = Description of Artificial Sequence: Syntheticoligonucleotide
  source 1..22: mol_type = other DNA
aggactctccggagagtcctgc

SEQ ID NO: 9029 - DNA, 22 bp, synthetic construct
  misc_feature 1..22: note = Description of Artificial Sequence: Syntheticoligonucleotide
  source 1..22: mol_type = other DNA
tggactctccggagagtccagc

SEQ ID NO: 9030 - DNA, 22 bp, synthetic construct
  misc_feature 1..22: note = Description of Artificial Sequence: Syntheticoligonucleotide
  source 1..22: mol_type = other DNA
aggactctccggagagtcctcg

SEQ ID NO: 9031 - DNA, 22 bp, synthetic construct
  misc_feature 1..22: note = Description of Artificial Sequence: Syntheticoligonucleotide
  source 1..22: mol_type = other DNA
tggactctccggagagtccacg

SEQ ID NO: 9032 - DNA, 22 bp, synthetic construct
  misc_feature 1..22: note = Description of Artificial Sequence: Syntheticoligonucleotide
  source 1..22: mol_type = other DNA
ccgactctccggagagtcggtg

SEQ ID NO: 9033 - DNA, 22 bp, synthetic construct
  misc_feature 1..22: note = Description of Artificial Sequence: Syntheticoligonucleotide
  source 1..22: mol_type = other DNA
ccgactctccggagagtcggag

SEQ ID NO: 9034 - DNA, 22 bp, synthetic construct
  misc_feature 1..22: note = Description of Artificial Sequence: Syntheticoligonucleotide
  source 1..22: mol_type = other DNA
gggactctccggagagtcccgc

SEQ ID NO: 9035 - DNA, 22 bp, synthetic construct
  misc_feature 1..22: note = Description of Artificial Sequence: Syntheticoligonucleotide
  source 1..22: mol_type = other DNA
gggactctccggagagtccctc

SEQ ID NO: 9036 - DNA, 22 bp, synthetic construct
  misc_feature 1..22: note = Description of Artificial Sequence: Syntheticoligonucleotide
  source 1..22: mol_type = other DNA
gggactctccggagagtcccac

SEQ ID NO: 9037 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcagatctgagtcnnnn

SEQ ID NO: 9038 - DNA, 22 bp, synthetic construct
  misc_feature 1..22: note = Description of Artificial Sequence: Syntheticoligonucleotide
  source 1..22: mol_type = other DNA
cggactcagatctgagtccgcc

SEQ ID NO: 9039 - DNA, 22 bp, synthetic construct
  misc_feature 1..22: note = Description of Artificial Sequence: Syntheticoligonucleotide
  source 1..22: mol_type = other DNA
cggactcagatctgagtccgct

SEQ ID NO: 9040 - DNA, 22 bp, synthetic construct
  misc_feature 1..22: note = Description of Artificial Sequence: Syntheticoligonucleotide
  source 1..22: mol_type = other DNA
cggactcagatctgagtccgtc

SEQ ID NO: 9041 - DNA, 22 bp, synthetic construct
  misc_feature 1..22: note = Description of Artificial Sequence: Syntheticoligonucleotide
  source 1..22: mol_type = other DNA
aggactcagatctgagtcctcc

SEQ ID NO: 9042 - DNA, 22 bp, synthetic construct
  misc_feature 1..22: note = Description of Artificial Sequence: Syntheticoligonucleotide
  source 1..22: mol_type = other DNA
cagactcagatctgagtctgcc

SEQ ID NO: 9043 - DNA, 22 bp, synthetic construct
  misc_feature 1..22: note = Description of Artificial Sequence: Syntheticoligonucleotide
  source 1..22: mol_type = other DNA
cggactcagatctgagtccgca

SEQ ID NO: 9044 - DNA, 22 bp, synthetic construct
  misc_feature 1..22: note = Description of Artificial Sequence: Syntheticoligonucleotide
  source 1..22: mol_type = other DNA
cggactcagatctgagtccgac

SEQ ID NO: 9045 - DNA, 22 bp, synthetic construct
  misc_feature 1..22: note = Description of Artificial Sequence: Syntheticoligonucleotide
  source 1..22: mol_type = other DNA
tggactcagatctgagtccacc

SEQ ID NO: 9046 - DNA, 22 bp, synthetic construct
  misc_feature 1..22: note = Description of Artificial Sequence: Syntheticoligonucleotide
  source 1..22: mol_type = other DNA
ctgactcagatctgagtcagcc

SEQ ID NO: 9047 - DNA, 22 bp, synthetic construct
  misc_feature 1..22: note = Description of Artificial Sequence: Syntheticoligonucleotide
  source 1..22: mol_type = other DNA
ccgactcagatctgagtcgggc

SEQ ID NO: 9048 - DNA, 22 bp, synthetic construct
  misc_feature 1..22: note = Description of Artificial Sequence: Syntheticoligonucleotide
  source 1..22: mol_type = other DNA
ccgactcagatctgagtcgggt

SEQ ID NO: 9049 - DNA, 22 bp, synthetic construct
  misc_feature 1..22: note = Description of Artificial Sequence: Syntheticoligonucleotide
  source 1..22: mol_type = other DNA
ccgactcagatctgagtcggtc

SEQ ID NO: 9050 - DNA, 22 bp, synthetic construct
  misc_feature 1..22: note = Description of Artificial Sequence: Syntheticoligonucleotide
  source 1..22: mol_type = other DNA
acgactcagatctgagtcgtgc

SEQ ID NO: 9051 - DNA, 22 bp, synthetic construct
  misc_feature 1..22: note = Description of Artificial Sequence: Syntheticoligonucleotide
  source 1..22: mol_type = other DNA
cagactcagatctgagtctggc

SEQ ID NO: 9052 - DNA, 22 bp, synthetic construct
  misc_feature 1..22: note = Description of Artificial Sequence: Syntheticoligonucleotide
  source 1..22: mol_type = other DNA
ccgactcagatctgagtcggga

SEQ ID NO: 9053 - DNA, 22 bp, synthetic construct
  misc_feature 1..22: note = Description of Artificial Sequence: Syntheticoligonucleotide
  source 1..22: mol_type = other DNA
ccgactcagatctgagtcggac

SEQ ID NO: 9054 - DNA, 22 bp, synthetic construct
  misc_feature 1..22: note = Description of Artificial Sequence: Syntheticoligonucleotide
  source 1..22: mol_type = other DNA
ctgactcagatctgagtcaggc

SEQ ID NO: 9055 - DNA, 22 bp, synthetic construct
  misc_feature 1..22: note = Description of Artificial Sequence: Syntheticoligonucleotide
  source 1..22: mol_type = other DNA
gcgactcagatctgagtcgccc

SEQ ID NO: 9056 - DNA, 22 bp, synthetic construct
  misc_feature 1..22: note = Description of Artificial Sequence: Syntheticoligonucleotide
  source 1..22: mol_type = other DNA
gcgactcagatctgagtcgcct

SEQ ID NO: 9057 - DNA, 22 bp, synthetic construct
  misc_feature 1..22: note = Description of Artificial Sequence: Syntheticoligonucleotide
  source 1..22: mol_type = other DNA
gcgactcagatctgagtcgctc

SEQ ID NO: 9058 - DNA, 22 bp, synthetic construct
  misc_feature 1..22: note = Description of Artificial Sequence: Syntheticoligonucleotide
  source 1..22: mol_type = other DNA
acgactcagatctgagtcgtcc

SEQ ID NO: 9059 - DNA, 22 bp, synthetic construct
  misc_feature 1..22: note = Description of Artificial Sequence: Syntheticoligonucleotide
  source 1..22: mol_type = other DNA
gagactcagatctgagtctccc

SEQ ID NO: 9060 - DNA, 22 bp, synthetic construct
  misc_feature 1..22: note = Description of Artificial Sequence: Syntheticoligonucleotide
  source 1..22: mol_type = other DNA
gcgactcagatctgagtcgcca

SEQ ID NO: 9061 - DNA, 22 bp, synthetic construct
  misc_feature 1..22: note = Description of Artificial Sequence: Syntheticoligonucleotide
  source 1..22: mol_type = other DNA
gcgactcagatctgagtcgcac

SEQ ID NO: 9062 - DNA, 22 bp, synthetic construct
  misc_feature 1..22: note = Description of Artificial Sequence: Syntheticoligonucleotide
  source 1..22: mol_type = other DNA
gtgactcagatctgagtcaccc

SEQ ID NO: 9063 - DNA, 22 bp, synthetic construct
  misc_feature 1..22: note = Description of Artificial Sequence: Syntheticoligonucleotide
  source 1..22: mol_type = other DNA
gggactcagatctgagtcccgt

SEQ ID NO: 9064 - DNA, 22 bp, synthetic construct
  misc_feature 1..22: note = Description of Artificial Sequence: Syntheticoligonucleotide
  source 1..22: mol_type = other DNA
gggactcagatctgagtccctg

SEQ ID NO: 9065 - DNA, 22 bp, synthetic construct
  misc_feature 1..22: note = Description of Artificial Sequence: Syntheticoligonucleotide
  source 1..22: mol_type = other DNA
aggactcagatctgagtcctgg

SEQ ID NO: 9066 - DNA, 22 bp, synthetic construct
  misc_feature 1..22: note = Description of Artificial Sequence: Syntheticoligonucleotide
  source 1..22: mol_type = other DNA
gagactcagatctgagtctcgg

SEQ ID NO: 9067 - DNA, 22 bp, synthetic construct
  misc_feature 1..22: note = Description of Artificial Sequence: Syntheticoligonucleotide
  source 1..22: mol_type = other DNA
gggactcagatctgagtcccga

SEQ ID NO: 9068 - DNA, 22 bp, synthetic construct
  misc_feature 1..22: note = Description of Artificial Sequence: Syntheticoligonucleotide
  source 1..22: mol_type = other DNA
gggactcagatctgagtcccag

SEQ ID NO: 9069 - DNA, 22 bp, synthetic construct
  misc_feature 1..22: note = Description of Artificial Sequence: Syntheticoligonucleotide
  source 1..22: mol_type = other DNA
tggactcagatctgagtccagg

SEQ ID NO: 9070 - DNA, 22 bp, synthetic construct
  misc_feature 1..22: note = Description of Artificial Sequence: Syntheticoligonucleotide
  source 1..22: mol_type = other DNA
gtgactcagatctgagtcacgg

SEQ ID NO: 9071 - DNA, 22 bp, synthetic construct
  misc_feature 1..22: note = Description of Artificial Sequence: Syntheticoligonucleotide
  source 1..22: mol_type = other DNA
gcgactcagatctgagtcgccg

SEQ ID NO: 9072 - DNA, 22 bp, synthetic construct
  misc_feature 1..22: note = Description of Artificial Sequence: Syntheticoligonucleotide
  source 1..22: mol_type = other DNA
gcgactcagatctgagtcgctg

SEQ ID NO: 9073 - DNA, 22 bp, synthetic construct
  misc_feature 1..22: note = Description of Artificial Sequence: Syntheticoligonucleotide
  source 1..22: mol_type = other DNA
acgactcagatctgagtcgtcg

SEQ ID NO: 9074 - DNA, 22 bp, synthetic construct
  misc_feature 1..22: note = Description of Artificial Sequence: Syntheticoligonucleotide
  source 1..22: mol_type = other DNA
gagactcagatctgagtctccg

SEQ ID NO: 9075 - DNA, 22 bp, synthetic construct
  misc_feature 1..22: note = Description of Artificial Sequence: Syntheticoligonucleotide
  source 1..22: mol_type = other DNA
gcgactcagatctgagtcgcag

SEQ ID NO: 9076 - DNA, 22 bp, synthetic construct
  misc_feature 1..22: note = Description of Artificial Sequence: Syntheticoligonucleotide
  source 1..22: mol_type = other DNA
gtgactcagatctgagtcaccg

SEQ ID NO: 9077 - DNA, 22 bp, synthetic construct
  misc_feature 1..22: note = Description of Artificial Sequence: Syntheticoligonucleotide
  source 1..22: mol_type = other DNA
cggactcagatctgagtccgtg

SEQ ID NO: 9078 - DNA, 22 bp, synthetic construct
  misc_feature 1..22: note = Description of Artificial Sequence: Syntheticoligonucleotide
  source 1..22: mol_type = other DNA
cagactcagatctgagtctggg

SEQ ID NO: 9079 - DNA, 22 bp, synthetic construct
  misc_feature 1..22: note = Description of Artificial Sequence: Syntheticoligonucleotide
  source 1..22: mol_type = other DNA
cggactcagatctgagtccgag

SEQ ID NO: 9080 - DNA, 22 bp, synthetic construct
  misc_feature 1..22: note = Description of Artificial Sequence: Syntheticoligonucleotide
  source 1..22: mol_type = other DNA
ctgactcagatctgagtcaggg

SEQ ID NO: 9081 - DNA, 22 bp, synthetic construct
  misc_feature 1..22: note = Description of Artificial Sequence: Syntheticoligonucleotide
  source 1..22: mol_type = other DNA
acgactcagatctgagtcgtgg

SEQ ID NO: 9082 - DNA, 22 bp, synthetic construct
  misc_feature 1..22: note = Description of Artificial Sequence: Syntheticoligonucleotide
  source 1..22: mol_type = other DNA
ccgactcagatctgagtcggct

SEQ ID NO: 9083 - DNA, 22 bp, synthetic construct
  misc_feature 1..22: note = Description of Artificial Sequence: Syntheticoligonucleotide
  source 1..22: mol_type = other DNA
ccgactcagatctgagtcggca

SEQ ID NO: 9084 - DNA, 22 bp, synthetic construct
  misc_feature 1..22: note = Description of Artificial Sequence: Syntheticoligonucleotide
  source 1..22: mol_type = other DNA
gagactcagatctgagtctcgc

SEQ ID NO: 9085 - DNA, 22 bp, synthetic construct
  misc_feature 1..22: note = Description of Artificial Sequence: Syntheticoligonucleotide
  source 1..22: mol_type = other DNA
gtgactcagatctgagtcacgc

SEQ ID NO: 9086 - DNA, 22 bp, synthetic construct
  misc_feature 1..22: note = Description of Artificial Sequence: Syntheticoligonucleotide
  source 1..22: mol_type = other DNA
aggactcagatctgagtcctgc

SEQ ID NO: 9087 - DNA, 22 bp, synthetic construct
  misc_feature 1..22: note = Description of Artificial Sequence: Syntheticoligonucleotide
  source 1..22: mol_type = other DNA
tggactcagatctgagtccagc

SEQ ID NO: 9088 - DNA, 22 bp, synthetic construct
  misc_feature 1..22: note = Description of Artificial Sequence: Syntheticoligonucleotide
  source 1..22: mol_type = other DNA
aggactcagatctgagtcctcg

SEQ ID NO: 9089 - DNA, 22 bp, synthetic construct
  misc_feature 1..22: note = Description of Artificial Sequence: Syntheticoligonucleotide
  source 1..22: mol_type = other DNA
tggactcagatctgagtccacg

SEQ ID NO: 9090 - DNA, 22 bp, synthetic construct
  misc_feature 1..22: note = Description of Artificial Sequence: Syntheticoligonucleotide
  source 1..22: mol_type = other DNA
ccgactcagatctgagtcggtg

SEQ ID NO: 9091 - DNA, 22 bp, synthetic construct
  misc_feature 1..22: note = Description of Artificial Sequence: Syntheticoligonucleotide
  source 1..22: mol_type = other DNA
ccgactcagatctgagtcggag

SEQ ID NO: 9092 - DNA, 22 bp, synthetic construct
  misc_feature 1..22: note = Description of Artificial Sequence: Syntheticoligonucleotide
  source 1..22: mol_type = other DNA
gggactcagatctgagtcccgc

SEQ ID NO: 9093 - DNA, 22 bp, synthetic construct
  misc_feature 1..22: note = Description of Artificial Sequence: Syntheticoligonucleotide
  source 1..22: mol_type = other DNA
gggactcagatctgagtccctc

SEQ ID NO: 9094 - DNA, 22 bp, synthetic construct
  misc_feature 1..22: note = Description of Artificial Sequence: Syntheticoligonucleotide
  source 1..22: mol_type = other DNA
gggactcagatctgagtcccac

SEQ ID NO: 9095 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcagtactgagtcnnnn

SEQ ID NO: 9096 - DNA, 22 bp, synthetic construct
  misc_feature 1..22: note = Description of Artificial Sequence: Syntheticoligonucleotide
  source 1..22: mol_type = other DNA
cggactcagtactgagtccgcc

SEQ ID NO: 9097 - DNA, 22 bp, synthetic construct
  misc_feature 1..22: note = Description of Artificial Sequence: Syntheticoligonucleotide
  source 1..22: mol_type = other DNA
cggactcagtactgagtccgct

SEQ ID NO: 9098 - DNA, 22 bp, synthetic construct
  misc_feature 1..22: note = Description of Artificial Sequence: Syntheticoligonucleotide
  source 1..22: mol_type = other DNA
cggactcagtactgagtccgtc

SEQ ID NO: 9099 - DNA, 22 bp, synthetic construct
  misc_feature 1..22: note = Description of Artificial Sequence: Syntheticoligonucleotide
  source 1..22: mol_type = other DNA
aggactcagtactgagtcctcc

SEQ ID NO: 9100 - DNA, 22 bp, synthetic construct
  misc_feature 1..22: note = Description of Artificial Sequence: Syntheticoligonucleotide
  source 1..22: mol_type = other DNA
cagactcagtactgagtctgcc

SEQ ID NO: 9101 - DNA, 22 bp, synthetic construct
  misc_feature 1..22: note = Description of Artificial Sequence: Syntheticoligonucleotide
  source 1..22: mol_type = other DNA
cggactcagtactgagtccgca

SEQ ID NO: 9102 - DNA, 22 bp, synthetic construct
  misc_feature 1..22: note = Description of Artificial Sequence: Syntheticoligonucleotide
  source 1..22: mol_type = other DNA
cggactcagtactgagtccgac

SEQ ID NO: 9103 - DNA, 22 bp, synthetic construct
  misc_feature 1..22: note = Description of Artificial Sequence: Syntheticoligonucleotide
  source 1..22: mol_type = other DNA
tggactcagtactgagtccacc

SEQ ID NO: 9104 - DNA, 22 bp, synthetic construct
  misc_feature 1..22: note = Description of Artificial Sequence: Syntheticoligonucleotide
  source 1..22: mol_type = other DNA
ctgactcagtactgagtcagcc

SEQ ID NO: 9105 - DNA, 22 bp, synthetic construct
  misc_feature 1..22: note = Description of Artificial Sequence: Syntheticoligonucleotide
  source 1..22: mol_type = other DNA
ccgactcagtactgagtcgggc

SEQ ID NO: 9106 - DNA, 22 bp, synthetic construct
  misc_feature 1..22: note = Description of Artificial Sequence: Syntheticoligonucleotide
  source 1..22: mol_type = other DNA
ccgactcagtactgagtcgggt

SEQ ID NO: 9107 - DNA, 22 bp, synthetic construct
  misc_feature 1..22: note = Description of Artificial Sequence: Syntheticoligonucleotide
  source 1..22: mol_type = other DNA
ccgactcagtactgagtcggtc

SEQ ID NO: 9108 - DNA, 22 bp, synthetic construct
  misc_feature 1..22: note = Description of Artificial Sequence: Syntheticoligonucleotide
  source 1..22: mol_type = other DNA
acgactcagtactgagtcgtgc

SEQ ID NO: 9109 - DNA, 22 bp, synthetic construct
  misc_feature 1..22: note = Description of Artificial Sequence: Syntheticoligonucleotide
  source 1..22: mol_type = other DNA
cagactcagtactgagtctggc

SEQ ID NO: 9110 - DNA, 22 bp, synthetic construct
  misc_feature 1..22: note = Description of Artificial Sequence: Syntheticoligonucleotide
  source 1..22: mol_type = other DNA
ccgactcagtactgagtcggga

SEQ ID NO: 9111 - DNA, 22 bp, synthetic construct
  misc_feature 1..22: note = Description of Artificial Sequence: Syntheticoligonucleotide
  source 1..22: mol_type = other DNA
ccgactcagtactgagtcggac

SEQ ID NO: 9112 - DNA, 22 bp, synthetic construct
  misc_feature 1..22: note = Description of Artificial Sequence: Syntheticoligonucleotide
  source 1..22: mol_type = other DNA
ctgactcagtactgagtcaggc

SEQ ID NO: 9113 - DNA, 22 bp, synthetic construct
  misc_feature 1..22: note = Description of Artificial Sequence: Syntheticoligonucleotide
  source 1..22: mol_type = other DNA
gcgactcagtactgagtcgccc

SEQ ID NO: 9114 - DNA, 22 bp, synthetic construct
  misc_feature 1..22: note = Description of Artificial Sequence: Syntheticoligonucleotide
  source 1..22: mol_type = other DNA
gcgactcagtactgagtcgcct

SEQ ID NO: 9115 - DNA, 22 bp, synthetic construct
  misc_feature 1..22: note = Description of Artificial Sequence: Syntheticoligonucleotide
  source 1..22: mol_type = other DNA
gcgactcagtactgagtcgctc

SEQ ID NO: 9116 - DNA, 22 bp, synthetic construct
  misc_feature 1..22: note = Description of Artificial Sequence: Syntheticoligonucleotide
  source 1..22: mol_type = other DNA
acgactcagtactgagtcgtcc

SEQ ID NO: 9117 - DNA, 22 bp, synthetic construct
  misc_feature 1..22: note = Description of Artificial Sequence: Syntheticoligonucleotide
  source 1..22: mol_type = other DNA
gagactcagtactgagtctccc

SEQ ID NO: 9118 - DNA, 22 bp, synthetic construct
  misc_feature 1..22: note = Description of Artificial Sequence: Syntheticoligonucleotide
  source 1..22: mol_type = other DNA
gcgactcagtactgagtcgcca

SEQ ID NO: 9119 - DNA, 22 bp, synthetic construct
  misc_feature 1..22: note = Description of Artificial Sequence: Syntheticoligonucleotide
  source 1..22: mol_type = other DNA
gcgactcagtactgagtcgcac

SEQ ID NO: 9120 - DNA, 22 bp, synthetic construct
  misc_feature 1..22: note = Description of Artificial Sequence: Syntheticoligonucleotide
  source 1..22: mol_type = other DNA
gtgactcagtactgagtcaccc

SEQ ID NO: 9121 - DNA, 22 bp, synthetic construct
  misc_feature 1..22: note = Description of Artificial Sequence: Syntheticoligonucleotide
  source 1..22: mol_type = other DNA
gggactcagtactgagtcccgt

SEQ ID NO: 9122 - DNA, 22 bp, synthetic construct
  misc_feature 1..22: note = Description of Artificial Sequence: Syntheticoligonucleotide
  source 1..22: mol_type = other DNA
gggactcagtactgagtccctg

SEQ ID NO: 9123 - DNA, 22 bp, synthetic construct
  misc_feature 1..22: note = Description of Artificial Sequence: Syntheticoligonucleotide
  source 1..22: mol_type = other DNA
aggactcagtactgagtcctgg

SEQ ID NO: 9124 - DNA, 22 bp, synthetic construct
  misc_feature 1..22: note = Description of Artificial Sequence: Syntheticoligonucleotide
  source 1..22: mol_type = other DNA
gagactcagtactgagtctcgg

SEQ ID NO: 9125 - DNA, 22 bp, synthetic construct
  misc_feature 1..22: note = Description of Artificial Sequence: Syntheticoligonucleotide
  source 1..22: mol_type = other DNA
gggactcagtactgagtcccga

SEQ ID NO: 9126 - DNA, 22 bp, synthetic construct
  misc_feature 1..22: note = Description of Artificial Sequence: Syntheticoligonucleotide
  source 1..22: mol_type = other DNA
gggactcagtactgagtcccag

SEQ ID NO: 9127 - DNA, 22 bp, synthetic construct
  misc_feature 1..22: note = Description of Artificial Sequence: Syntheticoligonucleotide
  source 1..22: mol_type = other DNA
tggactcagtactgagtccagg

SEQ ID NO: 9128 - DNA, 22 bp, synthetic construct
  misc_feature 1..22: note = Description of Artificial Sequence: Syntheticoligonucleotide
  source 1..22: mol_type = other DNA
gtgactcagtactgagtcacgg

SEQ ID NO: 9129 - DNA, 22 bp, synthetic construct
  misc_feature 1..22: note = Description of Artificial Sequence: Syntheticoligonucleotide
  source 1..22: mol_type = other DNA
gcgactcagtactgagtcgccg

SEQ ID NO: 9130 - DNA, 22 bp, synthetic construct
  misc_feature 1..22: note = Description of Artificial Sequence: Syntheticoligonucleotide
  source 1..22: mol_type = other DNA
gcgactcagtactgagtcgctg

SEQ ID NO: 9131 - DNA, 22 bp, synthetic construct
  misc_feature 1..22: note = Description of Artificial Sequence: Syntheticoligonucleotide
  source 1..22: mol_type = other DNA
acgactcagtactgagtcgtcg

SEQ ID NO: 9132 - DNA, 22 bp, synthetic construct
  misc_feature 1..22: note = Description of Artificial Sequence: Syntheticoligonucleotide
  source 1..22: mol_type = other DNA
gagactcagtactgagtctccg

SEQ ID NO: 9133 - DNA, 22 bp, synthetic construct
  misc_feature 1..22: note = Description of Artificial Sequence: Syntheticoligonucleotide
  source 1..22: mol_type = other DNA
gcgactcagtactgagtcgcag

SEQ ID NO: 9134 - DNA, 22 bp, synthetic construct
  misc_feature 1..22: note = Description of Artificial Sequence: Syntheticoligonucleotide
  source 1..22: mol_type = other DNA
gtgactcagtactgagtcaccg

SEQ ID NO: 9135 - DNA, 22 bp, synthetic construct
  misc_feature 1..22: note = Description of Artificial Sequence: Syntheticoligonucleotide
  source 1..22: mol_type = other DNA
cggactcagtactgagtccgtg

SEQ ID NO: 9136 - DNA, 22 bp, synthetic construct
  misc_feature 1..22: note = Description of Artificial Sequence: Syntheticoligonucleotide
  source 1..22: mol_type = other DNA
cagactcagtactgagtctggg

SEQ ID NO: 9137 - DNA, 22 bp, synthetic construct
  misc_feature 1..22: note = Description of Artificial Sequence: Syntheticoligonucleotide
  source 1..22: mol_type = other DNA
cggactcagtactgagtccgag

SEQ ID NO: 9138 - DNA, 22 bp, synthetic construct
  misc_feature 1..22: note = Description of Artificial Sequence: Syntheticoligonucleotide
  source 1..22: mol_type = other DNA
ctgactcagtactgagtcaggg

SEQ ID NO: 9139 - DNA, 22 bp, synthetic construct
  misc_feature 1..22: note = Description of Artificial Sequence: Syntheticoligonucleotide
  source 1..22: mol_type = other DNA
acgactcagtactgagtcgtgg

SEQ ID NO: 9140 - DNA, 22 bp, synthetic construct
  misc_feature 1..22: note = Description of Artificial Sequence: Syntheticoligonucleotide
  source 1..22: mol_type = other DNA
ccgactcagtactgagtcggct

SEQ ID NO: 9141 - DNA, 22 bp, synthetic construct
  misc_feature 1..22: note = Description of Artificial Sequence: Syntheticoligonucleotide
  source 1..22: mol_type = other DNA
ccgactcagtactgagtcggca

SEQ ID NO: 9142 - DNA, 22 bp, synthetic construct
  misc_feature 1..22: note = Description of Artificial Sequence: Syntheticoligonucleotide
  source 1..22: mol_type = other DNA
gagactcagtactgagtctcgc

SEQ ID NO: 9143 - DNA, 22 bp, synthetic construct
  misc_feature 1..22: note = Description of Artificial Sequence: Syntheticoligonucleotide
  source 1..22: mol_type = other DNA
gtgactcagtactgagtcacgc

SEQ ID NO: 9144 - DNA, 22 bp, synthetic construct
  misc_feature 1..22: note = Description of Artificial Sequence: Syntheticoligonucleotide
  source 1..22: mol_type = other DNA
aggactcagtactgagtcctgc

SEQ ID NO: 9145 - DNA, 22 bp, synthetic construct
  misc_feature 1..22: note = Description of Artificial Sequence: Syntheticoligonucleotide
  source 1..22: mol_type = other DNA
tggactcagtactgagtccagc

SEQ ID NO: 9146 - DNA, 22 bp, synthetic construct
  misc_feature 1..22: note = Description of Artificial Sequence: Syntheticoligonucleotide
  source 1..22: mol_type = other DNA
aggactcagtactgagtcctcg

SEQ ID NO: 9147 - DNA, 22 bp, synthetic construct
  misc_feature 1..22: note = Description of Artificial Sequence: Syntheticoligonucleotide
  source 1..22: mol_type = other DNA
tggactcagtactgagtccacg

SEQ ID NO: 9148 - DNA, 22 bp, synthetic construct
  misc_feature 1..22: note = Description of Artificial Sequence: Syntheticoligonucleotide
  source 1..22: mol_type = other DNA
ccgactcagtactgagtcggtg

SEQ ID NO: 9149 - DNA, 22 bp, synthetic construct
  misc_feature 1..22: note = Description of Artificial Sequence: Syntheticoligonucleotide
  source 1..22: mol_type = other DNA
ccgactcagtactgagtcggag

SEQ ID NO: 9150 - DNA, 22 bp, synthetic construct
  misc_feature 1..22: note = Description of Artificial Sequence: Syntheticoligonucleotide
  source 1..22: mol_type = other DNA
gggactcagtactgagtcccgc

SEQ ID NO: 9151 - DNA, 22 bp, synthetic construct
  misc_feature 1..22: note = Description of Artificial Sequence: Syntheticoligonucleotide
  source 1..22: mol_type = other DNA
gggactcagtactgagtccctc

SEQ ID NO: 9152 - DNA, 22 bp, synthetic construct
  misc_feature 1..22: note = Description of Artificial Sequence: Syntheticoligonucleotide
  source 1..22: mol_type = other DNA
gggactcagtactgagtcccac

SEQ ID NO: 9153 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcaggcctgagtcnnnn

SEQ ID NO: 9154 - DNA, 22 bp, synthetic construct
  misc_feature 1..22: note = Description of Artificial Sequence: Syntheticoligonucleotide
  source 1..22: mol_type = other DNA
cggactcaggcctgagtccgcc

SEQ ID NO: 9155 - DNA, 22 bp, synthetic construct
  misc_feature 1..22: note = Description of Artificial Sequence: Syntheticoligonucleotide
  source 1..22: mol_type = other DNA
cggactcaggcctgagtccgct

SEQ ID NO: 9156 - DNA, 22 bp, synthetic construct
  misc_feature 1..22: note = Description of Artificial Sequence: Syntheticoligonucleotide
  source 1..22: mol_type = other DNA
cggactcaggcctgagtccgtc

SEQ ID NO: 9157 - DNA, 22 bp, synthetic construct
  misc_feature 1..22: note = Description of Artificial Sequence: Syntheticoligonucleotide
  source 1..22: mol_type = other DNA
aggactcaggcctgagtcctcc

SEQ ID NO: 9158 - DNA, 22 bp, synthetic construct
  misc_feature 1..22: note = Description of Artificial Sequence: Syntheticoligonucleotide
  source 1..22: mol_type = other DNA
cagactcaggcctgagtctgcc

SEQ ID NO: 9159 - DNA, 22 bp, synthetic construct
  misc_feature 1..22: note = Description of Artificial Sequence: Syntheticoligonucleotide
  source 1..22: mol_type = other DNA
cggactcaggcctgagtccgca

SEQ ID NO: 9160 - DNA, 22 bp, synthetic construct
  misc_feature 1..22: note = Description of Artificial Sequence: Syntheticoligonucleotide
  source 1..22: mol_type = other DNA
cggactcaggcctgagtccgac

SEQ ID NO: 9161 - DNA, 22 bp, synthetic construct
  misc_feature 1..22: note = Description of Artificial Sequence: Syntheticoligonucleotide
  source 1..22: mol_type = other DNA
tggactcaggcctgagtccacc

SEQ ID NO: 9162 - DNA, 22 bp, synthetic construct
  misc_feature 1..22: note = Description of Artificial Sequence: Syntheticoligonucleotide
  source 1..22: mol_type = other DNA
ctgactcaggcctgagtcagcc

SEQ ID NO: 9163 - DNA, 22 bp, synthetic construct
  misc_feature 1..22: note = Description of Artificial Sequence: Syntheticoligonucleotide
  source 1..22: mol_type = other DNA
ccgactcaggcctgagtcgggc

SEQ ID NO: 9164 - DNA, 22 bp, synthetic construct
  misc_feature 1..22: note = Description of Artificial Sequence: Syntheticoligonucleotide
  source 1..22: mol_type = other DNA
ccgactcaggcctgagtcgggt

SEQ ID NO: 9165 - DNA, 22 bp, synthetic construct
  misc_feature 1..22: note = Description of Artificial Sequence: Syntheticoligonucleotide
  source 1..22: mol_type = other DNA
ccgactcaggcctgagtcggtc

SEQ ID NO: 9166 - DNA, 22 bp, synthetic construct
  misc_feature 1..22: note = Description of Artificial Sequence: Syntheticoligonucleotide
  source 1..22: mol_type = other DNA
acgactcaggcctgagtcgtgc

SEQ ID NO: 9167 - DNA, 22 bp, synthetic construct
  misc_feature 1..22: note = Description of Artificial Sequence: Syntheticoligonucleotide
  source 1..22: mol_type = other DNA
cagactcaggcctgagtctggc

SEQ ID NO: 9168 - DNA, 22 bp, synthetic construct
  misc_feature 1..22: note = Description of Artificial Sequence: Syntheticoligonucleotide
  source 1..22: mol_type = other DNA
ccgactcaggcctgagtcggga

SEQ ID NO: 9169 - DNA, 22 bp, synthetic construct
  misc_feature 1..22: note = Description of Artificial Sequence: Syntheticoligonucleotide
  source 1..22: mol_type = other DNA
ccgactcaggcctgagtcggac

SEQ ID NO: 9170 - DNA, 22 bp, synthetic construct
  misc_feature 1..22: note = Description of Artificial Sequence: Syntheticoligonucleotide
  source 1..22: mol_type = other DNA
ctgactcaggcctgagtcaggc

SEQ ID NO: 9171 - DNA, 22 bp, synthetic construct
  misc_feature 1..22: note = Description of Artificial Sequence: Syntheticoligonucleotide
  source 1..22: mol_type = other DNA
gcgactcaggcctgagtcgccc

SEQ ID NO: 9172 - DNA, 22 bp, synthetic construct
  misc_feature 1..22: note = Description of Artificial Sequence: Syntheticoligonucleotide
  source 1..22: mol_type = other DNA
gcgactcaggcctgagtcgcct

SEQ ID NO: 9173 - DNA, 22 bp, synthetic construct
  misc_feature 1..22: note = Description of Artificial Sequence: Syntheticoligonucleotide
  source 1..22: mol_type = other DNA
gcgactcaggcctgagtcgctc

SEQ ID NO: 9174 - DNA, 22 bp, synthetic construct
  misc_feature 1..22: note = Description of Artificial Sequence: Syntheticoligonucleotide
  source 1..22: mol_type = other DNA
acgactcaggcctgagtcgtcc

SEQ ID NO: 9175 - DNA, 22 bp, synthetic construct
  misc_feature 1..22: note = Description of Artificial Sequence: Syntheticoligonucleotide
  source 1..22: mol_type = other DNA
gagactcaggcctgagtctccc

SEQ ID NO: 9176 - DNA, 22 bp, synthetic construct
  misc_feature 1..22: note = Description of Artificial Sequence: Syntheticoligonucleotide
  source 1..22: mol_type = other DNA
gcgactcaggcctgagtcgcca

SEQ ID NO: 9177 - DNA, 22 bp, synthetic construct
  misc_feature 1..22: note = Description of Artificial Sequence: Syntheticoligonucleotide
  source 1..22: mol_type = other DNA
gcgactcaggcctgagtcgcac

SEQ ID NO: 9178 - DNA, 22 bp, synthetic construct
  misc_feature 1..22: note = Description of Artificial Sequence: Syntheticoligonucleotide
  source 1..22: mol_type = other DNA
gtgactcaggcctgagtcaccc

SEQ ID NO: 9179 - DNA, 22 bp, synthetic construct
  misc_feature 1..22: note = Description of Artificial Sequence: Syntheticoligonucleotide
  source 1..22: mol_type = other DNA
gggactcaggcctgagtcccgt

SEQ ID NO: 9180 - DNA, 22 bp, synthetic construct
  misc_feature 1..22: note = Description of Artificial Sequence: Syntheticoligonucleotide
  source 1..22: mol_type = other DNA
gggactcaggcctgagtccctg

SEQ ID NO: 9181 - DNA, 22 bp, synthetic construct
  misc_feature 1..22: note = Description of Artificial Sequence: Syntheticoligonucleotide
  source 1..22: mol_type = other DNA
aggactcaggcctgagtcctgg

SEQ ID NO: 9182 - DNA, 22 bp, synthetic construct
  misc_feature 1..22: note = Description of Artificial Sequence: Syntheticoligonucleotide
  source 1..22: mol_type = other DNA
gagactcaggcctgagtctcgg

SEQ ID NO: 9183 - DNA, 22 bp, synthetic construct
  misc_feature 1..22: note = Description of Artificial Sequence: Syntheticoligonucleotide
  source 1..22: mol_type = other DNA
gggactcaggcctgagtcccga

SEQ ID NO: 9184 - DNA, 22 bp, synthetic construct
  misc_feature 1..22: note = Description of Artificial Sequence: Syntheticoligonucleotide
  source 1..22: mol_type = other DNA
gggactcaggcctgagtcccag

SEQ ID NO: 9185 - DNA, 22 bp, synthetic construct
  misc_feature 1..22: note = Description of Artificial Sequence: Syntheticoligonucleotide
  source 1..22: mol_type = other DNA
tggactcaggcctgagtccagg

SEQ ID NO: 9186 - DNA, 22 bp, synthetic construct
  misc_feature 1..22: note = Description of Artificial Sequence: Syntheticoligonucleotide
  source 1..22: mol_type = other DNA
gtgactcaggcctgagtcacgg

SEQ ID NO: 9187 - DNA, 22 bp, synthetic construct
  misc_feature 1..22: note = Description of Artificial Sequence: Syntheticoligonucleotide
  source 1..22: mol_type = other DNA
gcgactcaggcctgagtcgccg

SEQ ID NO: 9188 - DNA, 22 bp, synthetic construct
  misc_feature 1..22: note = Description of Artificial Sequence: Syntheticoligonucleotide
  source 1..22: mol_type = other DNA
gcgactcaggcctgagtcgctg

SEQ ID NO: 9189 - DNA, 22 bp, synthetic construct
  misc_feature 1..22: note = Description of Artificial Sequence: Syntheticoligonucleotide
  source 1..22: mol_type = other DNA
acgactcaggcctgagtcgtcg

SEQ ID NO: 9190 - DNA, 22 bp, synthetic construct
  misc_feature 1..22: note = Description of Artificial Sequence: Syntheticoligonucleotide
  source 1..22: mol_type = other DNA
gagactcaggcctgagtctccg

SEQ ID NO: 9191 - DNA, 22 bp, synthetic construct
  misc_feature 1..22: note = Description of Artificial Sequence: Syntheticoligonucleotide
  source 1..22: mol_type = other DNA
gcgactcaggcctgagtcgcag

SEQ ID NO: 9192 - DNA, 22 bp, synthetic construct
  misc_feature 1..22: note = Description of Artificial Sequence: Syntheticoligonucleotide
  source 1..22: mol_type = other DNA
gtgactcaggcctgagtcaccg

SEQ ID NO: 9193 - DNA, 22 bp, synthetic construct
  misc_feature 1..22: note = Description of Artificial Sequence: Syntheticoligonucleotide
  source 1..22: mol_type = other DNA
cggactcaggcctgagtccgtg

SEQ ID NO: 9194 - DNA, 22 bp, synthetic construct
  misc_feature 1..22: note = Description of Artificial Sequence: Syntheticoligonucleotide
  source 1..22: mol_type = other DNA
cagactcaggcctgagtctggg

SEQ ID NO: 9195 - DNA, 22 bp, synthetic construct
  misc_feature 1..22: note = Description of Artificial Sequence: Syntheticoligonucleotide
  source 1..22: mol_type = other DNA
cggactcaggcctgagtccgag

SEQ ID NO: 9196 - DNA, 22 bp, synthetic construct
  misc_feature 1..22: note = Description of Artificial Sequence: Syntheticoligonucleotide
  source 1..22: mol_type = other DNA
ctgactcaggcctgagtcaggg

SEQ ID NO: 9197 - DNA, 22 bp, synthetic construct
  misc_feature 1..22: note = Description of Artificial Sequence: Syntheticoligonucleotide
  source 1..22: mol_type = other DNA
acgactcaggcctgagtcgtgg

SEQ ID NO: 9198 - DNA, 22 bp, synthetic construct
  misc_feature 1..22: note = Description of Artificial Sequence: Syntheticoligonucleotide
  source 1..22: mol_type = other DNA
ccgactcaggcctgagtcggct

SEQ ID NO: 9199 - DNA, 22 bp, synthetic construct
  misc_feature 1..22: note = Description of Artificial Sequence: Syntheticoligonucleotide
  source 1..22: mol_type = other DNA
ccgactcaggcctgagtcggca

SEQ ID NO: 9200 - DNA, 22 bp, synthetic construct
  misc_feature 1..22: note = Description of Artificial Sequence: Syntheticoligonucleotide
  source 1..22: mol_type = other DNA
gagactcaggcctgagtctcgc

SEQ ID NO: 9201 - DNA, 22 bp, synthetic construct
  misc_feature 1..22: note = Description of Artificial Sequence: Syntheticoligonucleotide
  source 1..22: mol_type = other DNA
gtgactcaggcctgagtcacgc

SEQ ID NO: 9202 - DNA, 22 bp, synthetic construct
  misc_feature 1..22: note = Description of Artificial Sequence: Syntheticoligonucleotide
  source 1..22: mol_type = other DNA
aggactcaggcctgagtcctgc

SEQ ID NO: 9203 - DNA, 22 bp, synthetic construct
  misc_feature 1..22: note = Description of Artificial Sequence: Syntheticoligonucleotide
  source 1..22: mol_type = other DNA
tggactcaggcctgagtccagc

SEQ ID NO: 9204 - DNA, 22 bp, synthetic construct
  misc_feature 1..22: note = Description of Artificial Sequence: Syntheticoligonucleotide
  source 1..22: mol_type = other DNA
aggactcaggcctgagtcctcg

SEQ ID NO: 9205 - DNA, 22 bp, synthetic construct
  misc_feature 1..22: note = Description of Artificial Sequence: Syntheticoligonucleotide
  source 1..22: mol_type = other DNA
tggactcaggcctgagtccacg

SEQ ID NO: 9206 - DNA, 22 bp, synthetic construct
  misc_feature 1..22: note = Description of Artificial Sequence: Syntheticoligonucleotide
  source 1..22: mol_type = other DNA
ccgactcaggcctgagtcggtg

SEQ ID NO: 9207 - DNA, 22 bp, synthetic construct
  misc_feature 1..22: note = Description of Artificial Sequence: Syntheticoligonucleotide
  source 1..22: mol_type = other DNA
ccgactcaggcctgagtcggag

SEQ ID NO: 9208 - DNA, 22 bp, synthetic construct
  misc_feature 1..22: note = Description of Artificial Sequence: Syntheticoligonucleotide
  source 1..22: mol_type = other DNA
gggactcaggcctgagtcccgc

SEQ ID NO: 9209 - DNA, 22 bp, synthetic construct
  misc_feature 1..22: note = Description of Artificial Sequence: Syntheticoligonucleotide
  source 1..22: mol_type = other DNA
gggactcaggcctgagtccctc

SEQ ID NO: 9210 - DNA, 22 bp, synthetic construct
  misc_feature 1..22: note = Description of Artificial Sequence: Syntheticoligonucleotide
  source 1..22: mol_type = other DNA
gggactcaggcctgagtcccac

SEQ ID NO: 9211 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcagcgctgagtcnnnn

SEQ ID NO: 9212 - DNA, 22 bp, synthetic construct
  misc_feature 1..22: note = Description of Artificial Sequence: Syntheticoligonucleotide
  source 1..22: mol_type = other DNA
cggactcagcgctgagtccgcc

SEQ ID NO: 9213 - DNA, 22 bp, synthetic construct
  misc_feature 1..22: note = Description of Artificial Sequence: Syntheticoligonucleotide
  source 1..22: mol_type = other DNA
cggactcagcgctgagtccgct

SEQ ID NO: 9214 - DNA, 22 bp, synthetic construct
  misc_feature 1..22: note = Description of Artificial Sequence: Syntheticoligonucleotide
  source 1..22: mol_type = other DNA
cggactcagcgctgagtccgtc

SEQ ID NO: 9215 - DNA, 22 bp, synthetic construct
  misc_feature 1..22: note = Description of Artificial Sequence: Syntheticoligonucleotide
  source 1..22: mol_type = other DNA
aggactcagcgctgagtcctcc

SEQ ID NO: 9216 - DNA, 22 bp, synthetic construct
  misc_feature 1..22: note = Description of Artificial Sequence: Syntheticoligonucleotide
  source 1..22: mol_type = other DNA
cagactcagcgctgagtctgcc

SEQ ID NO: 9217 - DNA, 22 bp, synthetic construct
  misc_feature 1..22: note = Description of Artificial Sequence: Syntheticoligonucleotide
  source 1..22: mol_type = other DNA
cggactcagcgctgagtccgca

SEQ ID NO: 9218 - DNA, 22 bp, synthetic construct
  misc_feature 1..22: note = Description of Artificial Sequence: Syntheticoligonucleotide
  source 1..22: mol_type = other DNA
cggactcagcgctgagtccgac

SEQ ID NO: 9219 - DNA, 22 bp, synthetic construct
  misc_feature 1..22: note = Description of Artificial Sequence: Syntheticoligonucleotide
  source 1..22: mol_type = other DNA
tggactcagcgctgagtccacc

SEQ ID NO: 9220 - DNA, 22 bp, synthetic construct
  misc_feature 1..22: note = Description of Artificial Sequence: Syntheticoligonucleotide
  source 1..22: mol_type = other DNA
ctgactcagcgctgagtcagcc

SEQ ID NO: 9221 - DNA, 22 bp, synthetic construct
  misc_feature 1..22: note = Description of Artificial Sequence: Syntheticoligonucleotide
  source 1..22: mol_type = other DNA
ccgactcagcgctgagtcgggc

SEQ ID NO: 9222 - DNA, 22 bp, synthetic construct
  misc_feature 1..22: note = Description of Artificial Sequence: Syntheticoligonucleotide
  source 1..22: mol_type = other DNA
ccgactcagcgctgagtcgggt

SEQ ID NO: 9223 - DNA, 22 bp, synthetic construct
  misc_feature 1..22: note = Description of Artificial Sequence: Syntheticoligonucleotide
  source 1..22: mol_type = other DNA
ccgactcagcgctgagtcggtc

SEQ ID NO: 9224 - DNA, 22 bp, synthetic construct
  misc_feature 1..22: note = Description of Artificial Sequence: Syntheticoligonucleotide
  source 1..22: mol_type = other DNA
acgactcagcgctgagtcgtgc

SEQ ID NO: 9225 - DNA, 22 bp, synthetic construct
  misc_feature 1..22: note = Description of Artificial Sequence: Syntheticoligonucleotide
  source 1..22: mol_type = other DNA
cagactcagcgctgagtctggc

SEQ ID NO: 9226 - DNA, 22 bp, synthetic construct
  misc_feature 1..22: note = Description of Artificial Sequence: Syntheticoligonucleotide
  source 1..22: mol_type = other DNA
ccgactcagcgctgagtcggga

SEQ ID NO: 9227 - DNA, 22 bp, synthetic construct
  misc_feature 1..22: note = Description of Artificial Sequence: Syntheticoligonucleotide
  source 1..22: mol_type = other DNA
ccgactcagcgctgagtcggac

SEQ ID NO: 9228 - DNA, 22 bp, synthetic construct
  misc_feature 1..22: note = Description of Artificial Sequence: Syntheticoligonucleotide
  source 1..22: mol_type = other DNA
ctgactcagcgctgagtcaggc

SEQ ID NO: 9229 - DNA, 22 bp, synthetic construct
  misc_feature 1..22: note = Description of Artificial Sequence: Syntheticoligonucleotide
  source 1..22: mol_type = other DNA
gcgactcagcgctgagtcgccc

SEQ ID NO: 9230 - DNA, 22 bp, synthetic construct
  misc_feature 1..22: note = Description of Artificial Sequence: Syntheticoligonucleotide
  source 1..22: mol_type = other DNA
gcgactcagcgctgagtcgcct

SEQ ID NO: 9231 - DNA, 22 bp, synthetic construct
  misc_feature 1..22: note = Description of Artificial Sequence: Syntheticoligonucleotide
  source 1..22: mol_type = other DNA
gcgactcagcgctgagtcgctc

SEQ ID NO: 9232 - DNA, 22 bp, synthetic construct
  misc_feature 1..22: note = Description of Artificial Sequence: Syntheticoligonucleotide
  source 1..22: mol_type = other DNA
acgactcagcgctgagtcgtcc

SEQ ID NO: 9233 - DNA, 22 bp, synthetic construct
  misc_feature 1..22: note = Description of Artificial Sequence: Syntheticoligonucleotide
  source 1..22: mol_type = other DNA
gagactcagcgctgagtctccc

SEQ ID NO: 9234 - DNA, 22 bp, synthetic construct
  misc_feature 1..22: note = Description of Artificial Sequence: Syntheticoligonucleotide
  source 1..22: mol_type = other DNA
gcgactcagcgctgagtcgcca

SEQ ID NO: 9235 - DNA, 22 bp, synthetic construct
  misc_feature 1..22: note = Description of Artificial Sequence: Syntheticoligonucleotide
  source 1..22: mol_type = other DNA
gcgactcagcgctgagtcgcac

SEQ ID NO: 9236 - DNA, 22 bp, synthetic construct
  misc_feature 1..22: note = Description of Artificial Sequence: Syntheticoligonucleotide
  source 1..22: mol_type = other DNA
gtgactcagcgctgagtcaccc

SEQ ID NO: 9237 - DNA, 22 bp, synthetic construct
  misc_feature 1..22: note = Description of Artificial Sequence: Syntheticoligonucleotide
  source 1..22: mol_type = other DNA
gggactcagcgctgagtcccgt

SEQ ID NO: 9238 - DNA, 22 bp, synthetic construct
  misc_feature 1..22: note = Description of Artificial Sequence: Syntheticoligonucleotide
  source 1..22: mol_type = other DNA
gggactcagcgctgagtccctg

SEQ ID NO: 9239 - DNA, 22 bp, synthetic construct
  misc_feature 1..22: note = Description of Artificial Sequence: Syntheticoligonucleotide
  source 1..22: mol_type = other DNA
aggactcagcgctgagtcctgg

SEQ ID NO: 9240 - DNA, 22 bp, synthetic construct
  misc_feature 1..22: note = Description of Artificial Sequence: Syntheticoligonucleotide
  source 1..22: mol_type = other DNA
gagactcagcgctgagtctcgg

SEQ ID NO: 9241 - DNA, 22 bp, synthetic construct
  misc_feature 1..22: note = Description of Artificial Sequence: Syntheticoligonucleotide
  source 1..22: mol_type = other DNA
gggactcagcgctgagtcccga

SEQ ID NO: 9242 - DNA, 22 bp, synthetic construct
  misc_feature 1..22: note = Description of Artificial Sequence: Syntheticoligonucleotide
  source 1..22: mol_type = other DNA
gggactcagcgctgagtcccag

SEQ ID NO: 9243 - DNA, 22 bp, synthetic construct
  misc_feature 1..22: note = Description of Artificial Sequence: Syntheticoligonucleotide
  source 1..22: mol_type = other DNA
tggactcagcgctgagtccagg

SEQ ID NO: 9244 - DNA, 22 bp, synthetic construct
  misc_feature 1..22: note = Description of Artificial Sequence: Syntheticoligonucleotide
  source 1..22: mol_type = other DNA
gtgactcagcgctgagtcacgg

SEQ ID NO: 9245 - DNA, 22 bp, synthetic construct
  misc_feature 1..22: note = Description of Artificial Sequence: Syntheticoligonucleotide
  source 1..22: mol_type = other DNA
gcgactcagcgctgagtcgccg

SEQ ID NO: 9246 - DNA, 22 bp, synthetic construct
  misc_feature 1..22: note = Description of Artificial Sequence: Syntheticoligonucleotide
  source 1..22: mol_type = other DNA
gcgactcagcgctgagtcgctg

SEQ ID NO: 9247 - DNA, 22 bp, synthetic construct
  misc_feature 1..22: note = Description of Artificial Sequence: Syntheticoligonucleotide
  source 1..22: mol_type = other DNA
acgactcagcgctgagtcgtcg

SEQ ID NO: 9248 - DNA, 22 bp, synthetic construct
  misc_feature 1..22: note = Description of Artificial Sequence: Syntheticoligonucleotide
  source 1..22: mol_type = other DNA
gagactcagcgctgagtctccg

SEQ ID NO: 9249 - DNA, 22 bp, synthetic construct
  misc_feature 1..22: note = Description of Artificial Sequence: Syntheticoligonucleotide
  source 1..22: mol_type = other DNA
gcgactcagcgctgagtcgcag

SEQ ID NO: 9250 - DNA, 22 bp, synthetic construct
  misc_feature 1..22: note = Description of Artificial Sequence: Syntheticoligonucleotide
  source 1..22: mol_type = other DNA
gtgactcagcgctgagtcaccg

SEQ ID NO: 9251 - DNA, 22 bp, synthetic construct
  misc_feature 1..22: note = Description of Artificial Sequence: Syntheticoligonucleotide
  source 1..22: mol_type = other DNA
cggactcagcgctgagtccgtg

SEQ ID NO: 9252 - DNA, 22 bp, synthetic construct
  misc_feature 1..22: note = Description of Artificial Sequence: Syntheticoligonucleotide
  source 1..22: mol_type = other DNA
cagactcagcgctgagtctggg

SEQ ID NO: 9253 - DNA, 22 bp, synthetic construct
  misc_feature 1..22: note = Description of Artificial Sequence: Syntheticoligonucleotide
  source 1..22: mol_type = other DNA
cggactcagcgctgagtccgag

SEQ ID NO: 9254 - DNA, 22 bp, synthetic construct
  misc_feature 1..22: note = Description of Artificial Sequence: Syntheticoligonucleotide
  source 1..22: mol_type = other DNA
ctgactcagcgctgagtcaggg

SEQ ID NO: 9255 - DNA, 22 bp, synthetic construct
  misc_feature 1..22: note = Description of Artificial Sequence: Syntheticoligonucleotide
  source 1..22: mol_type = other DNA
acgactcagcgctgagtcgtgg

SEQ ID NO: 9256 - DNA, 22 bp, synthetic construct
  misc_feature 1..22: note = Description of Artificial Sequence: Syntheticoligonucleotide
  source 1..22: mol_type = other DNA
ccgactcagcgctgagtcggct

SEQ ID NO: 9257 - DNA, 22 bp, synthetic construct
  misc_feature 1..22: note = Description of Artificial Sequence: Syntheticoligonucleotide
  source 1..22: mol_type = other DNA
ccgactcagcgctgagtcggca

SEQ ID NO: 9258 - DNA, 22 bp, synthetic construct
  misc_feature 1..22: note = Description of Artificial Sequence: Syntheticoligonucleotide
  source 1..22: mol_type = other DNA
gagactcagcgctgagtctcgc

SEQ ID NO: 9259 - DNA, 22 bp, synthetic construct
  misc_feature 1..22: note = Description of Artificial Sequence: Syntheticoligonucleotide
  source 1..22: mol_type = other DNA
gtgactcagcgctgagtcacgc

SEQ ID NO: 9260 - DNA, 22 bp, synthetic construct
  misc_feature 1..22: note = Description of Artificial Sequence: Syntheticoligonucleotide
  source 1..22: mol_type = other DNA
aggactcagcgctgagtcctgc

SEQ ID NO: 9261 - DNA, 22 bp, synthetic construct
  misc_feature 1..22: note = Description of Artificial Sequence: Syntheticoligonucleotide
  source 1..22: mol_type = other DNA
tggactcagcgctgagtccagc

SEQ ID NO: 9262 - DNA, 22 bp, synthetic construct
  misc_feature 1..22: note = Description of Artificial Sequence: Syntheticoligonucleotide
  source 1..22: mol_type = other DNA
aggactcagcgctgagtcctcg

SEQ ID NO: 9263 - DNA, 22 bp, synthetic construct
  misc_feature 1..22: note = Description of Artificial Sequence: Syntheticoligonucleotide
  source 1..22: mol_type = other DNA
tggactcagcgctgagtccacg

SEQ ID NO: 9264 - DNA, 22 bp, synthetic construct
  misc_feature 1..22: note = Description of Artificial Sequence: Syntheticoligonucleotide
  source 1..22: mol_type = other DNA
ccgactcagcgctgagtcggtg

SEQ ID NO: 9265 - DNA, 22 bp, synthetic construct
  misc_feature 1..22: note = Description of Artificial Sequence: Syntheticoligonucleotide
  source 1..22: mol_type = other DNA
ccgactcagcgctgagtcggag

SEQ ID NO: 9266 - DNA, 22 bp, synthetic construct
  misc_feature 1..22: note = Description of Artificial Sequence: Syntheticoligonucleotide
  source 1..22: mol_type = other DNA
gggactcagcgctgagtcccgc

SEQ ID NO: 9267 - DNA, 22 bp, synthetic construct
  misc_feature 1..22: note = Description of Artificial Sequence: Syntheticoligonucleotide
  source 1..22: mol_type = other DNA
gggactcagcgctgagtccctc

SEQ ID NO: 9268 - DNA, 22 bp, synthetic construct
  misc_feature 1..22: note = Description of Artificial Sequence: Syntheticoligonucleotide
  source 1..22: mol_type = other DNA
gggactcagcgctgagtcccac

SEQ ID NO: 9269 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcaaatttgagtcnnnn

SEQ ID NO: 9270 - DNA, 22 bp, synthetic construct
  misc_feature 1..22: note = Description of Artificial Sequence: Syntheticoligonucleotide
  source 1..22: mol_type = other DNA
cggactcaaatttgagtccgcc

SEQ ID NO: 9271 - DNA, 22 bp, synthetic construct
  misc_feature 1..22: note = Description of Artificial Sequence: Syntheticoligonucleotide
  source 1..22: mol_type = other DNA
cggactcaaatttgagtccgct

SEQ ID NO: 9272 - DNA, 22 bp, synthetic construct
  misc_feature 1..22: note = Description of Artificial Sequence: Syntheticoligonucleotide
  source 1..22: mol_type = other DNA
cggactcaaatttgagtccgtc

SEQ ID NO: 9273 - DNA, 22 bp, synthetic construct
  misc_feature 1..22: note = Description of Artificial Sequence: Syntheticoligonucleotide
  source 1..22: mol_type = other DNA
aggactcaaatttgagtcctcc

SEQ ID NO: 9274 - DNA, 22 bp, synthetic construct
  misc_feature 1..22: note = Description of Artificial Sequence: Syntheticoligonucleotide
  source 1..22: mol_type = other DNA
cagactcaaatttgagtctgcc

SEQ ID NO: 9275 - DNA, 22 bp, synthetic construct
  misc_feature 1..22: note = Description of Artificial Sequence: Syntheticoligonucleotide
  source 1..22: mol_type = other DNA
cggactcaaatttgagtccgca

SEQ ID NO: 9276 - DNA, 22 bp, synthetic construct
  misc_feature 1..22: note = Description of Artificial Sequence: Syntheticoligonucleotide
  source 1..22: mol_type = other DNA
cggactcaaatttgagtccgac

SEQ ID NO: 9277 - DNA, 22 bp, synthetic construct
  misc_feature 1..22: note = Description of Artificial Sequence: Syntheticoligonucleotide
  source 1..22: mol_type = other DNA
tggactcaaatttgagtccacc

SEQ ID NO: 9278 - DNA, 22 bp, synthetic construct
  misc_feature 1..22: note = Description of Artificial Sequence: Syntheticoligonucleotide
  source 1..22: mol_type = other DNA
ctgactcaaatttgagtcagcc

SEQ ID NO: 9279 - DNA, 22 bp, synthetic construct
  misc_feature 1..22: note = Description of Artificial Sequence: Syntheticoligonucleotide
  source 1..22: mol_type = other DNA
ccgactcaaatttgagtcgggc

SEQ ID NO: 9280 - DNA, 22 bp, synthetic construct
  misc_feature 1..22: note = Description of Artificial Sequence: Syntheticoligonucleotide
  source 1..22: mol_type = other DNA
ccgactcaaatttgagtcgggt

SEQ ID NO: 9281 - DNA, 22 bp, synthetic construct
  misc_feature 1..22: note = Description of Artificial Sequence: Syntheticoligonucleotide
  source 1..22: mol_type = other DNA
ccgactcaaatttgagtcggtc

SEQ ID NO: 9282 - DNA, 22 bp, synthetic construct
  misc_feature 1..22: note = Description of Artificial Sequence: Syntheticoligonucleotide
  source 1..22: mol_type = other DNA
acgactcaaatttgagtcgtgc

SEQ ID NO: 9283 - DNA, 22 bp, synthetic construct
  misc_feature 1..22: note = Description of Artificial Sequence: Syntheticoligonucleotide
  source 1..22: mol_type = other DNA
cagactcaaatttgagtctggc

SEQ ID NO: 9284 - DNA, 22 bp, synthetic construct
  misc_feature 1..22: note = Description of Artificial Sequence: Syntheticoligonucleotide
  source 1..22: mol_type = other DNA
ccgactcaaatttgagtcggga

SEQ ID NO: 9285 - DNA, 22 bp, synthetic construct
  misc_feature 1..22: note = Description of Artificial Sequence: Syntheticoligonucleotide
  source 1..22: mol_type = other DNA
ccgactcaaatttgagtcggac

SEQ ID NO: 9286 - DNA, 22 bp, synthetic construct
  misc_feature 1..22: note = Description of Artificial Sequence: Syntheticoligonucleotide
  source 1..22: mol_type = other DNA
ctgactcaaatttgagtcaggc

SEQ ID NO: 9287 - DNA, 22 bp, synthetic construct
  misc_feature 1..22: note = Description of Artificial Sequence: Syntheticoligonucleotide
  source 1..22: mol_type = other DNA
gcgactcaaatttgagtcgccc

SEQ ID NO: 9288 - DNA, 22 bp, synthetic construct
  misc_feature 1..22: note = Description of Artificial Sequence: Syntheticoligonucleotide
  source 1..22: mol_type = other DNA
gcgactcaaatttgagtcgcct

SEQ ID NO: 9289 - DNA, 22 bp, synthetic construct
  misc_feature 1..22: note = Description of Artificial Sequence: Syntheticoligonucleotide
  source 1..22: mol_type = other DNA
gcgactcaaatttgagtcgctc

SEQ ID NO: 9290 - DNA, 22 bp, synthetic construct
  misc_feature 1..22: note = Description of Artificial Sequence: Syntheticoligonucleotide
  source 1..22: mol_type = other DNA
acgactcaaatttgagtcgtcc

SEQ ID NO: 9291 - DNA, 22 bp, synthetic construct
  misc_feature 1..22: note = Description of Artificial Sequence: Syntheticoligonucleotide
  source 1..22: mol_type = other DNA
gagactcaaatttgagtctccc

SEQ ID NO: 9292 - DNA, 22 bp, synthetic construct
  misc_feature 1..22: note = Description of Artificial Sequence: Syntheticoligonucleotide
  source 1..22: mol_type = other DNA
gcgactcaaatttgagtcgcca

SEQ ID NO: 9293 - DNA, 22 bp, synthetic construct
  misc_feature 1..22: note = Description of Artificial Sequence: Syntheticoligonucleotide
  source 1..22: mol_type = other DNA
gcgactcaaatttgagtcgcac

SEQ ID NO: 9294 - DNA, 22 bp, synthetic construct
  misc_feature 1..22: note = Description of Artificial Sequence: Syntheticoligonucleotide
  source 1..22: mol_type = other DNA
gtgactcaaatttgagtcaccc

SEQ ID NO: 9295 - DNA, 22 bp, synthetic construct
  misc_feature 1..22: note = Description of Artificial Sequence: Syntheticoligonucleotide
  source 1..22: mol_type = other DNA
gggactcaaatttgagtcccgt

SEQ ID NO: 9296 - DNA, 22 bp, synthetic construct
  misc_feature 1..22: note = Description of Artificial Sequence: Syntheticoligonucleotide
  source 1..22: mol_type = other DNA
gggactcaaatttgagtccctg

SEQ ID NO: 9297 - DNA, 22 bp, synthetic construct
  misc_feature 1..22: note = Description of Artificial Sequence: Syntheticoligonucleotide
  source 1..22: mol_type = other DNA
aggactcaaatttgagtcctgg

SEQ ID NO: 9298 - DNA, 22 bp, synthetic construct
  misc_feature 1..22: note = Description of Artificial Sequence: Syntheticoligonucleotide
  source 1..22: mol_type = other DNA
gagactcaaatttgagtctcgg

SEQ ID NO: 9299 - DNA, 22 bp, synthetic construct
  misc_feature 1..22: note = Description of Artificial Sequence: Syntheticoligonucleotide
  source 1..22: mol_type = other DNA
gggactcaaatttgagtcccga

SEQ ID NO: 9300 - DNA, 22 bp, synthetic construct
  misc_feature 1..22: note = Description of Artificial Sequence: Syntheticoligonucleotide
  source 1..22: mol_type = other DNA
gggactcaaatttgagtcccag

SEQ ID NO: 9301 - DNA, 22 bp, synthetic construct
  misc_feature 1..22: note = Description of Artificial Sequence: Syntheticoligonucleotide
  source 1..22: mol_type = other DNA
tggactcaaatttgagtccagg

SEQ ID NO: 9302 - DNA, 22 bp, synthetic construct
  misc_feature 1..22: note = Description of Artificial Sequence: Syntheticoligonucleotide
  source 1..22: mol_type = other DNA
gtgactcaaatttgagtcacgg

SEQ ID NO: 9303 - DNA, 22 bp, synthetic construct
  misc_feature 1..22: note = Description of Artificial Sequence: Syntheticoligonucleotide
  source 1..22: mol_type = other DNA
gcgactcaaatttgagtcgccg

SEQ ID NO: 9304 - DNA, 22 bp, synthetic construct
  misc_feature 1..22: note = Description of Artificial Sequence: Syntheticoligonucleotide
  source 1..22: mol_type = other DNA
gcgactcaaatttgagtcgctg

SEQ ID NO: 9305 - DNA, 22 bp, synthetic construct
  misc_feature 1..22: note = Description of Artificial Sequence: Syntheticoligonucleotide
  source 1..22: mol_type = other DNA
acgactcaaatttgagtcgtcg

SEQ ID NO: 9306 - DNA, 22 bp, synthetic construct
  misc_feature 1..22: note = Description of Artificial Sequence: Syntheticoligonucleotide
  source 1..22: mol_type = other DNA
gagactcaaatttgagtctccg

SEQ ID NO: 9307 - DNA, 22 bp, synthetic construct
  misc_feature 1..22: note = Description of Artificial Sequence: Syntheticoligonucleotide
  source 1..22: mol_type = other DNA
gcgactcaaatttgagtcgcag

SEQ ID NO: 9308 - DNA, 22 bp, synthetic construct
  misc_feature 1..22: note = Description of Artificial Sequence: Syntheticoligonucleotide
  source 1..22: mol_type = other DNA
gtgactcaaatttgagtcaccg

SEQ ID NO: 9309 - DNA, 22 bp, synthetic construct
  misc_feature 1..22: note = Description of Artificial Sequence: Syntheticoligonucleotide
  source 1..22: mol_type = other DNA
cggactcaaatttgagtccgtg

SEQ ID NO: 9310 - DNA, 22 bp, synthetic construct
  misc_feature 1..22: note = Description of Artificial Sequence: Syntheticoligonucleotide
  source 1..22: mol_type = other DNA
cagactcaaatttgagtctggg

SEQ ID NO: 9311 - DNA, 22 bp, synthetic construct
  misc_feature 1..22: note = Description of Artificial Sequence: Syntheticoligonucleotide
  source 1..22: mol_type = other DNA
cggactcaaatttgagtccgag

SEQ ID NO: 9312 - DNA, 22 bp, synthetic construct
  misc_feature 1..22: note = Description of Artificial Sequence: Syntheticoligonucleotide
  source 1..22: mol_type = other DNA
ctgactcaaatttgagtcaggg

SEQ ID NO: 9313 - DNA, 22 bp, synthetic construct
  misc_feature 1..22: note = Description of Artificial Sequence: Syntheticoligonucleotide
  source 1..22: mol_type = other DNA
acgactcaaatttgagtcgtgg

SEQ ID NO: 9314 - DNA, 22 bp, synthetic construct
  misc_feature 1..22: note = Description of Artificial Sequence: Syntheticoligonucleotide
  source 1..22: mol_type = other DNA
ccgactcaaatttgagtcggct

SEQ ID NO: 9315 - DNA, 22 bp, synthetic construct
  misc_feature 1..22: note = Description of Artificial Sequence: Syntheticoligonucleotide
  source 1..22: mol_type = other DNA
ccgactcaaatttgagtcggca

SEQ ID NO: 9316 - DNA, 22 bp, synthetic construct
  misc_feature 1..22: note = Description of Artificial Sequence: Syntheticoligonucleotide
  source 1..22: mol_type = other DNA
gagactcaaatttgagtctcgc

SEQ ID NO: 9317 - DNA, 22 bp, synthetic construct
  misc_feature 1..22: note = Description of Artificial Sequence: Syntheticoligonucleotide
  source 1..22: mol_type = other DNA
gtgactcaaatttgagtcacgc

SEQ ID NO: 9318 - DNA, 22 bp, synthetic construct
  misc_feature 1..22: note = Description of Artificial Sequence: Syntheticoligonucleotide
  source 1..22: mol_type = other DNA
aggactcaaatttgagtcctgc

SEQ ID NO: 9319 - DNA, 22 bp, synthetic construct
  misc_feature 1..22: note = Description of Artificial Sequence: Syntheticoligonucleotide
  source 1..22: mol_type = other DNA
tggactcaaatttgagtccagc

SEQ ID NO: 9320 - DNA, 22 bp, synthetic construct
  misc_feature 1..22: note = Description of Artificial Sequence: Syntheticoligonucleotide
  source 1..22: mol_type = other DNA
aggactcaaatttgagtcctcg

SEQ ID NO: 9321 - DNA, 22 bp, synthetic construct
  misc_feature 1..22: note = Description of Artificial Sequence: Syntheticoligonucleotide
  source 1..22: mol_type = other DNA
tggactcaaatttgagtccacg

SEQ ID NO: 9322 - DNA, 22 bp, synthetic construct
  misc_feature 1..22: note = Description of Artificial Sequence: Syntheticoligonucleotide
  source 1..22: mol_type = other DNA
ccgactcaaatttgagtcggtg

SEQ ID NO: 9323 - DNA, 22 bp, synthetic construct
  misc_feature 1..22: note = Description of Artificial Sequence: Syntheticoligonucleotide
  source 1..22: mol_type = other DNA
ccgactcaaatttgagtcggag

SEQ ID NO: 9324 - DNA, 22 bp, synthetic construct
  misc_feature 1..22: note = Description of Artificial Sequence: Syntheticoligonucleotide
  source 1..22: mol_type = other DNA
gggactcaaatttgagtcccgc

SEQ ID NO: 9325 - DNA, 22 bp, synthetic construct
  misc_feature 1..22: note = Description of Artificial Sequence: Syntheticoligonucleotide
  source 1..22: mol_type = other DNA
gggactcaaatttgagtccctc

SEQ ID NO: 9326 - DNA, 22 bp, synthetic construct
  misc_feature 1..22: note = Description of Artificial Sequence: Syntheticoligonucleotide
  source 1..22: mol_type = other DNA
gggactcaaatttgagtcccac

SEQ ID NO: 9327 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcaatattgagtcnnnn

SEQ ID NO: 9328 - DNA, 22 bp, synthetic construct
  misc_feature 1..22: note = Description of Artificial Sequence: Syntheticoligonucleotide
  source 1..22: mol_type = other DNA
cggactcaatattgagtccgcc

SEQ ID NO: 9329 - DNA, 22 bp, synthetic construct
  misc_feature 1..22: note = Description of Artificial Sequence: Syntheticoligonucleotide
  source 1..22: mol_type = other DNA
cggactcaatattgagtccgct

SEQ ID NO: 9330 - DNA, 22 bp, synthetic construct
  misc_feature 1..22: note = Description of Artificial Sequence: Syntheticoligonucleotide
  source 1..22: mol_type = other DNA
cggactcaatattgagtccgtc

SEQ ID NO: 9331 - DNA, 22 bp, synthetic construct
  misc_feature 1..22: note = Description of Artificial Sequence: Syntheticoligonucleotide
  source 1..22: mol_type = other DNA
aggactcaatattgagtcctcc

SEQ ID NO: 9332 - DNA, 22 bp, synthetic construct
  misc_feature 1..22: note = Description of Artificial Sequence: Syntheticoligonucleotide
  source 1..22: mol_type = other DNA
cagactcaatattgagtctgcc

SEQ ID NO: 9333 - DNA, 22 bp, synthetic construct
  misc_feature 1..22: note = Description of Artificial Sequence: Syntheticoligonucleotide
  source 1..22: mol_type = other DNA
cggactcaatattgagtccgca

SEQ ID NO: 9334 - DNA, 22 bp, synthetic construct
  misc_feature 1..22: note = Description of Artificial Sequence: Syntheticoligonucleotide
  source 1..22: mol_type = other DNA
cggactcaatattgagtccgac

SEQ ID NO: 9335 - DNA, 22 bp, synthetic construct
  misc_feature 1..22: note = Description of Artificial Sequence: Syntheticoligonucleotide
  source 1..22: mol_type = other DNA
tggactcaatattgagtccacc

SEQ ID NO: 9336 - DNA, 22 bp, synthetic construct
  misc_feature 1..22: note = Description of Artificial Sequence: Syntheticoligonucleotide
  source 1..22: mol_type = other DNA
ctgactcaatattgagtcagcc

SEQ ID NO: 9337 - DNA, 22 bp, synthetic construct
  misc_feature 1..22: note = Description of Artificial Sequence: Syntheticoligonucleotide
  source 1..22: mol_type = other DNA
ccgactcaatattgagtcgggc

SEQ ID NO: 9338 - DNA, 22 bp, synthetic construct
  misc_feature 1..22: note = Description of Artificial Sequence: Syntheticoligonucleotide
  source 1..22: mol_type = other DNA
ccgactcaatattgagtcgggt

SEQ ID NO: 9339 - DNA, 22 bp, synthetic construct
  misc_feature 1..22: note = Description of Artificial Sequence: Syntheticoligonucleotide
  source 1..22: mol_type = other DNA
ccgactcaatattgagtcggtc

SEQ ID NO: 9340 - DNA, 22 bp, synthetic construct
  misc_feature 1..22: note = Description of Artificial Sequence: Syntheticoligonucleotide
  source 1..22: mol_type = other DNA
acgactcaatattgagtcgtgc

SEQ ID NO: 9341 - DNA, 22 bp, synthetic construct
  misc_feature 1..22: note = Description of Artificial Sequence: Syntheticoligonucleotide
  source 1..22: mol_type = other DNA
cagactcaatattgagtctggc

SEQ ID NO: 9342 - DNA, 22 bp, synthetic construct
  misc_feature 1..22: note = Description of Artificial Sequence: Syntheticoligonucleotide
  source 1..22: mol_type = other DNA
ccgactcaatattgagtcggga

SEQ ID NO: 9343 - DNA, 22 bp, synthetic construct
  misc_feature 1..22: note = Description of Artificial Sequence: Syntheticoligonucleotide
  source 1..22: mol_type = other DNA
ccgactcaatattgagtcggac

SEQ ID NO: 9344 - DNA, 22 bp, synthetic construct
  misc_feature 1..22: note = Description of Artificial Sequence: Syntheticoligonucleotide
  source 1..22: mol_type = other DNA
ctgactcaatattgagtcaggc

SEQ ID NO: 9345 - DNA, 22 bp, synthetic construct
  misc_feature 1..22: note = Description of Artificial Sequence: Syntheticoligonucleotide
  source 1..22: mol_type = other DNA
gcgactcaatattgagtcgccc

SEQ ID NO: 9346 - DNA, 22 bp, synthetic construct
  misc_feature 1..22: note = Description of Artificial Sequence: Syntheticoligonucleotide
  source 1..22: mol_type = other DNA
gcgactcaatattgagtcgcct

SEQ ID NO: 9347 - DNA, 22 bp, synthetic construct
  misc_feature 1..22: note = Description of Artificial Sequence: Syntheticoligonucleotide
  source 1..22: mol_type = other DNA
gcgactcaatattgagtcgctc

SEQ ID NO: 9348 - DNA, 22 bp, synthetic construct
  misc_feature 1..22: note = Description of Artificial Sequence: Syntheticoligonucleotide
  source 1..22: mol_type = other DNA
acgactcaatattgagtcgtcc

SEQ ID NO: 9349 - DNA, 22 bp, synthetic construct
  misc_feature 1..22: note = Description of Artificial Sequence: Syntheticoligonucleotide
  source 1..22: mol_type = other DNA
gagactcaatattgagtctccc

SEQ ID NO: 9350 - DNA, 22 bp, synthetic construct
  misc_feature 1..22: note = Description of Artificial Sequence: Syntheticoligonucleotide
  source 1..22: mol_type = other DNA
gcgactcaatattgagtcgcca

SEQ ID NO: 9351 - DNA, 22 bp, synthetic construct
  misc_feature 1..22: note = Description of Artificial Sequence: Syntheticoligonucleotide
  source 1..22: mol_type = other DNA
gcgactcaatattgagtcgcac

SEQ ID NO: 9352 - DNA, 22 bp, synthetic construct
  misc_feature 1..22: note = Description of Artificial Sequence: Syntheticoligonucleotide
  source 1..22: mol_type = other DNA
gtgactcaatattgagtcaccc

SEQ ID NO: 9353 - DNA, 22 bp, synthetic construct
  misc_feature 1..22: note = Description of Artificial Sequence: Syntheticoligonucleotide
  source 1..22: mol_type = other DNA
gggactcaatattgagtcccgt

SEQ ID NO: 9354 - DNA, 22 bp, synthetic construct
  misc_feature 1..22: note = Description of Artificial Sequence: Syntheticoligonucleotide
  source 1..22: mol_type = other DNA
gggactcaatattgagtccctg

SEQ ID NO: 9355 - DNA, 22 bp, synthetic construct
  misc_feature 1..22: note = Description of Artificial Sequence: Syntheticoligonucleotide
  source 1..22: mol_type = other DNA
aggactcaatattgagtcctgg

SEQ ID NO: 9356 - DNA, 22 bp, synthetic construct
  misc_feature 1..22: note = Description of Artificial Sequence: Syntheticoligonucleotide
  source 1..22: mol_type = other DNA
gagactcaatattgagtctcgg

SEQ ID NO: 9357 - DNA, 22 bp, synthetic construct
  misc_feature 1..22: note = Description of Artificial Sequence: Syntheticoligonucleotide
  source 1..22: mol_type = other DNA
gggactcaatattgagtcccga

SEQ ID NO: 9358 - DNA, 22 bp, synthetic construct
  misc_feature 1..22: note = Description of Artificial Sequence: Syntheticoligonucleotide
  source 1..22: mol_type = other DNA
gggactcaatattgagtcccag

SEQ ID NO: 9359 - DNA, 22 bp, synthetic construct
  misc_feature 1..22: note = Description of Artificial Sequence: Syntheticoligonucleotide
  source 1..22: mol_type = other DNA
tggactcaatattgagtccagg

SEQ ID NO: 9360 - DNA, 22 bp, synthetic construct
  misc_feature 1..22: note = Description of Artificial Sequence: Syntheticoligonucleotide
  source 1..22: mol_type = other DNA
gtgactcaatattgagtcacgg

SEQ ID NO: 9361 - DNA, 22 bp, synthetic construct
  misc_feature 1..22: note = Description of Artificial Sequence: Syntheticoligonucleotide
  source 1..22: mol_type = other DNA
gcgactcaatattgagtcgccg

SEQ ID NO: 9362 - DNA, 22 bp, synthetic construct
  misc_feature 1..22: note = Description of Artificial Sequence: Syntheticoligonucleotide
  source 1..22: mol_type = other DNA
gcgactcaatattgagtcgctg

SEQ ID NO: 9363 - DNA, 22 bp, synthetic construct
  misc_feature 1..22: note = Description of Artificial Sequence: Syntheticoligonucleotide
  source 1..22: mol_type = other DNA
acgactcaatattgagtcgtcg

SEQ ID NO: 9364 - DNA, 22 bp, synthetic construct
  misc_feature 1..22: note = Description of Artificial Sequence: Syntheticoligonucleotide
  source 1..22: mol_type = other DNA
gagactcaatattgagtctccg

SEQ ID NO: 9365 - DNA, 22 bp, synthetic construct
  misc_feature 1..22: note = Description of Artificial Sequence: Syntheticoligonucleotide
  source 1..22: mol_type = other DNA
gcgactcaatattgagtcgcag

SEQ ID NO: 9366 - DNA, 22 bp, synthetic construct
  misc_feature 1..22: note = Description of Artificial Sequence: Syntheticoligonucleotide
  source 1..22: mol_type = other DNA
gtgactcaatattgagtcaccg

SEQ ID NO: 9367 - DNA, 22 bp, synthetic construct
  misc_feature 1..22: note = Description of Artificial Sequence: Syntheticoligonucleotide
  source 1..22: mol_type = other DNA
cggactcaatattgagtccgtg

SEQ ID NO: 9368 - DNA, 22 bp, synthetic construct
  misc_feature 1..22: note = Description of Artificial Sequence: Syntheticoligonucleotide
  source 1..22: mol_type = other DNA
cagactcaatattgagtctggg

SEQ ID NO: 9369 - DNA, 22 bp, synthetic construct
  misc_feature 1..22: note = Description of Artificial Sequence: Syntheticoligonucleotide
  source 1..22: mol_type = other DNA
cggactcaatattgagtccgag

SEQ ID NO: 9370 - DNA, 22 bp, synthetic construct
  misc_feature 1..22: note = Description of Artificial Sequence: Syntheticoligonucleotide
  source 1..22: mol_type = other DNA
ctgactcaatattgagtcaggg

SEQ ID NO: 9371 - DNA, 22 bp, synthetic construct
  misc_feature 1..22: note = Description of Artificial Sequence: Syntheticoligonucleotide
  source 1..22: mol_type = other DNA
acgactcaatattgagtcgtgg

SEQ ID NO: 9372 - DNA, 22 bp, synthetic construct
  misc_feature 1..22: note = Description of Artificial Sequence: Syntheticoligonucleotide
  source 1..22: mol_type = other DNA
ccgactcaatattgagtcggct

SEQ ID NO: 9373 - DNA, 22 bp, synthetic construct
  misc_feature 1..22: note = Description of Artificial Sequence: Syntheticoligonucleotide
  source 1..22: mol_type = other DNA
ccgactcaatattgagtcggca

SEQ ID NO: 9374 - DNA, 22 bp, synthetic construct
  misc_feature 1..22: note = Description of Artificial Sequence: Syntheticoligonucleotide
  source 1..22: mol_type = other DNA
gagactcaatattgagtctcgc

SEQ ID NO: 9375 - DNA, 22 bp, synthetic construct
  misc_feature 1..22: note = Description of Artificial Sequence: Syntheticoligonucleotide
  source 1..22: mol_type = other DNA
gtgactcaatattgagtcacgc

SEQ ID NO: 9376 - DNA, 22 bp, synthetic construct
  misc_feature 1..22: note = Description of Artificial Sequence: Syntheticoligonucleotide
  source 1..22: mol_type = other DNA
aggactcaatattgagtcctgc

SEQ ID NO: 9377 - DNA, 22 bp, synthetic construct
  misc_feature 1..22: note = Description of Artificial Sequence: Syntheticoligonucleotide
  source 1..22: mol_type = other DNA
tggactcaatattgagtccagc

SEQ ID NO: 9378 - DNA, 22 bp, synthetic construct
  misc_feature 1..22: note = Description of Artificial Sequence: Syntheticoligonucleotide
  source 1..22: mol_type = other DNA
aggactcaatattgagtcctcg

SEQ ID NO: 9379 - DNA, 22 bp, synthetic construct
  misc_feature 1..22: note = Description of Artificial Sequence: Syntheticoligonucleotide
  source 1..22: mol_type = other DNA
tggactcaatattgagtccacg

SEQ ID NO: 9380 - DNA, 22 bp, synthetic construct
  misc_feature 1..22: note = Description of Artificial Sequence: Syntheticoligonucleotide
  source 1..22: mol_type = other DNA
ccgactcaatattgagtcggtg

SEQ ID NO: 9381 - DNA, 22 bp, synthetic construct
  misc_feature 1..22: note = Description of Artificial Sequence: Syntheticoligonucleotide
  source 1..22: mol_type = other DNA
ccgactcaatattgagtcggag

SEQ ID NO: 9382 - DNA, 22 bp, synthetic construct
  misc_feature 1..22: note = Description of Artificial Sequence: Syntheticoligonucleotide
  source 1..22: mol_type = other DNA
gggactcaatattgagtcccgc

SEQ ID NO: 9383 - DNA, 22 bp, synthetic construct
  misc_feature 1..22: note = Description of Artificial Sequence: Syntheticoligonucleotide
  source 1..22: mol_type = other DNA
gggactcaatattgagtccctc

SEQ ID NO: 9384 - DNA, 22 bp, synthetic construct
  misc_feature 1..22: note = Description of Artificial Sequence: Syntheticoligonucleotide
  source 1..22: mol_type = other DNA
gggactcaatattgagtcccac

SEQ ID NO: 9385 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcaagcttgagtcnnnn

SEQ ID NO: 9386 - DNA, 22 bp, synthetic construct
  misc_feature 1..22: note = Description of Artificial Sequence: Syntheticoligonucleotide
  source 1..22: mol_type = other DNA
cggactcaagcttgagtccgcc

SEQ ID NO: 9387 - DNA, 22 bp, synthetic construct
  misc_feature 1..22: note = Description of Artificial Sequence: Syntheticoligonucleotide
  source 1..22: mol_type = other DNA
cggactcaagcttgagtccgct

SEQ ID NO: 9388 - DNA, 22 bp, synthetic construct
  misc_feature 1..22: note = Description of Artificial Sequence: Syntheticoligonucleotide
  source 1..22: mol_type = other DNA
cggactcaagcttgagtccgtc

SEQ ID NO: 9389 - DNA, 22 bp, synthetic construct
  misc_feature 1..22: note = Description of Artificial Sequence: Syntheticoligonucleotide
  source 1..22: mol_type = other DNA
aggactcaagcttgagtcctcc

SEQ ID NO: 9390 - DNA, 22 bp, synthetic construct
  misc_feature 1..22: note = Description of Artificial Sequence: Syntheticoligonucleotide
  source 1..22: mol_type = other DNA
cagactcaagcttgagtctgcc

SEQ ID NO: 9391 - DNA, 22 bp, synthetic construct
  misc_feature 1..22: note = Description of Artificial Sequence: Syntheticoligonucleotide
  source 1..22: mol_type = other DNA
cggactcaagcttgagtccgca

SEQ ID NO: 9392 - DNA, 22 bp, synthetic construct
  misc_feature 1..22: note = Description of Artificial Sequence: Syntheticoligonucleotide
  source 1..22: mol_type = other DNA
cggactcaagcttgagtccgac

SEQ ID NO: 9393 - DNA, 22 bp, synthetic construct
  misc_feature 1..22: note = Description of Artificial Sequence: Syntheticoligonucleotide
  source 1..22: mol_type = other DNA
tggactcaagcttgagtccacc

SEQ ID NO: 9394 - DNA, 22 bp, synthetic construct
  misc_feature 1..22: note = Description of Artificial Sequence: Syntheticoligonucleotide
  source 1..22: mol_type = other DNA
ctgactcaagcttgagtcagcc

SEQ ID NO: 9395 - DNA, 22 bp, synthetic construct
  misc_feature 1..22: note = Description of Artificial Sequence: Syntheticoligonucleotide
  source 1..22: mol_type = other DNA
ccgactcaagcttgagtcgggc

SEQ ID NO: 9396 - DNA, 22 bp, synthetic construct
  misc_feature 1..22: note = Description of Artificial Sequence: Syntheticoligonucleotide
  source 1..22: mol_type = other DNA
ccgactcaagcttgagtcgggt

SEQ ID NO: 9397 - DNA, 22 bp, synthetic construct
  misc_feature 1..22: note = Description of Artificial Sequence: Syntheticoligonucleotide
  source 1..22: mol_type = other DNA
ccgactcaagcttgagtcggtc

SEQ ID NO: 9398 - DNA, 22 bp, synthetic construct
  misc_feature 1..22: note = Description of Artificial Sequence: Syntheticoligonucleotide
  source 1..22: mol_type = other DNA
acgactcaagcttgagtcgtgc

SEQ ID NO: 9399 - DNA, 22 bp, synthetic construct
  misc_feature 1..22: note = Description of Artificial Sequence: Syntheticoligonucleotide
  source 1..22: mol_type = other DNA
cagactcaagcttgagtctggc

SEQ ID NO: 9400 - DNA, 22 bp, synthetic construct
  misc_feature 1..22: note = Description of Artificial Sequence: Syntheticoligonucleotide
  source 1..22: mol_type = other DNA
ccgactcaagcttgagtcggga

SEQ ID NO: 9401 - DNA, 22 bp, synthetic construct
  misc_feature 1..22: note = Description of Artificial Sequence: Syntheticoligonucleotide
  source 1..22: mol_type = other DNA
ccgactcaagcttgagtcggac

SEQ ID NO: 9402 - DNA, 22 bp, synthetic construct
  misc_feature 1..22: note = Description of Artificial Sequence: Syntheticoligonucleotide
  source 1..22: mol_type = other DNA
ctgactcaagcttgagtcaggc

SEQ ID NO: 9403 - DNA, 22 bp, synthetic construct
  misc_feature 1..22: note = Description of Artificial Sequence: Syntheticoligonucleotide
  source 1..22: mol_type = other DNA
gcgactcaagcttgagtcgccc

SEQ ID NO: 9404 - DNA, 22 bp, synthetic construct
  misc_feature 1..22: note = Description of Artificial Sequence: Syntheticoligonucleotide
  source 1..22: mol_type = other DNA
gcgactcaagcttgagtcgcct

SEQ ID NO: 9405 - DNA, 22 bp, synthetic construct
  misc_feature 1..22: note = Description of Artificial Sequence: Syntheticoligonucleotide
  source 1..22: mol_type = other DNA
gcgactcaagcttgagtcgctc

SEQ ID NO: 9406 - DNA, 22 bp, synthetic construct
  misc_feature 1..22: note = Description of Artificial Sequence: Syntheticoligonucleotide
  source 1..22: mol_type = other DNA
acgactcaagcttgagtcgtcc

SEQ ID NO: 9407 - DNA, 22 bp, synthetic construct
  misc_feature 1..22: note = Description of Artificial Sequence: Syntheticoligonucleotide
  source 1..22: mol_type = other DNA
gagactcaagcttgagtctccc

SEQ ID NO: 9408 - DNA, 22 bp, synthetic construct
  misc_feature 1..22: note = Description of Artificial Sequence: Syntheticoligonucleotide
  source 1..22: mol_type = other DNA
gcgactcaagcttgagtcgcca

SEQ ID NO: 9409 - DNA, 22 bp, synthetic construct
  misc_feature 1..22: note = Description of Artificial Sequence: Syntheticoligonucleotide
  source 1..22: mol_type = other DNA
gcgactcaagcttgagtcgcac

SEQ ID NO: 9410 - DNA, 22 bp, synthetic construct
  misc_feature 1..22: note = Description of Artificial Sequence: Syntheticoligonucleotide
  source 1..22: mol_type = other DNA
gtgactcaagcttgagtcaccc

SEQ ID NO: 9411 - DNA, 22 bp, synthetic construct
  misc_feature 1..22: note = Description of Artificial Sequence: Syntheticoligonucleotide
  source 1..22: mol_type = other DNA
gggactcaagcttgagtcccgt

SEQ ID NO: 9412 - DNA, 22 bp, synthetic construct
  misc_feature 1..22: note = Description of Artificial Sequence: Syntheticoligonucleotide
  source 1..22: mol_type = other DNA
gggactcaagcttgagtccctg

SEQ ID NO: 9413 - DNA, 22 bp, synthetic construct
  misc_feature 1..22: note = Description of Artificial Sequence: Syntheticoligonucleotide
  source 1..22: mol_type = other DNA
aggactcaagcttgagtcctgg

SEQ ID NO: 9414 - DNA, 22 bp, synthetic construct
  misc_feature 1..22: note = Description of Artificial Sequence: Syntheticoligonucleotide
  source 1..22: mol_type = other DNA
gagactcaagcttgagtctcgg

SEQ ID NO: 9415 - DNA, 22 bp, synthetic construct
  misc_feature 1..22: note = Description of Artificial Sequence: Syntheticoligonucleotide
  source 1..22: mol_type = other DNA
gggactcaagcttgagtcccga

SEQ ID NO: 9416 - DNA, 22 bp, synthetic construct
  misc_feature 1..22: note = Description of Artificial Sequence: Syntheticoligonucleotide
  source 1..22: mol_type = other DNA
gggactcaagcttgagtcccag

SEQ ID NO: 9417 - DNA, 22 bp, synthetic construct
  misc_feature 1..22: note = Description of Artificial Sequence: Syntheticoligonucleotide
  source 1..22: mol_type = other DNA
tggactcaagcttgagtccagg

SEQ ID NO: 9418 - DNA, 22 bp, synthetic construct
  misc_feature 1..22: note = Description of Artificial Sequence: Syntheticoligonucleotide
  source 1..22: mol_type = other DNA
gtgactcaagcttgagtcacgg

SEQ ID NO: 9419 - DNA, 22 bp, synthetic construct
  misc_feature 1..22: note = Description of Artificial Sequence: Syntheticoligonucleotide
  source 1..22: mol_type = other DNA
gcgactcaagcttgagtcgccg

SEQ ID NO: 9420 - DNA, 22 bp, synthetic construct
  misc_feature 1..22: note = Description of Artificial Sequence: Syntheticoligonucleotide
  source 1..22: mol_type = other DNA
gcgactcaagcttgagtcgctg

SEQ ID NO: 9421 - DNA, 22 bp, synthetic construct
  misc_feature 1..22: note = Description of Artificial Sequence: Syntheticoligonucleotide
  source 1..22: mol_type = other DNA
acgactcaagcttgagtcgtcg

SEQ ID NO: 9422 - DNA, 22 bp, synthetic construct
  misc_feature 1..22: note = Description of Artificial Sequence: Syntheticoligonucleotide
  source 1..22: mol_type = other DNA
gagactcaagcttgagtctccg

SEQ ID NO: 9423 - DNA, 22 bp, synthetic construct
  misc_feature 1..22: note = Description of Artificial Sequence: Syntheticoligonucleotide
  source 1..22: mol_type = other DNA
gcgactcaagcttgagtcgcag

SEQ ID NO: 9424 - DNA, 22 bp, synthetic construct
  misc_feature 1..22: note = Description of Artificial Sequence: Syntheticoligonucleotide
  source 1..22: mol_type = other DNA
gtgactcaagcttgagtcaccg

SEQ ID NO: 9425 - DNA, 22 bp, synthetic construct
  misc_feature 1..22: note = Description of Artificial Sequence: Syntheticoligonucleotide
  source 1..22: mol_type = other DNA
cggactcaagcttgagtccgtg

SEQ ID NO: 9426 - DNA, 22 bp, synthetic construct
  misc_feature 1..22: note = Description of Artificial Sequence: Syntheticoligonucleotide
  source 1..22: mol_type = other DNA
cagactcaagcttgagtctggg

SEQ ID NO: 9427 - DNA, 22 bp, synthetic construct
  misc_feature 1..22: note = Description of Artificial Sequence: Syntheticoligonucleotide
  source 1..22: mol_type = other DNA
cggactcaagcttgagtccgag

SEQ ID NO: 9428 - DNA, 22 bp, synthetic construct
  misc_feature 1..22: note = Description of Artificial Sequence: Syntheticoligonucleotide
  source 1..22: mol_type = other DNA
ctgactcaagcttgagtcaggg

SEQ ID NO: 9429 - DNA, 22 bp, synthetic construct
  misc_feature 1..22: note = Description of Artificial Sequence: Syntheticoligonucleotide
  source 1..22: mol_type = other DNA
acgactcaagcttgagtcgtgg

SEQ ID NO: 9430 - DNA, 22 bp, synthetic construct
  misc_feature 1..22: note = Description of Artificial Sequence: Syntheticoligonucleotide
  source 1..22: mol_type = other DNA
ccgactcaagcttgagtcggct

SEQ ID NO: 9431 - DNA, 22 bp, synthetic construct
  misc_feature 1..22: note = Description of Artificial Sequence: Syntheticoligonucleotide
  source 1..22: mol_type = other DNA
ccgactcaagcttgagtcggca

SEQ ID NO: 9432 - DNA, 22 bp, synthetic construct
  misc_feature 1..22: note = Description of Artificial Sequence: Syntheticoligonucleotide
  source 1..22: mol_type = other DNA
gagactcaagcttgagtctcgc

SEQ ID NO: 9433 - DNA, 22 bp, synthetic construct
  misc_feature 1..22: note = Description of Artificial Sequence: Syntheticoligonucleotide
  source 1..22: mol_type = other DNA
gtgactcaagcttgagtcacgc

SEQ ID NO: 9434 - DNA, 22 bp, synthetic construct
  misc_feature 1..22: note = Description of Artificial Sequence: Syntheticoligonucleotide
  source 1..22: mol_type = other DNA
aggactcaagcttgagtcctgc

SEQ ID NO: 9435 - DNA, 22 bp, synthetic construct
  misc_feature 1..22: note = Description of Artificial Sequence: Syntheticoligonucleotide
  source 1..22: mol_type = other DNA
tggactcaagcttgagtccagc

SEQ ID NO: 9436 - DNA, 22 bp, synthetic construct
  misc_feature 1..22: note = Description of Artificial Sequence: Syntheticoligonucleotide
  source 1..22: mol_type = other DNA
aggactcaagcttgagtcctcg

SEQ ID NO: 9437 - DNA, 22 bp, synthetic construct
  misc_feature 1..22: note = Description of Artificial Sequence: Syntheticoligonucleotide
  source 1..22: mol_type = other DNA
tggactcaagcttgagtccacg

SEQ ID NO: 9438 - DNA, 22 bp, synthetic construct
  misc_feature 1..22: note = Description of Artificial Sequence: Syntheticoligonucleotide
  source 1..22: mol_type = other DNA
ccgactcaagcttgagtcggtg

SEQ ID NO: 9439 - DNA, 22 bp, synthetic construct
  misc_feature 1..22: note = Description of Artificial Sequence: Syntheticoligonucleotide
  source 1..22: mol_type = other DNA
ccgactcaagcttgagtcggag

SEQ ID NO: 9440 - DNA, 22 bp, synthetic construct
  misc_feature 1..22: note = Description of Artificial Sequence: Syntheticoligonucleotide
  source 1..22: mol_type = other DNA
gggactcaagcttgagtcccgc

SEQ ID NO: 9441 - DNA, 22 bp, synthetic construct
  misc_feature 1..22: note = Description of Artificial Sequence: Syntheticoligonucleotide
  source 1..22: mol_type = other DNA
gggactcaagcttgagtccctc

SEQ ID NO: 9442 - DNA, 22 bp, synthetic construct
  misc_feature 1..22: note = Description of Artificial Sequence: Syntheticoligonucleotide
  source 1..22: mol_type = other DNA
gggactcaagcttgagtcccac

SEQ ID NO: 9443 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcaacgttgagtcnnnn

SEQ ID NO: 9444 - DNA, 22 bp, synthetic construct
  misc_feature 1..22: note = Description of Artificial Sequence: Syntheticoligonucleotide
  source 1..22: mol_type = other DNA
cggactcaacgttgagtccgcc

SEQ ID NO: 9445 - DNA, 22 bp, synthetic construct
  misc_feature 1..22: note = Description of Artificial Sequence: Syntheticoligonucleotide
  source 1..22: mol_type = other DNA
cggactcaacgttgagtccgct

SEQ ID NO: 9446 - DNA, 22 bp, synthetic construct
  misc_feature 1..22: note = Description of Artificial Sequence: Syntheticoligonucleotide
  source 1..22: mol_type = other DNA
cggactcaacgttgagtccgtc

SEQ ID NO: 9447 - DNA, 22 bp, synthetic construct
  misc_feature 1..22: note = Description of Artificial Sequence: Syntheticoligonucleotide
  source 1..22: mol_type = other DNA
aggactcaacgttgagtcctcc

SEQ ID NO: 9448 - DNA, 22 bp, synthetic construct
  misc_feature 1..22: note = Description of Artificial Sequence: Syntheticoligonucleotide
  source 1..22: mol_type = other DNA
cagactcaacgttgagtctgcc

SEQ ID NO: 9449 - DNA, 22 bp, synthetic construct
  misc_feature 1..22: note = Description of Artificial Sequence: Syntheticoligonucleotide
  source 1..22: mol_type = other DNA
cggactcaacgttgagtccgca

SEQ ID NO: 9450 - DNA, 22 bp, synthetic construct
  misc_feature 1..22: note = Description of Artificial Sequence: Syntheticoligonucleotide
  source 1..22: mol_type = other DNA
cggactcaacgttgagtccgac

SEQ ID NO: 9451 - DNA, 22 bp, synthetic construct
  misc_feature 1..22: note = Description of Artificial Sequence: Syntheticoligonucleotide
  source 1..22: mol_type = other DNA
tggactcaacgttgagtccacc

SEQ ID NO: 9452 - DNA, 22 bp, synthetic construct
  misc_feature 1..22: note = Description of Artificial Sequence: Syntheticoligonucleotide
  source 1..22: mol_type = other DNA
ctgactcaacgttgagtcagcc

SEQ ID NO: 9453 - DNA, 22 bp, synthetic construct
  misc_feature 1..22: note = Description of Artificial Sequence: Syntheticoligonucleotide
  source 1..22: mol_type = other DNA
ccgactcaacgttgagtcgggc

SEQ ID NO: 9454 - DNA, 22 bp, synthetic construct
  misc_feature 1..22: note = Description of Artificial Sequence: Syntheticoligonucleotide
  source 1..22: mol_type = other DNA
ccgactcaacgttgagtcgggt

SEQ ID NO: 9455 - DNA, 22 bp, synthetic construct
  misc_feature 1..22: note = Description of Artificial Sequence: Syntheticoligonucleotide
  source 1..22: mol_type = other DNA
ccgactcaacgttgagtcggtc

SEQ ID NO: 9456 - DNA, 22 bp, synthetic construct
  misc_feature 1..22: note = Description of Artificial Sequence: Syntheticoligonucleotide
  source 1..22: mol_type = other DNA
acgactcaacgttgagtcgtgc

SEQ ID NO: 9457 - DNA, 22 bp, synthetic construct
  misc_feature 1..22: note = Description of Artificial Sequence: Syntheticoligonucleotide
  source 1..22: mol_type = other DNA
cagactcaacgttgagtctggc

SEQ ID NO: 9458 - DNA, 22 bp, synthetic construct
  misc_feature 1..22: note = Description of Artificial Sequence: Syntheticoligonucleotide
  source 1..22: mol_type = other DNA
ccgactcaacgttgagtcggga

SEQ ID NO: 9459 - DNA, 22 bp, synthetic construct
  misc_feature 1..22: note = Description of Artificial Sequence: Syntheticoligonucleotide
  source 1..22: mol_type = other DNA
ccgactcaacgttgagtcggac

SEQ ID NO: 9460 - DNA, 22 bp, synthetic construct
  misc_feature 1..22: note = Description of Artificial Sequence: Syntheticoligonucleotide
  source 1..22: mol_type = other DNA
ctgactcaacgttgagtcaggc

SEQ ID NO: 9461 - DNA, 22 bp, synthetic construct
  misc_feature 1..22: note = Description of Artificial Sequence: Syntheticoligonucleotide
  source 1..22: mol_type = other DNA
gcgactcaacgttgagtcgccc

SEQ ID NO: 9462 - DNA, 22 bp, synthetic construct
  misc_feature 1..22: note = Description of Artificial Sequence: Syntheticoligonucleotide
  source 1..22: mol_type = other DNA
gcgactcaacgttgagtcgcct

SEQ ID NO: 9463 - DNA, 22 bp, synthetic construct
  misc_feature 1..22: note = Description of Artificial Sequence: Syntheticoligonucleotide
  source 1..22: mol_type = other DNA
gcgactcaacgttgagtcgctc

SEQ ID NO: 9464 - DNA, 22 bp, synthetic construct
  misc_feature 1..22: note = Description of Artificial Sequence: Syntheticoligonucleotide
  source 1..22: mol_type = other DNA
acgactcaacgttgagtcgtcc

SEQ ID NO: 9465 - DNA, 22 bp, synthetic construct
  misc_feature 1..22: note = Description of Artificial Sequence: Syntheticoligonucleotide
  source 1..22: mol_type = other DNA
gagactcaacgttgagtctccc

SEQ ID NO: 9466 - DNA, 22 bp, synthetic construct
  misc_feature 1..22: note = Description of Artificial Sequence: Syntheticoligonucleotide
  source 1..22: mol_type = other DNA
gcgactcaacgttgagtcgcca

SEQ ID NO: 9467 - DNA, 22 bp, synthetic construct
  misc_feature 1..22: note = Description of Artificial Sequence: Syntheticoligonucleotide
  source 1..22: mol_type = other DNA
gcgactcaacgttgagtcgcac

SEQ ID NO: 9468 - DNA, 22 bp, synthetic construct
  misc_feature 1..22: note = Description of Artificial Sequence: Syntheticoligonucleotide
  source 1..22: mol_type = other DNA
gtgactcaacgttgagtcaccc

SEQ ID NO: 9469 - DNA, 22 bp, synthetic construct
  misc_feature 1..22: note = Description of Artificial Sequence: Syntheticoligonucleotide
  source 1..22: mol_type = other DNA
gggactcaacgttgagtcccgt

SEQ ID NO: 9470 - DNA, 22 bp, synthetic construct
  misc_feature 1..22: note = Description of Artificial Sequence: Syntheticoligonucleotide
  source 1..22: mol_type = other DNA
gggactcaacgttgagtccctg

SEQ ID NO: 9471 - DNA, 22 bp, synthetic construct
  misc_feature 1..22: note = Description of Artificial Sequence: Syntheticoligonucleotide
  source 1..22: mol_type = other DNA
aggactcaacgttgagtcctgg

SEQ ID NO: 9472 - DNA, 22 bp, synthetic construct
  misc_feature 1..22: note = Description of Artificial Sequence: Syntheticoligonucleotide
  source 1..22: mol_type = other DNA
gagactcaacgttgagtctcgg

SEQ ID NO: 9473 - DNA, 22 bp, synthetic construct
  misc_feature 1..22: note = Description of Artificial Sequence: Syntheticoligonucleotide
  source 1..22: mol_type = other DNA
gggactcaacgttgagtcccga

SEQ ID NO: 9474 - DNA, 22 bp, synthetic construct
  misc_feature 1..22: note = Description of Artificial Sequence: Syntheticoligonucleotide
  source 1..22: mol_type = other DNA
gggactcaacgttgagtcccag

SEQ ID NO: 9475 - DNA, 22 bp, synthetic construct
  misc_feature 1..22: note = Description of Artificial Sequence: Syntheticoligonucleotide
  source 1..22: mol_type = other DNA
tggactcaacgttgagtccagg

SEQ ID NO: 9476 - DNA, 22 bp, synthetic construct
  misc_feature 1..22: note = Description of Artificial Sequence: Syntheticoligonucleotide
  source 1..22: mol_type = other DNA
gtgactcaacgttgagtcacgg

SEQ ID NO: 9477 - DNA, 22 bp, synthetic construct
  misc_feature 1..22: note = Description of Artificial Sequence: Syntheticoligonucleotide
  source 1..22: mol_type = other DNA
gcgactcaacgttgagtcgccg

SEQ ID NO: 9478 - DNA, 22 bp, synthetic construct
  misc_feature 1..22: note = Description of Artificial Sequence: Syntheticoligonucleotide
  source 1..22: mol_type = other DNA
gcgactcaacgttgagtcgctg

SEQ ID NO: 9479 - DNA, 22 bp, synthetic construct
  misc_feature 1..22: note = Description of Artificial Sequence: Syntheticoligonucleotide
  source 1..22: mol_type = other DNA
acgactcaacgttgagtcgtcg

SEQ ID NO: 9480 - DNA, 22 bp, synthetic construct
  misc_feature 1..22: note = Description of Artificial Sequence: Syntheticoligonucleotide
  source 1..22: mol_type = other DNA
gagactcaacgttgagtctccg

SEQ ID NO: 9481 - DNA, 22 bp, synthetic construct
  misc_feature 1..22: note = Description of Artificial Sequence: Syntheticoligonucleotide
  source 1..22: mol_type = other DNA
gcgactcaacgttgagtcgcag

SEQ ID NO: 9482 - DNA, 22 bp, synthetic construct
  misc_feature 1..22: note = Description of Artificial Sequence: Syntheticoligonucleotide
  source 1..22: mol_type = other DNA
gtgactcaacgttgagtcaccg

SEQ ID NO: 9483 - DNA, 22 bp, synthetic construct
  misc_feature 1..22: note = Description of Artificial Sequence: Syntheticoligonucleotide
  source 1..22: mol_type = other DNA
cggactcaacgttgagtccgtg

SEQ ID NO: 9484 - DNA, 22 bp, synthetic construct
  misc_feature 1..22: note = Description of Artificial Sequence: Syntheticoligonucleotide
  source 1..22: mol_type = other DNA
cagactcaacgttgagtctggg

SEQ ID NO: 9485 - DNA, 22 bp, synthetic construct
  misc_feature 1..22: note = Description of Artificial Sequence: Syntheticoligonucleotide
  source 1..22: mol_type = other DNA
cggactcaacgttgagtccgag

SEQ ID NO: 9486 - DNA, 22 bp, synthetic construct
  misc_feature 1..22: note = Description of Artificial Sequence: Syntheticoligonucleotide
  source 1..22: mol_type = other DNA
ctgactcaacgttgagtcaggg

SEQ ID NO: 9487 - DNA, 22 bp, synthetic construct
  misc_feature 1..22: note = Description of Artificial Sequence: Syntheticoligonucleotide
  source 1..22: mol_type = other DNA
acgactcaacgttgagtcgtgg

SEQ ID NO: 9488 - DNA, 22 bp, synthetic construct
  misc_feature 1..22: note = Description of Artificial Sequence: Syntheticoligonucleotide
  source 1..22: mol_type = other DNA
ccgactcaacgttgagtcggct

SEQ ID NO: 9489 - DNA, 22 bp, synthetic construct
  misc_feature 1..22: note = Description of Artificial Sequence: Syntheticoligonucleotide
  source 1..22: mol_type = other DNA
ccgactcaacgttgagtcggca

SEQ ID NO: 9490 - DNA, 22 bp, synthetic construct
  misc_feature 1..22: note = Description of Artificial Sequence: Syntheticoligonucleotide
  source 1..22: mol_type = other DNA
gagactcaacgttgagtctcgc

SEQ ID NO: 9491 - DNA, 22 bp, synthetic construct
  misc_feature 1..22: note = Description of Artificial Sequence: Syntheticoligonucleotide
  source 1..22: mol_type = other DNA
gtgactcaacgttgagtcacgc

SEQ ID NO: 9492 - DNA, 22 bp, synthetic construct
  misc_feature 1..22: note = Description of Artificial Sequence: Syntheticoligonucleotide
  source 1..22: mol_type = other DNA
aggactcaacgttgagtcctgc

SEQ ID NO: 9493 - DNA, 22 bp, synthetic construct
  misc_feature 1..22: note = Description of Artificial Sequence: Syntheticoligonucleotide
  source 1..22: mol_type = other DNA
tggactcaacgttgagtccagc

SEQ ID NO: 9494 - DNA, 22 bp, synthetic construct
  misc_feature 1..22: note = Description of Artificial Sequence: Syntheticoligonucleotide
  source 1..22: mol_type = other DNA
aggactcaacgttgagtcctcg

SEQ ID NO: 9495 - DNA, 22 bp, synthetic construct
  misc_feature 1..22: note = Description of Artificial Sequence: Syntheticoligonucleotide
  source 1..22: mol_type = other DNA
tggactcaacgttgagtccacg

SEQ ID NO: 9496 - DNA, 22 bp, synthetic construct
  misc_feature 1..22: note = Description of Artificial Sequence: Syntheticoligonucleotide
  source 1..22: mol_type = other DNA
ccgactcaacgttgagtcggtg

SEQ ID NO: 9497 - DNA, 22 bp, synthetic construct
  misc_feature 1..22: note = Description of Artificial Sequence: Syntheticoligonucleotide
  source 1..22: mol_type = other DNA
ccgactcaacgttgagtcggag

SEQ ID NO: 9498 - DNA, 22 bp, synthetic construct
  misc_feature 1..22: note = Description of Artificial Sequence: Syntheticoligonucleotide
  source 1..22: mol_type = other DNA
gggactcaacgttgagtcccgc

SEQ ID NO: 9499 - DNA, 22 bp, synthetic construct
  misc_feature 1..22: note = Description of Artificial Sequence: Syntheticoligonucleotide
  source 1..22: mol_type = other DNA
gggactcaacgttgagtccctc

SEQ ID NO: 9500 - DNA, 22 bp, synthetic construct
  misc_feature 1..22: note = Description of Artificial Sequence: Syntheticoligonucleotide
  source 1..22: mol_type = other DNA
gggactcaacgttgagtcccac

SEQ ID NO: 9501 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactctaattagagtcnnnn

SEQ ID NO: 9502 - DNA, 22 bp, synthetic construct
  misc_feature 1..22: note = Description of Artificial Sequence: Syntheticoligonucleotide
  source 1..22: mol_type = other DNA
cggactctaattagagtccgcc

SEQ ID NO: 9503 - DNA, 22 bp, synthetic construct
  misc_feature 1..22: note = Description of Artificial Sequence: Syntheticoligonucleotide
  source 1..22: mol_type = other DNA
cggactctaattagagtccgct

SEQ ID NO: 9504 - DNA, 22 bp, synthetic construct
  misc_feature 1..22: note = Description of Artificial Sequence: Syntheticoligonucleotide
  source 1..22: mol_type = other DNA
cggactctaattagagtccgtc

SEQ ID NO: 9505 - DNA, 22 bp, synthetic construct
  misc_feature 1..22: note = Description of Artificial Sequence: Syntheticoligonucleotide
  source 1..22: mol_type = other DNA
aggactctaattagagtcctcc

SEQ ID NO: 9506 - DNA, 22 bp, synthetic construct
  misc_feature 1..22: note = Description of Artificial Sequence: Syntheticoligonucleotide
  source 1..22: mol_type = other DNA
cagactctaattagagtctgcc

SEQ ID NO: 9507 - DNA, 22 bp, synthetic construct
  misc_feature 1..22: note = Description of Artificial Sequence: Syntheticoligonucleotide
  source 1..22: mol_type = other DNA
cggactctaattagagtccgca

SEQ ID NO: 9508 - DNA, 22 bp, synthetic construct
  misc_feature 1..22: note = Description of Artificial Sequence: Syntheticoligonucleotide
  source 1..22: mol_type = other DNA
cggactctaattagagtccgac

SEQ ID NO: 9509 - DNA, 22 bp, synthetic construct
  misc_feature 1..22: note = Description of Artificial Sequence: Syntheticoligonucleotide
  source 1..22: mol_type = other DNA
tggactctaattagagtccacc

SEQ ID NO: 9510 - DNA, 22 bp, synthetic construct
  misc_feature 1..22: note = Description of Artificial Sequence: Syntheticoligonucleotide
  source 1..22: mol_type = other DNA
ctgactctaattagagtcagcc

SEQ ID NO: 9511 - DNA, 22 bp, synthetic construct
  misc_feature 1..22: note = Description of Artificial Sequence: Syntheticoligonucleotide
  source 1..22: mol_type = other DNA
ccgactctaattagagtcgggc

SEQ ID NO: 9512 - DNA, 22 bp, synthetic construct
  misc_feature 1..22: note = Description of Artificial Sequence: Syntheticoligonucleotide
  source 1..22: mol_type = other DNA
ccgactctaattagagtcgggt

SEQ ID NO: 9513 - DNA, 22 bp, synthetic construct
  misc_feature 1..22: note = Description of Artificial Sequence: Syntheticoligonucleotide
  source 1..22: mol_type = other DNA
ccgactctaattagagtcggtc

SEQ ID NO: 9514 - DNA, 22 bp, synthetic construct
  misc_feature 1..22: note = Description of Artificial Sequence: Syntheticoligonucleotide
  source 1..22: mol_type = other DNA
acgactctaattagagtcgtgc

SEQ ID NO: 9515 - DNA, 22 bp, synthetic construct
  misc_feature 1..22: note = Description of Artificial Sequence: Syntheticoligonucleotide
  source 1..22: mol_type = other DNA
cagactctaattagagtctggc

SEQ ID NO: 9516 - DNA, 22 bp, synthetic construct
  misc_feature 1..22: note = Description of Artificial Sequence: Syntheticoligonucleotide
  source 1..22: mol_type = other DNA
ccgactctaattagagtcggga

SEQ ID NO: 9517 - DNA, 22 bp, synthetic construct
  misc_feature 1..22: note = Description of Artificial Sequence: Syntheticoligonucleotide
  source 1..22: mol_type = other DNA
ccgactctaattagagtcggac

SEQ ID NO: 9518 - DNA, 22 bp, synthetic construct
  misc_feature 1..22: note = Description of Artificial Sequence: Syntheticoligonucleotide
  source 1..22: mol_type = other DNA
ctgactctaattagagtcaggc

SEQ ID NO: 9519 - DNA, 22 bp, synthetic construct
  misc_feature 1..22: note = Description of Artificial Sequence: Syntheticoligonucleotide
  source 1..22: mol_type = other DNA
gcgactctaattagagtcgccc

SEQ ID NO: 9520 - DNA, 22 bp, synthetic construct
  misc_feature 1..22: note = Description of Artificial Sequence: Syntheticoligonucleotide
  source 1..22: mol_type = other DNA
gcgactctaattagagtcgcct

SEQ ID NO: 9521 - DNA, 22 bp, synthetic construct
  misc_feature 1..22: note = Description of Artificial Sequence: Syntheticoligonucleotide
  source 1..22: mol_type = other DNA
gcgactctaattagagtcgctc

SEQ ID NO: 9522 - DNA, 22 bp, synthetic construct
  misc_feature 1..22: note = Description of Artificial Sequence: Syntheticoligonucleotide
  source 1..22: mol_type = other DNA
acgactctaattagagtcgtcc

SEQ ID NO: 9523 - DNA, 22 bp, synthetic construct
  misc_feature 1..22: note = Description of Artificial Sequence: Syntheticoligonucleotide
  source 1..22: mol_type = other DNA
gagactctaattagagtctccc

SEQ ID NO: 9524 - DNA, 22 bp, synthetic construct
  misc_feature 1..22: note = Description of Artificial Sequence: Syntheticoligonucleotide
  source 1..22: mol_type = other DNA
gcgactctaattagagtcgcca

SEQ ID NO: 9525 - DNA, 22 bp, synthetic construct
  misc_feature 1..22: note = Description of Artificial Sequence: Syntheticoligonucleotide
  source 1..22: mol_type = other DNA
gcgactctaattagagtcgcac

SEQ ID NO: 9526 - DNA, 22 bp, synthetic construct
  misc_feature 1..22: note = Description of Artificial Sequence: Syntheticoligonucleotide
  source 1..22: mol_type = other DNA
gtgactctaattagagtcaccc

SEQ ID NO: 9527 - DNA, 22 bp, synthetic construct
  misc_feature 1..22: note = Description of Artificial Sequence: Syntheticoligonucleotide
  source 1..22: mol_type = other DNA
gggactctaattagagtcccgt

SEQ ID NO: 9528 - DNA, 22 bp, synthetic construct
  misc_feature 1..22: note = Description of Artificial Sequence: Syntheticoligonucleotide
  source 1..22: mol_type = other DNA
gggactctaattagagtccctg

SEQ ID NO: 9529 - DNA, 22 bp, synthetic construct
  misc_feature 1..22: note = Description of Artificial Sequence: Syntheticoligonucleotide
  source 1..22: mol_type = other DNA
aggactctaattagagtcctgg

SEQ ID NO: 9530 - DNA, 22 bp, synthetic construct
  misc_feature 1..22: note = Description of Artificial Sequence: Syntheticoligonucleotide
  source 1..22: mol_type = other DNA
gagactctaattagagtctcgg

SEQ ID NO: 9531 - DNA, 22 bp, synthetic construct
  misc_feature 1..22: note = Description of Artificial Sequence: Syntheticoligonucleotide
  source 1..22: mol_type = other DNA
gggactctaattagagtcccga

SEQ ID NO: 9532 - DNA, 22 bp, synthetic construct
  misc_feature 1..22: note = Description of Artificial Sequence: Syntheticoligonucleotide
  source 1..22: mol_type = other DNA
gggactctaattagagtcccag

SEQ ID NO: 9533 - DNA, 22 bp, synthetic construct
  misc_feature 1..22: note = Description of Artificial Sequence: Syntheticoligonucleotide
  source 1..22: mol_type = other DNA
tggactctaattagagtccagg

SEQ ID NO: 9534 - DNA, 22 bp, synthetic construct
  misc_feature 1..22: note = Description of Artificial Sequence: Syntheticoligonucleotide
  source 1..22: mol_type = other DNA
gtgactctaattagagtcacgg

SEQ ID NO: 9535 - DNA, 22 bp, synthetic construct
  misc_feature 1..22: note = Description of Artificial Sequence: Syntheticoligonucleotide
  source 1..22: mol_type = other DNA
gcgactctaattagagtcgccg

SEQ ID NO: 9536 - DNA, 22 bp, synthetic construct
  misc_feature 1..22: note = Description of Artificial Sequence: Syntheticoligonucleotide
  source 1..22: mol_type = other DNA
gcgactctaattagagtcgctg

SEQ ID NO: 9537 - DNA, 22 bp, synthetic construct
  misc_feature 1..22: note = Description of Artificial Sequence: Syntheticoligonucleotide
  source 1..22: mol_type = other DNA
acgactctaattagagtcgtcg

SEQ ID NO: 9538 - DNA, 22 bp, synthetic construct
  misc_feature 1..22: note = Description of Artificial Sequence: Syntheticoligonucleotide
  source 1..22: mol_type = other DNA
gagactctaattagagtctccg

SEQ ID NO: 9539 - DNA, 22 bp, synthetic construct
  misc_feature 1..22: note = Description of Artificial Sequence: Syntheticoligonucleotide
  source 1..22: mol_type = other DNA
gcgactctaattagagtcgcag

SEQ ID NO: 9540 - DNA, 22 bp, synthetic construct
  misc_feature 1..22: note = Description of Artificial Sequence: Syntheticoligonucleotide
  source 1..22: mol_type = other DNA
gtgactctaattagagtcaccg

SEQ ID NO: 9541 - DNA, 22 bp, synthetic construct
  misc_feature 1..22: note = Description of Artificial Sequence: Syntheticoligonucleotide
  source 1..22: mol_type = other DNA
cggactctaattagagtccgtg

SEQ ID NO: 9542 - DNA, 22 bp, synthetic construct
  misc_feature 1..22: note = Description of Artificial Sequence: Syntheticoligonucleotide
  source 1..22: mol_type = other DNA
cagactctaattagagtctggg

SEQ ID NO: 9543 - DNA, 22 bp, synthetic construct
  misc_feature 1..22: note = Description of Artificial Sequence: Syntheticoligonucleotide
  source 1..22: mol_type = other DNA
cggactctaattagagtccgag

SEQ ID NO: 9544 - DNA, 22 bp, synthetic construct
  misc_feature 1..22: note = Description of Artificial Sequence: Syntheticoligonucleotide
  source 1..22: mol_type = other DNA
ctgactctaattagagtcaggg

SEQ ID NO: 9545 - DNA, 22 bp, synthetic construct
  misc_feature 1..22: note = Description of Artificial Sequence: Syntheticoligonucleotide
  source 1..22: mol_type = other DNA
acgactctaattagagtcgtgg

SEQ ID NO: 9546 - DNA, 22 bp, synthetic construct
  misc_feature 1..22: note = Description of Artificial Sequence: Syntheticoligonucleotide
  source 1..22: mol_type = other DNA
ccgactctaattagagtcggct

SEQ ID NO: 9547 - DNA, 22 bp, synthetic construct
  misc_feature 1..22: note = Description of Artificial Sequence: Syntheticoligonucleotide
  source 1..22: mol_type = other DNA
ccgactctaattagagtcggca

SEQ ID NO: 9548 - DNA, 22 bp, synthetic construct
  misc_feature 1..22: note = Description of Artificial Sequence: Syntheticoligonucleotide
  source 1..22: mol_type = other DNA
gagactctaattagagtctcgc

SEQ ID NO: 9549 - DNA, 22 bp, synthetic construct
  misc_feature 1..22: note = Description of Artificial Sequence: Syntheticoligonucleotide
  source 1..22: mol_type = other DNA
gtgactctaattagagtcacgc

SEQ ID NO: 9550 - DNA, 22 bp, synthetic construct
  misc_feature 1..22: note = Description of Artificial Sequence: Syntheticoligonucleotide
  source 1..22: mol_type = other DNA
aggactctaattagagtcctgc

SEQ ID NO: 9551 - DNA, 22 bp, synthetic construct
  misc_feature 1..22: note = Description of Artificial Sequence: Syntheticoligonucleotide
  source 1..22: mol_type = other DNA
tggactctaattagagtccagc

SEQ ID NO: 9552 - DNA, 22 bp, synthetic construct
  misc_feature 1..22: note = Description of Artificial Sequence: Syntheticoligonucleotide
  source 1..22: mol_type = other DNA
aggactctaattagagtcctcg

SEQ ID NO: 9553 - DNA, 22 bp, synthetic construct
  misc_feature 1..22: note = Description of Artificial Sequence: Syntheticoligonucleotide
  source 1..22: mol_type = other DNA
tggactctaattagagtccacg

SEQ ID NO: 9554 - DNA, 22 bp, synthetic construct
  misc_feature 1..22: note = Description of Artificial Sequence: Syntheticoligonucleotide
  source 1..22: mol_type = other DNA
ccgactctaattagagtcggtg

SEQ ID NO: 9555 - DNA, 22 bp, synthetic construct
  misc_feature 1..22: note = Description of Artificial Sequence: Syntheticoligonucleotide
  source 1..22: mol_type = other DNA
ccgactctaattagagtcggag

SEQ ID NO: 9556 - DNA, 22 bp, synthetic construct
  misc_feature 1..22: note = Description of Artificial Sequence: Syntheticoligonucleotide
  source 1..22: mol_type = other DNA
gggactctaattagagtcccgc

SEQ ID NO: 9557 - DNA, 22 bp, synthetic construct
  misc_feature 1..22: note = Description of Artificial Sequence: Syntheticoligonucleotide
  source 1..22: mol_type = other DNA
gggactctaattagagtccctc

SEQ ID NO: 9558 - DNA, 22 bp, synthetic construct
  misc_feature 1..22: note = Description of Artificial Sequence: Syntheticoligonucleotide
  source 1..22: mol_type = other DNA
gggactctaattagagtcccac

SEQ ID NO: 9559 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactctatatagagtcnnnn

SEQ ID NO: 9560 - DNA, 22 bp, synthetic construct
  misc_feature 1..22: note = Description of Artificial Sequence: Syntheticoligonucleotide
  source 1..22: mol_type = other DNA
cggactctatatagagtccgcc

SEQ ID NO: 9561 - DNA, 22 bp, synthetic construct
  misc_feature 1..22: note = Description of Artificial Sequence: Syntheticoligonucleotide
  source 1..22: mol_type = other DNA
cggactctatatagagtccgct

SEQ ID NO: 9562 - DNA, 22 bp, synthetic construct
  misc_feature 1..22: note = Description of Artificial Sequence: Syntheticoligonucleotide
  source 1..22: mol_type = other DNA
cggactctatatagagtccgtc

SEQ ID NO: 9563 - DNA, 22 bp, synthetic construct
  misc_feature 1..22: note = Description of Artificial Sequence: Syntheticoligonucleotide
  source 1..22: mol_type = other DNA
aggactctatatagagtcctcc

SEQ ID NO: 9564 - DNA, 22 bp, synthetic construct
  misc_feature 1..22: note = Description of Artificial Sequence: Syntheticoligonucleotide
  source 1..22: mol_type = other DNA
cagactctatatagagtctgcc

SEQ ID NO: 9565 - DNA, 22 bp, synthetic construct
  misc_feature 1..22: note = Description of Artificial Sequence: Syntheticoligonucleotide
  source 1..22: mol_type = other DNA
cggactctatatagagtccgca

SEQ ID NO: 9566 - DNA, 22 bp, synthetic construct
  misc_feature 1..22: note = Description of Artificial Sequence: Syntheticoligonucleotide
  source 1..22: mol_type = other DNA
cggactctatatagagtccgac

SEQ ID NO: 9567 - DNA, 22 bp, synthetic construct
  misc_feature 1..22: note = Description of Artificial Sequence: Syntheticoligonucleotide
  source 1..22: mol_type = other DNA
tggactctatatagagtccacc

SEQ ID NO: 9568 - DNA, 22 bp, synthetic construct
  misc_feature 1..22: note = Description of Artificial Sequence: Syntheticoligonucleotide
  source 1..22: mol_type = other DNA
ctgactctatatagagtcagcc

SEQ ID NO: 9569 - DNA, 22 bp, synthetic construct
  misc_feature 1..22: note = Description of Artificial Sequence: Syntheticoligonucleotide
  source 1..22: mol_type = other DNA
ccgactctatatagagtcgggc

SEQ ID NO: 9570 - DNA, 22 bp, synthetic construct
  misc_feature 1..22: note = Description of Artificial Sequence: Syntheticoligonucleotide
  source 1..22: mol_type = other DNA
ccgactctatatagagtcgggt

SEQ ID NO: 9571 - DNA, 22 bp, synthetic construct
  misc_feature 1..22: note = Description of Artificial Sequence: Syntheticoligonucleotide
  source 1..22: mol_type = other DNA
ccgactctatatagagtcggtc

SEQ ID NO: 9572 - DNA, 22 bp, synthetic construct
  misc_feature 1..22: note = Description of Artificial Sequence: Syntheticoligonucleotide
  source 1..22: mol_type = other DNA
acgactctatatagagtcgtgc

SEQ ID NO: 9573 - DNA, 22 bp, synthetic construct
  misc_feature 1..22: note = Description of Artificial Sequence: Syntheticoligonucleotide
  source 1..22: mol_type = other DNA
cagactctatatagagtctggc

SEQ ID NO: 9574 - DNA, 22 bp, synthetic construct
  misc_feature 1..22: note = Description of Artificial Sequence: Syntheticoligonucleotide
  source 1..22: mol_type = other DNA
ccgactctatatagagtcggga

SEQ ID NO: 9575 - DNA, 22 bp, synthetic construct
  misc_feature 1..22: note = Description of Artificial Sequence: Syntheticoligonucleotide
  source 1..22: mol_type = other DNA
ccgactctatatagagtcggac

SEQ ID NO: 9576 - DNA, 22 bp, synthetic construct
  misc_feature 1..22: note = Description of Artificial Sequence: Syntheticoligonucleotide
  source 1..22: mol_type = other DNA
ctgactctatatagagtcaggc

SEQ ID NO: 9577 - DNA, 22 bp, synthetic construct
  misc_feature 1..22: note = Description of Artificial Sequence: Syntheticoligonucleotide
  source 1..22: mol_type = other DNA
gcgactctatatagagtcgccc

SEQ ID NO: 9578 - DNA, 22 bp, synthetic construct
  misc_feature 1..22: note = Description of Artificial Sequence: Syntheticoligonucleotide
  source 1..22: mol_type = other DNA
gcgactctatatagagtcgcct

SEQ ID NO: 9579 - DNA, 22 bp, synthetic construct
  misc_feature 1..22: note = Description of Artificial Sequence: Syntheticoligonucleotide
  source 1..22: mol_type = other DNA
gcgactctatatagagtcgctc

SEQ ID NO: 9580 - DNA, 22 bp, synthetic construct
  misc_feature 1..22: note = Description of Artificial Sequence: Syntheticoligonucleotide
  source 1..22: mol_type = other DNA
acgactctatatagagtcgtcc

SEQ ID NO: 9581 - DNA, 22 bp, synthetic construct
  misc_feature 1..22: note = Description of Artificial Sequence: Syntheticoligonucleotide
  source 1..22: mol_type = other DNA
gagactctatatagagtctccc

SEQ ID NO: 9582 - DNA, 22 bp, synthetic construct
  misc_feature 1..22: note = Description of Artificial Sequence: Syntheticoligonucleotide
  source 1..22: mol_type = other DNA
gcgactctatatagagtcgcca

SEQ ID NO: 9583 - DNA, 22 bp, synthetic construct
  misc_feature 1..22: note = Description of Artificial Sequence: Syntheticoligonucleotide
  source 1..22: mol_type = other DNA
gcgactctatatagagtcgcac

SEQ ID NO: 9584 - DNA, 22 bp, synthetic construct
  misc_feature 1..22: note = Description of Artificial Sequence: Syntheticoligonucleotide
  source 1..22: mol_type = other DNA
gtgactctatatagagtcaccc

SEQ ID NO: 9585 - DNA, 22 bp, synthetic construct
  misc_feature 1..22: note = Description of Artificial Sequence: Syntheticoligonucleotide
  source 1..22: mol_type = other DNA
gggactctatatagagtcccgt

SEQ ID NO: 9586 - DNA, 22 bp, synthetic construct
  misc_feature 1..22: note = Description of Artificial Sequence: Syntheticoligonucleotide
  source 1..22: mol_type = other DNA
gggactctatatagagtccctg

SEQ ID NO: 9587 - DNA, 22 bp, synthetic construct
  misc_feature 1..22: note = Description of Artificial Sequence: Syntheticoligonucleotide
  source 1..22: mol_type = other DNA
aggactctatatagagtcctgg

SEQ ID NO: 9588 - DNA, 22 bp, synthetic construct
  misc_feature 1..22: note = Description of Artificial Sequence: Syntheticoligonucleotide
  source 1..22: mol_type = other DNA
gagactctatatagagtctcgg

SEQ ID NO: 9589 - DNA, 22 bp, synthetic construct
  misc_feature 1..22: note = Description of Artificial Sequence: Syntheticoligonucleotide
  source 1..22: mol_type = other DNA
gggactctatatagagtcccga

SEQ ID NO: 9590 - DNA, 22 bp, synthetic construct
  misc_feature 1..22: note = Description of Artificial Sequence: Syntheticoligonucleotide
  source 1..22: mol_type = other DNA
gggactctatatagagtcccag

SEQ ID NO: 9591 - DNA, 22 bp, synthetic construct
  misc_feature 1..22: note = Description of Artificial Sequence: Syntheticoligonucleotide
  source 1..22: mol_type = other DNA
tggactctatatagagtccagg

SEQ ID NO: 9592 - DNA, 22 bp, synthetic construct
  misc_feature 1..22: note = Description of Artificial Sequence: Syntheticoligonucleotide
  source 1..22: mol_type = other DNA
gtgactctatatagagtcacgg

SEQ ID NO: 9593 - DNA, 22 bp, synthetic construct
  misc_feature 1..22: note = Description of Artificial Sequence: Syntheticoligonucleotide
  source 1..22: mol_type = other DNA
gcgactctatatagagtcgccg

SEQ ID NO: 9594 - DNA, 22 bp, synthetic construct
  misc_feature 1..22: note = Description of Artificial Sequence: Syntheticoligonucleotide
  source 1..22: mol_type = other DNA
gcgactctatatagagtcgctg

SEQ ID NO: 9595 - DNA, 22 bp, synthetic construct
  misc_feature 1..22: note = Description of Artificial Sequence: Syntheticoligonucleotide
  source 1..22: mol_type = other DNA
acgactctatatagagtcgtcg

SEQ ID NO: 9596 - DNA, 22 bp, synthetic construct
  misc_feature 1..22: note = Description of Artificial Sequence: Syntheticoligonucleotide
  source 1..22: mol_type = other DNA
gagactctatatagagtctccg

SEQ ID NO: 9597 - DNA, 22 bp, synthetic construct
  misc_feature 1..22: note = Description of Artificial Sequence: Syntheticoligonucleotide
  source 1..22: mol_type = other DNA
gcgactctatatagagtcgcag

SEQ ID NO: 9598 - DNA, 22 bp, synthetic construct
  misc_feature 1..22: note = Description of Artificial Sequence: Syntheticoligonucleotide
  source 1..22: mol_type = other DNA
gtgactctatatagagtcaccg

SEQ ID NO: 9599 - DNA, 22 bp, synthetic construct
  misc_feature 1..22: note = Description of Artificial Sequence: Syntheticoligonucleotide
  source 1..22: mol_type = other DNA
cggactctatatagagtccgtg

SEQ ID NO: 9600 - DNA, 22 bp, synthetic construct
  misc_feature 1..22: note = Description of Artificial Sequence: Syntheticoligonucleotide
  source 1..22: mol_type = other DNA
cagactctatatagagtctggg

SEQ ID NO: 9601 - DNA, 22 bp, synthetic construct
  misc_feature 1..22: note = Description of Artificial Sequence: Syntheticoligonucleotide
  source 1..22: mol_type = other DNA
cggactctatatagagtccgag

SEQ ID NO: 9602 - DNA, 22 bp, synthetic construct
  misc_feature 1..22: note = Description of Artificial Sequence: Syntheticoligonucleotide
  source 1..22: mol_type = other DNA
ctgactctatatagagtcaggg

SEQ ID NO: 9603 - DNA, 22 bp, synthetic construct
  misc_feature 1..22: note = Description of Artificial Sequence: Syntheticoligonucleotide
  source 1..22: mol_type = other DNA
acgactctatatagagtcgtgg

SEQ ID NO: 9604 - DNA, 22 bp, synthetic construct
  misc_feature 1..22: note = Description of Artificial Sequence: Syntheticoligonucleotide
  source 1..22: mol_type = other DNA
ccgactctatatagagtcggct

SEQ ID NO: 9605 - DNA, 22 bp, synthetic construct
  misc_feature 1..22: note = Description of Artificial Sequence: Syntheticoligonucleotide
  source 1..22: mol_type = other DNA
ccgactctatatagagtcggca

SEQ ID NO: 9606 - DNA, 22 bp, synthetic construct
  misc_feature 1..22: note = Description of Artificial Sequence: Syntheticoligonucleotide
  source 1..22: mol_type = other DNA
gagactctatatagagtctcgc

SEQ ID NO: 9607 - DNA, 22 bp, synthetic construct
  misc_feature 1..22: note = Description of Artificial Sequence: Syntheticoligonucleotide
  source 1..22: mol_type = other DNA
gtgactctatatagagtcacgc

SEQ ID NO: 9608 - DNA, 22 bp, synthetic construct
  misc_feature 1..22: note = Description of Artificial Sequence: Syntheticoligonucleotide
  source 1..22: mol_type = other DNA
aggactctatatagagtcctgc

SEQ ID NO: 9609 - DNA, 22 bp, synthetic construct
  misc_feature 1..22: note = Description of Artificial Sequence: Syntheticoligonucleotide
  source 1..22: mol_type = other DNA
tggactctatatagagtccagc

SEQ ID NO: 9610 - DNA, 22 bp, synthetic construct
  misc_feature 1..22: note = Description of Artificial Sequence: Syntheticoligonucleotide
  source 1..22: mol_type = other DNA
aggactctatatagagtcctcg

SEQ ID NO: 9611 - DNA, 22 bp, synthetic construct
  misc_feature 1..22: note = Description of Artificial Sequence: Syntheticoligonucleotide
  source 1..22: mol_type = other DNA
tggactctatatagagtccacg

SEQ ID NO: 9612 - DNA, 22 bp, synthetic construct
  misc_feature 1..22: note = Description of Artificial Sequence: Syntheticoligonucleotide
  source 1..22: mol_type = other DNA
ccgactctatatagagtcggtg

SEQ ID NO: 9613 - DNA, 22 bp, synthetic construct
  misc_feature 1..22: note = Description of Artificial Sequence: Syntheticoligonucleotide
  source 1..22: mol_type = other DNA
ccgactctatatagagtcggag

SEQ ID NO: 9614 - DNA, 22 bp, synthetic construct
  misc_feature 1..22: note = Description of Artificial Sequence: Syntheticoligonucleotide
  source 1..22: mol_type = other DNA
gggactctatatagagtcccgc

SEQ ID NO: 9615 - DNA, 22 bp, synthetic construct
  misc_feature 1..22: note = Description of Artificial Sequence: Syntheticoligonucleotide
  source 1..22: mol_type = other DNA
gggactctatatagagtccctc

SEQ ID NO: 9616 - DNA, 22 bp, synthetic construct
  misc_feature 1..22: note = Description of Artificial Sequence: Syntheticoligonucleotide
  source 1..22: mol_type = other DNA
gggactctatatagagtcccac

SEQ ID NO: 9617 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactctagctagagtcnnnn

SEQ ID NO: 9618 - DNA, 22 bp, synthetic construct
  misc_feature 1..22: note = Description of Artificial Sequence: Syntheticoligonucleotide
  source 1..22: mol_type = other DNA
cggactctagctagagtccgcc

SEQ ID NO: 9619 - DNA, 22 bp, synthetic construct
  misc_feature 1..22: note = Description of Artificial Sequence: Syntheticoligonucleotide
  source 1..22: mol_type = other DNA
cggactctagctagagtccgct

SEQ ID NO: 9620 - DNA, 22 bp, synthetic construct
  misc_feature 1..22: note = Description of Artificial Sequence: Syntheticoligonucleotide
  source 1..22: mol_type = other DNA
cggactctagctagagtccgtc

SEQ ID NO: 9621 - DNA, 22 bp, synthetic construct
  misc_feature 1..22: note = Description of Artificial Sequence: Syntheticoligonucleotide
  source 1..22: mol_type = other DNA
aggactctagctagagtcctcc

SEQ ID NO: 9622 - DNA, 22 bp, synthetic construct
  misc_feature 1..22: note = Description of Artificial Sequence: Syntheticoligonucleotide
  source 1..22: mol_type = other DNA
cagactctagctagagtctgcc

SEQ ID NO: 9623 - DNA, 22 bp, synthetic construct
  misc_feature 1..22: note = Description of Artificial Sequence: Syntheticoligonucleotide
  source 1..22: mol_type = other DNA
cggactctagctagagtccgca

SEQ ID NO: 9624 - DNA, 22 bp, synthetic construct
  misc_feature 1..22: note = Description of Artificial Sequence: Syntheticoligonucleotide
  source 1..22: mol_type = other DNA
cggactctagctagagtccgac

SEQ ID NO: 9625 - DNA, 22 bp, synthetic construct
  misc_feature 1..22: note = Description of Artificial Sequence: Syntheticoligonucleotide
  source 1..22: mol_type = other DNA
tggactctagctagagtccacc

SEQ ID NO: 9626 - DNA, 22 bp, synthetic construct
  misc_feature 1..22: note = Description of Artificial Sequence: Syntheticoligonucleotide
  source 1..22: mol_type = other DNA
ctgactctagctagagtcagcc

SEQ ID NO: 9627 - DNA, 22 bp, synthetic construct
  misc_feature 1..22: note = Description of Artificial Sequence: Syntheticoligonucleotide
  source 1..22: mol_type = other DNA
ccgactctagctagagtcgggc

SEQ ID NO: 9628 - DNA, 22 bp, synthetic construct
  misc_feature 1..22: note = Description of Artificial Sequence: Syntheticoligonucleotide
  source 1..22: mol_type = other DNA
ccgactctagctagagtcgggt

SEQ ID NO: 9629 - DNA, 22 bp, synthetic construct
  misc_feature 1..22: note = Description of Artificial Sequence: Syntheticoligonucleotide
  source 1..22: mol_type = other DNA
ccgactctagctagagtcggtc

SEQ ID NO: 9630 - DNA, 22 bp, synthetic construct
  misc_feature 1..22: note = Description of Artificial Sequence: Syntheticoligonucleotide
  source 1..22: mol_type = other DNA
acgactctagctagagtcgtgc

SEQ ID NO: 9631 - DNA, 22 bp, synthetic construct
  misc_feature 1..22: note = Description of Artificial Sequence: Syntheticoligonucleotide
  source 1..22: mol_type = other DNA
cagactctagctagagtctggc

SEQ ID NO: 9632 - DNA, 22 bp, synthetic construct
  misc_feature 1..22: note = Description of Artificial Sequence: Syntheticoligonucleotide
  source 1..22: mol_type = other DNA
ccgactctagctagagtcggga

SEQ ID NO: 9633 - DNA, 22 bp, synthetic construct
  misc_feature 1..22: note = Description of Artificial Sequence: Syntheticoligonucleotide
  source 1..22: mol_type = other DNA
ccgactctagctagagtcggac

SEQ ID NO: 9634 - DNA, 22 bp, synthetic construct
  misc_feature 1..22: note = Description of Artificial Sequence: Syntheticoligonucleotide
  source 1..22: mol_type = other DNA
ctgactctagctagagtcaggc

SEQ ID NO: 9635 - DNA, 22 bp, synthetic construct
  misc_feature 1..22: note = Description of Artificial Sequence: Syntheticoligonucleotide
  source 1..22: mol_type = other DNA
gcgactctagctagagtcgccc

SEQ ID NO: 9636 - DNA, 22 bp, synthetic construct
  misc_feature 1..22: note = Description of Artificial Sequence: Syntheticoligonucleotide
  source 1..22: mol_type = other DNA
gcgactctagctagagtcgcct

SEQ ID NO: 9637 - DNA, 22 bp, synthetic construct
  misc_feature 1..22: note = Description of Artificial Sequence: Syntheticoligonucleotide
  source 1..22: mol_type = other DNA
gcgactctagctagagtcgctc

SEQ ID NO: 9638 - DNA, 22 bp, synthetic construct
  misc_feature 1..22: note = Description of Artificial Sequence: Syntheticoligonucleotide
  source 1..22: mol_type = other DNA
acgactctagctagagtcgtcc

SEQ ID NO: 9639 - DNA, 22 bp, synthetic construct
  misc_feature 1..22: note = Description of Artificial Sequence: Syntheticoligonucleotide
  source 1..22: mol_type = other DNA
gagactctagctagagtctccc

SEQ ID NO: 9640 - DNA, 22 bp, synthetic construct
  misc_feature 1..22: note = Description of Artificial Sequence: Syntheticoligonucleotide
  source 1..22: mol_type = other DNA
gcgactctagctagagtcgcca

SEQ ID NO: 9641 - DNA, 22 bp, synthetic construct
  misc_feature 1..22: note = Description of Artificial Sequence: Syntheticoligonucleotide
  source 1..22: mol_type = other DNA
gcgactctagctagagtcgcac

SEQ ID NO: 9642 - DNA, 22 bp, synthetic construct
  misc_feature 1..22: note = Description of Artificial Sequence: Syntheticoligonucleotide
  source 1..22: mol_type = other DNA
gtgactctagctagagtcaccc

SEQ ID NO: 9643 - DNA, 22 bp, synthetic construct
  misc_feature 1..22: note = Description of Artificial Sequence: Syntheticoligonucleotide
  source 1..22: mol_type = other DNA
gggactctagctagagtcccgt

SEQ ID NO: 9644 - DNA, 22 bp, synthetic construct
  misc_feature 1..22: note = Description of Artificial Sequence: Syntheticoligonucleotide
  source 1..22: mol_type = other DNA
gggactctagctagagtccctg

SEQ ID NO: 9645 - DNA, 22 bp, synthetic construct
  misc_feature 1..22: note = Description of Artificial Sequence: Syntheticoligonucleotide
  source 1..22: mol_type = other DNA
aggactctagctagagtcctgg

SEQ ID NO: 9646 - DNA, 22 bp, synthetic construct
  misc_feature 1..22: note = Description of Artificial Sequence: Syntheticoligonucleotide
  source 1..22: mol_type = other DNA
gagactctagctagagtctcgg

SEQ ID NO: 9647 - DNA, 22 bp, synthetic construct
  misc_feature 1..22: note = Description of Artificial Sequence: Syntheticoligonucleotide
  source 1..22: mol_type = other DNA
gggactctagctagagtcccga

SEQ ID NO: 9648 - DNA, 22 bp, synthetic construct
  misc_feature 1..22: note = Description of Artificial Sequence: Syntheticoligonucleotide
  source 1..22: mol_type = other DNA
gggactctagctagagtcccag

SEQ ID NO: 9649 - DNA, 22 bp, synthetic construct
  misc_feature 1..22: note = Description of Artificial Sequence: Syntheticoligonucleotide
  source 1..22: mol_type = other DNA
tggactctagctagagtccagg

SEQ ID NO: 9650 - DNA, 22 bp, synthetic construct
  misc_feature 1..22: note = Description of Artificial Sequence: Syntheticoligonucleotide
  source 1..22: mol_type = other DNA
gtgactctagctagagtcacgg

SEQ ID NO: 9651 - DNA, 22 bp, synthetic construct
  misc_feature 1..22: note = Description of Artificial Sequence: Syntheticoligonucleotide
  source 1..22: mol_type = other DNA
gcgactctagctagagtcgccg

SEQ ID NO: 9652 - DNA, 22 bp, synthetic construct
  misc_feature 1..22: note = Description of Artificial Sequence: Syntheticoligonucleotide
  source 1..22: mol_type = other DNA
gcgactctagctagagtcgctg

SEQ ID NO: 9653 - DNA, 22 bp, synthetic construct
  misc_feature 1..22: note = Description of Artificial Sequence: Syntheticoligonucleotide
  source 1..22: mol_type = other DNA
acgactctagctagagtcgtcg

SEQ ID NO: 9654 - DNA, 22 bp, synthetic construct
  misc_feature 1..22: note = Description of Artificial Sequence: Syntheticoligonucleotide
  source 1..22: mol_type = other DNA
gagactctagctagagtctccg

SEQ ID NO: 9655 - DNA, 22 bp, synthetic construct
  misc_feature 1..22: note = Description of Artificial Sequence: Syntheticoligonucleotide
  source 1..22: mol_type = other DNA
gcgactctagctagagtcgcag

SEQ ID NO: 9656 - DNA, 22 bp, synthetic construct
  misc_feature 1..22: note = Description of Artificial Sequence: Syntheticoligonucleotide
  source 1..22: mol_type = other DNA
gtgactctagctagagtcaccg

SEQ ID NO: 9657 - DNA, 22 bp, synthetic construct
  misc_feature 1..22: note = Description of Artificial Sequence: Syntheticoligonucleotide
  source 1..22: mol_type = other DNA
cggactctagctagagtccgtg

SEQ ID NO: 9658 - DNA, 22 bp, synthetic construct
  misc_feature 1..22: note = Description of Artificial Sequence: Syntheticoligonucleotide
  source 1..22: mol_type = other DNA
cagactctagctagagtctggg

SEQ ID NO: 9659 - DNA, 22 bp, synthetic construct
  misc_feature 1..22: note = Description of Artificial Sequence: Syntheticoligonucleotide
  source 1..22: mol_type = other DNA
cggactctagctagagtccgag

SEQ ID NO: 9660 - DNA, 22 bp, synthetic construct
  misc_feature 1..22: note = Description of Artificial Sequence: Syntheticoligonucleotide
  source 1..22: mol_type = other DNA
ctgactctagctagagtcaggg

SEQ ID NO: 9661 - DNA, 22 bp, synthetic construct
  misc_feature 1..22: note = Description of Artificial Sequence: Syntheticoligonucleotide
  source 1..22: mol_type = other DNA
acgactctagctagagtcgtgg

SEQ ID NO: 9662 - DNA, 22 bp, synthetic construct
  misc_feature 1..22: note = Description of Artificial Sequence: Syntheticoligonucleotide
  source 1..22: mol_type = other DNA
ccgactctagctagagtcggct

SEQ ID NO: 9663 - DNA, 22 bp, synthetic construct
  misc_feature 1..22: note = Description of Artificial Sequence: Syntheticoligonucleotide
  source 1..22: mol_type = other DNA
ccgactctagctagagtcggca

SEQ ID NO: 9664 - DNA, 22 bp, synthetic construct
  misc_feature 1..22: note = Description of Artificial Sequence: Syntheticoligonucleotide
  source 1..22: mol_type = other DNA
gagactctagctagagtctcgc

SEQ ID NO: 9665 - DNA, 22 bp, synthetic construct
  misc_feature 1..22: note = Description of Artificial Sequence: Syntheticoligonucleotide
  source 1..22: mol_type = other DNA
gtgactctagctagagtcacgc

SEQ ID NO: 9666 - DNA, 22 bp, synthetic construct
  misc_feature 1..22: note = Description of Artificial Sequence: Syntheticoligonucleotide
  source 1..22: mol_type = other DNA
aggactctagctagagtcctgc

SEQ ID NO: 9667 - DNA, 22 bp, synthetic construct
  misc_feature 1..22: note = Description of Artificial Sequence: Syntheticoligonucleotide
  source 1..22: mol_type = other DNA
tggactctagctagagtccagc

SEQ ID NO: 9668 - DNA, 22 bp, synthetic construct
  misc_feature 1..22: note = Description of Artificial Sequence: Syntheticoligonucleotide
  source 1..22: mol_type = other DNA
aggactctagctagagtcctcg

SEQ ID NO: 9669 - DNA, 22 bp, synthetic construct
  misc_feature 1..22: note = Description of Artificial Sequence: Syntheticoligonucleotide
  source 1..22: mol_type = other DNA
tggactctagctagagtccacg

SEQ ID NO: 9670 - DNA, 22 bp, synthetic construct
  misc_feature 1..22: note = Description of Artificial Sequence: Syntheticoligonucleotide
  source 1..22: mol_type = other DNA
ccgactctagctagagtcggtg

SEQ ID NO: 9671 - DNA, 22 bp, synthetic construct
  misc_feature 1..22: note = Description of Artificial Sequence: Syntheticoligonucleotide
  source 1..22: mol_type = other DNA
ccgactctagctagagtcggag

SEQ ID NO: 9672 - DNA, 22 bp, synthetic construct
  misc_feature 1..22: note = Description of Artificial Sequence: Syntheticoligonucleotide
  source 1..22: mol_type = other DNA
gggactctagctagagtcccgc

SEQ ID NO: 9673 - DNA, 22 bp, synthetic construct
  misc_feature 1..22: note = Description of Artificial Sequence: Syntheticoligonucleotide
  source 1..22: mol_type = other DNA
gggactctagctagagtccctc

SEQ ID NO: 9674 - DNA, 22 bp, synthetic construct
  misc_feature 1..22: note = Description of Artificial Sequence: Syntheticoligonucleotide
  source 1..22: mol_type = other DNA
gggactctagctagagtcccac

SEQ ID NO: 9675 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactctacgtagagtcnnnn

SEQ ID NO: 9676 - DNA, 22 bp, synthetic construct
  misc_feature 1..22: note = Description of Artificial Sequence: Syntheticoligonucleotide
  source 1..22: mol_type = other DNA
cggactctacgtagagtccgcc

SEQ ID NO: 9677 - DNA, 22 bp, synthetic construct
  misc_feature 1..22: note = Description of Artificial Sequence: Syntheticoligonucleotide
  source 1..22: mol_type = other DNA
cggactctacgtagagtccgct

SEQ ID NO: 9678 - DNA, 22 bp, synthetic construct
  misc_feature 1..22: note = Description of Artificial Sequence: Syntheticoligonucleotide
  source 1..22: mol_type = other DNA
cggactctacgtagagtccgtc

SEQ ID NO: 9679 - DNA, 22 bp, synthetic construct
  misc_feature 1..22: note = Description of Artificial Sequence: Syntheticoligonucleotide
  source 1..22: mol_type = other DNA
aggactctacgtagagtcctcc

SEQ ID NO: 9680 - DNA, 22 bp, synthetic construct
  misc_feature 1..22: note = Description of Artificial Sequence: Syntheticoligonucleotide
  source 1..22: mol_type = other DNA
cagactctacgtagagtctgcc

SEQ ID NO: 9681 - DNA, 22 bp, synthetic construct
  misc_feature 1..22: note = Description of Artificial Sequence: Syntheticoligonucleotide
  source 1..22: mol_type = other DNA
cggactctacgtagagtccgca

SEQ ID NO: 9682 - DNA, 22 bp, synthetic construct
  misc_feature 1..22: note = Description of Artificial Sequence: Syntheticoligonucleotide
  source 1..22: mol_type = other DNA
cggactctacgtagagtccgac

SEQ ID NO: 9683 - DNA, 22 bp, synthetic construct
  misc_feature 1..22: note = Description of Artificial Sequence: Syntheticoligonucleotide
  source 1..22: mol_type = other DNA
tggactctacgtagagtccacc

SEQ ID NO: 9684 - DNA, 22 bp, synthetic construct
  misc_feature 1..22: note = Description of Artificial Sequence: Syntheticoligonucleotide
  source 1..22: mol_type = other DNA
ctgactctacgtagagtcagcc

SEQ ID NO: 9685 - DNA, 22 bp, synthetic construct
  misc_feature 1..22: note = Description of Artificial Sequence: Syntheticoligonucleotide
  source 1..22: mol_type = other DNA
ccgactctacgtagagtcgggc

SEQ ID NO: 9686 - DNA, 22 bp, synthetic construct
  misc_feature 1..22: note = Description of Artificial Sequence: Syntheticoligonucleotide
  source 1..22: mol_type = other DNA
ccgactctacgtagagtcgggt

SEQ ID NO: 9687 - DNA, 22 bp, synthetic construct
  misc_feature 1..22: note = Description of Artificial Sequence: Syntheticoligonucleotide
  source 1..22: mol_type = other DNA
ccgactctacgtagagtcggtc

SEQ ID NO: 9688 - DNA, 22 bp, synthetic construct
  misc_feature 1..22: note = Description of Artificial Sequence: Syntheticoligonucleotide
  source 1..22: mol_type = other DNA
acgactctacgtagagtcgtgc

SEQ ID NO: 9689 - DNA, 22 bp, synthetic construct
  misc_feature 1..22: note = Description of Artificial Sequence: Syntheticoligonucleotide
  source 1..22: mol_type = other DNA
cagactctacgtagagtctggc

SEQ ID NO: 9690 - DNA, 22 bp, synthetic construct
  misc_feature 1..22: note = Description of Artificial Sequence: Syntheticoligonucleotide
  source 1..22: mol_type = other DNA
ccgactctacgtagagtcggga

SEQ ID NO: 9691 - DNA, 22 bp, synthetic construct
  misc_feature 1..22: note = Description of Artificial Sequence: Syntheticoligonucleotide
  source 1..22: mol_type = other DNA
ccgactctacgtagagtcggac

SEQ ID NO: 9692 - DNA, 22 bp, synthetic construct
  misc_feature 1..22: note = Description of Artificial Sequence: Syntheticoligonucleotide
  source 1..22: mol_type = other DNA
ctgactctacgtagagtcaggc

SEQ ID NO: 9693 - DNA, 22 bp, synthetic construct
  misc_feature 1..22: note = Description of Artificial Sequence: Syntheticoligonucleotide
  source 1..22: mol_type = other DNA
gcgactctacgtagagtcgccc

SEQ ID NO: 9694 - DNA, 22 bp, synthetic construct
  misc_feature 1..22: note = Description of Artificial Sequence: Syntheticoligonucleotide
  source 1..22: mol_type = other DNA
gcgactctacgtagagtcgcct

SEQ ID NO: 9695 - DNA, 22 bp, synthetic construct
  misc_feature 1..22: note = Description of Artificial Sequence: Syntheticoligonucleotide
  source 1..22: mol_type = other DNA
gcgactctacgtagagtcgctc

SEQ ID NO: 9696 - DNA, 22 bp, synthetic construct
  misc_feature 1..22: note = Description of Artificial Sequence: Syntheticoligonucleotide
  source 1..22: mol_type = other DNA
acgactctacgtagagtcgtcc

SEQ ID NO: 9697 - DNA, 22 bp, synthetic construct
  misc_feature 1..22: note = Description of Artificial Sequence: Syntheticoligonucleotide
  source 1..22: mol_type = other DNA
gagactctacgtagagtctccc

SEQ ID NO: 9698 - DNA, 22 bp, synthetic construct
  misc_feature 1..22: note = Description of Artificial Sequence: Syntheticoligonucleotide
  source 1..22: mol_type = other DNA
gcgactctacgtagagtcgcca

SEQ ID NO: 9699 - DNA, 22 bp, synthetic construct
  misc_feature 1..22: note = Description of Artificial Sequence: Syntheticoligonucleotide
  source 1..22: mol_type = other DNA
gcgactctacgtagagtcgcac

SEQ ID NO: 9700 - DNA, 22 bp, synthetic construct
  misc_feature 1..22: note = Description of Artificial Sequence: Syntheticoligonucleotide
  source 1..22: mol_type = other DNA
gtgactctacgtagagtcaccc

SEQ ID NO: 9701 - DNA, 22 bp, synthetic construct
  misc_feature 1..22: note = Description of Artificial Sequence: Syntheticoligonucleotide
  source 1..22: mol_type = other DNA
gggactctacgtagagtcccgt

SEQ ID NO: 9702 - DNA, 22 bp, synthetic construct
  misc_feature 1..22: note = Description of Artificial Sequence: Syntheticoligonucleotide
  source 1..22: mol_type = other DNA
gggactctacgtagagtccctg

SEQ ID NO: 9703 - DNA, 22 bp, synthetic construct
  misc_feature 1..22: note = Description of Artificial Sequence: Syntheticoligonucleotide
  source 1..22: mol_type = other DNA
aggactctacgtagagtcctgg

SEQ ID NO: 9704 - DNA, 22 bp, synthetic construct
  misc_feature 1..22: note = Description of Artificial Sequence: Syntheticoligonucleotide
  source 1..22: mol_type = other DNA
gagactctacgtagagtctcgg

SEQ ID NO: 9705 - DNA, 22 bp, synthetic construct
  misc_feature 1..22: note = Description of Artificial Sequence: Syntheticoligonucleotide
  source 1..22: mol_type = other DNA
gggactctacgtagagtcccga

SEQ ID NO: 9706 - DNA, 22 bp, synthetic construct
  misc_feature 1..22: note = Description of Artificial Sequence: Syntheticoligonucleotide
  source 1..22: mol_type = other DNA
gggactctacgtagagtcccag

SEQ ID NO: 9707 - DNA, 22 bp, synthetic construct
  misc_feature 1..22: note = Description of Artificial Sequence: Syntheticoligonucleotide
  source 1..22: mol_type = other DNA
tggactctacgtagagtccagg

SEQ ID NO: 9708 - DNA, 22 bp, synthetic construct
  misc_feature 1..22: note = Description of Artificial Sequence: Syntheticoligonucleotide
  source 1..22: mol_type = other DNA
gtgactctacgtagagtcacgg

SEQ ID NO: 9709 - DNA, 22 bp, synthetic construct
  misc_feature 1..22: note = Description of Artificial Sequence: Syntheticoligonucleotide
  source 1..22: mol_type = other DNA
gcgactctacgtagagtcgccg

SEQ ID NO: 9710 - DNA, 22 bp, synthetic construct
  misc_feature 1..22: note = Description of Artificial Sequence: Syntheticoligonucleotide
  source 1..22: mol_type = other DNA
gcgactctacgtagagtcgctg

SEQ ID NO: 9711 - DNA, 22 bp, synthetic construct
  misc_feature 1..22: note = Description of Artificial Sequence: Syntheticoligonucleotide
  source 1..22: mol_type = other DNA
acgactctacgtagagtcgtcg

SEQ ID NO: 9712 - DNA, 22 bp, synthetic construct
  misc_feature 1..22: note = Description of Artificial Sequence: Syntheticoligonucleotide
  source 1..22: mol_type = other DNA
gagactctacgtagagtctccg

SEQ ID NO: 9713 - DNA, 22 bp, synthetic construct
  misc_feature 1..22: note = Description of Artificial Sequence: Syntheticoligonucleotide
  source 1..22: mol_type = other DNA
gcgactctacgtagagtcgcag

SEQ ID NO: 9714 - DNA, 22 bp, synthetic construct
  misc_feature 1..22: note = Description of Artificial Sequence: Syntheticoligonucleotide
  source 1..22: mol_type = other DNA
gtgactctacgtagagtcaccg

SEQ ID NO: 9715 - DNA, 22 bp, synthetic construct
  misc_feature 1..22: note = Description of Artificial Sequence: Syntheticoligonucleotide
  source 1..22: mol_type = other DNA
cggactctacgtagagtccgtg

SEQ ID NO: 9716 - DNA, 22 bp, synthetic construct
  misc_feature 1..22: note = Description of Artificial Sequence: Syntheticoligonucleotide
  source 1..22: mol_type = other DNA
cagactctacgtagagtctggg

SEQ ID NO: 9717 - DNA, 22 bp, synthetic construct
  misc_feature 1..22: note = Description of Artificial Sequence: Syntheticoligonucleotide
  source 1..22: mol_type = other DNA
cggactctacgtagagtccgag

SEQ ID NO: 9718 - DNA, 22 bp, synthetic construct
  misc_feature 1..22: note = Description of Artificial Sequence: Syntheticoligonucleotide
  source 1..22: mol_type = other DNA
ctgactctacgtagagtcaggg

SEQ ID NO: 9719 - DNA, 22 bp, synthetic construct
  misc_feature 1..22: note = Description of Artificial Sequence: Syntheticoligonucleotide
  source 1..22: mol_type = other DNA
acgactctacgtagagtcgtgg

SEQ ID NO: 9720 - DNA, 22 bp, synthetic construct
  misc_feature 1..22: note = Description of Artificial Sequence: Syntheticoligonucleotide
  source 1..22: mol_type = other DNA
ccgactctacgtagagtcggct

SEQ ID NO: 9721 - DNA, 22 bp, synthetic construct
  misc_feature 1..22: note = Description of Artificial Sequence: Syntheticoligonucleotide
  source 1..22: mol_type = other DNA
ccgactctacgtagagtcggca

SEQ ID NO: 9722 - DNA, 22 bp, synthetic construct
  misc_feature 1..22: note = Description of Artificial Sequence: Syntheticoligonucleotide
  source 1..22: mol_type = other DNA
gagactctacgtagagtctcgc

SEQ ID NO: 9723 - DNA, 22 bp, synthetic construct
  misc_feature 1..22: note = Description of Artificial Sequence: Syntheticoligonucleotide
  source 1..22: mol_type = other DNA
gtgactctacgtagagtcacgc

SEQ ID NO: 9724 - DNA, 22 bp, synthetic construct
  misc_feature 1..22: note = Description of Artificial Sequence: Syntheticoligonucleotide
  source 1..22: mol_type = other DNA
aggactctacgtagagtcctgc

SEQ ID NO: 9725 - DNA, 22 bp, synthetic construct
  misc_feature 1..22: note = Description of Artificial Sequence: Syntheticoligonucleotide
  source 1..22: mol_type = other DNA
tggactctacgtagagtccagc

SEQ ID NO: 9726 - DNA, 22 bp, synthetic construct
  misc_feature 1..22: note = Description of Artificial Sequence: Syntheticoligonucleotide
  source 1..22: mol_type = other DNA
aggactctacgtagagtcctcg

SEQ ID NO: 9727 - DNA, 22 bp, synthetic construct
  misc_feature 1..22: note = Description of Artificial Sequence: Syntheticoligonucleotide
  source 1..22: mol_type = other DNA
tggactctacgtagagtccacg

SEQ ID NO: 9728 - DNA, 22 bp, synthetic construct
  misc_feature 1..22: note = Description of Artificial Sequence: Syntheticoligonucleotide
  source 1..22: mol_type = other DNA
ccgactctacgtagagtcggtg

SEQ ID NO: 9729 - DNA, 22 bp, synthetic construct
  misc_feature 1..22: note = Description of Artificial Sequence: Syntheticoligonucleotide
  source 1..22: mol_type = other DNA
ccgactctacgtagagtcggag

SEQ ID NO: 9730 - DNA, 22 bp, synthetic construct
  misc_feature 1..22: note = Description of Artificial Sequence: Syntheticoligonucleotide
  source 1..22: mol_type = other DNA
gggactctacgtagagtcccgc

SEQ ID NO: 9731 - DNA, 22 bp, synthetic construct
  misc_feature 1..22: note = Description of Artificial Sequence: Syntheticoligonucleotide
  source 1..22: mol_type = other DNA
gggactctacgtagagtccctc

SEQ ID NO: 9732 - DNA, 22 bp, synthetic construct
  misc_feature 1..22: note = Description of Artificial Sequence: Syntheticoligonucleotide
  source 1..22: mol_type = other DNA
gggactctacgtagagtcccac

SEQ ID NO: 9733 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcatatatgagtcnnnn

SEQ ID NO: 9734 - DNA, 22 bp, synthetic construct
  misc_feature 1..22: note = Description of Artificial Sequence: Syntheticoligonucleotide
  source 1..22: mol_type = other DNA
cggactcatatatgagtccgcc

SEQ ID NO: 9735 - DNA, 22 bp, synthetic construct
  misc_feature 1..22: note = Description of Artificial Sequence: Syntheticoligonucleotide
  source 1..22: mol_type = other DNA
cggactcatatatgagtccgct

SEQ ID NO: 9736 - DNA, 22 bp, synthetic construct
  misc_feature 1..22: note = Description of Artificial Sequence: Syntheticoligonucleotide
  source 1..22: mol_type = other DNA
cggactcatatatgagtccgtc

SEQ ID NO: 9737 - DNA, 22 bp, synthetic construct
  misc_feature 1..22: note = Description of Artificial Sequence: Syntheticoligonucleotide
  source 1..22: mol_type = other DNA
aggactcatatatgagtcctcc

SEQ ID NO: 9738 - DNA, 22 bp, synthetic construct
  misc_feature 1..22: note = Description of Artificial Sequence: Syntheticoligonucleotide
  source 1..22: mol_type = other DNA
cagactcatatatgagtctgcc

SEQ ID NO: 9739 - DNA, 22 bp, synthetic construct
  misc_feature 1..22: note = Description of Artificial Sequence: Syntheticoligonucleotide
  source 1..22: mol_type = other DNA
cggactcatatatgagtccgca

SEQ ID NO: 9740 - DNA, 22 bp, synthetic construct
  misc_feature 1..22: note = Description of Artificial Sequence: Syntheticoligonucleotide
  source 1..22: mol_type = other DNA
cggactcatatatgagtccgac

SEQ ID NO: 9741 - DNA, 22 bp, synthetic construct
  misc_feature 1..22: note = Description of Artificial Sequence: Syntheticoligonucleotide
  source 1..22: mol_type = other DNA
tggactcatatatgagtccacc

SEQ ID NO: 9742 - DNA, 22 bp, synthetic construct
  misc_feature 1..22: note = Description of Artificial Sequence: Syntheticoligonucleotide
  source 1..22: mol_type = other DNA
ctgactcatatatgagtcagcc

SEQ ID NO: 9743 - DNA, 22 bp, synthetic construct
  misc_feature 1..22: note = Description of Artificial Sequence: Syntheticoligonucleotide
  source 1..22: mol_type = other DNA
ccgactcatatatgagtcgggc

SEQ ID NO: 9744 - DNA, 22 bp, synthetic construct
  misc_feature 1..22: note = Description of Artificial Sequence: Syntheticoligonucleotide
  source 1..22: mol_type = other DNA
ccgactcatatatgagtcgggt

SEQ ID NO: 9745 - DNA, 22 bp, synthetic construct
  misc_feature 1..22: note = Description of Artificial Sequence: Syntheticoligonucleotide
  source 1..22: mol_type = other DNA
ccgactcatatatgagtcggtc

SEQ ID NO: 9746 - DNA, 22 bp, synthetic construct
  misc_feature 1..22: note = Description of Artificial Sequence: Syntheticoligonucleotide
  source 1..22: mol_type = other DNA
acgactcatatatgagtcgtgc

SEQ ID NO: 9747 - DNA, 22 bp, synthetic construct
  misc_feature 1..22: note = Description of Artificial Sequence: Syntheticoligonucleotide
  source 1..22: mol_type = other DNA
cagactcatatatgagtctggc

SEQ ID NO: 9748 - DNA, 22 bp, synthetic construct
  misc_feature 1..22: note = Description of Artificial Sequence: Syntheticoligonucleotide
  source 1..22: mol_type = other DNA
ccgactcatatatgagtcggga

SEQ ID NO: 9749 - DNA, 22 bp, synthetic construct
  misc_feature 1..22: note = Description of Artificial Sequence: Syntheticoligonucleotide
  source 1..22: mol_type = other DNA
ccgactcatatatgagtcggac

SEQ ID NO: 9750 - DNA, 22 bp, synthetic construct
  misc_feature 1..22: note = Description of Artificial Sequence: Syntheticoligonucleotide
  source 1..22: mol_type = other DNA
ctgactcatatatgagtcaggc

SEQ ID NO: 9751 - DNA, 22 bp, synthetic construct
  misc_feature 1..22: note = Description of Artificial Sequence: Syntheticoligonucleotide
  source 1..22: mol_type = other DNA
gcgactcatatatgagtcgccc

SEQ ID NO: 9752 - DNA, 22 bp, synthetic construct
  misc_feature 1..22: note = Description of Artificial Sequence: Syntheticoligonucleotide
  source 1..22: mol_type = other DNA
gcgactcatatatgagtcgcct

SEQ ID NO: 9753 - DNA, 22 bp, synthetic construct
  misc_feature 1..22: note = Description of Artificial Sequence: Syntheticoligonucleotide
  source 1..22: mol_type = other DNA
gcgactcatatatgagtcgctc

SEQ ID NO: 9754 - DNA, 22 bp, synthetic construct
  misc_feature 1..22: note = Description of Artificial Sequence: Syntheticoligonucleotide
  source 1..22: mol_type = other DNA
acgactcatatatgagtcgtcc

SEQ ID NO: 9755 - DNA, 22 bp, synthetic construct
  misc_feature 1..22: note = Description of Artificial Sequence: Syntheticoligonucleotide
  source 1..22: mol_type = other DNA
gagactcatatatgagtctccc

SEQ ID NO: 9756 - DNA, 22 bp, synthetic construct
  misc_feature 1..22: note = Description of Artificial Sequence: Syntheticoligonucleotide
  source 1..22: mol_type = other DNA
gcgactcatatatgagtcgcca

SEQ ID NO: 9757 - DNA, 22 bp, synthetic construct
  misc_feature 1..22: note = Description of Artificial Sequence: Syntheticoligonucleotide
  source 1..22: mol_type = other DNA
gcgactcatatatgagtcgcac

SEQ ID NO: 9758 - DNA, 22 bp, synthetic construct
  misc_feature 1..22: note = Description of Artificial Sequence: Syntheticoligonucleotide
  source 1..22: mol_type = other DNA
gtgactcatatatgagtcaccc

SEQ ID NO: 9759 - DNA, 22 bp, synthetic construct
  misc_feature 1..22: note = Description of Artificial Sequence: Syntheticoligonucleotide
  source 1..22: mol_type = other DNA
gggactcatatatgagtcccgt

SEQ ID NO: 9760 - DNA, 22 bp, synthetic construct
  misc_feature 1..22: note = Description of Artificial Sequence: Syntheticoligonucleotide
  source 1..22: mol_type = other DNA
gggactcatatatgagtccctg

SEQ ID NO: 9761 - DNA, 22 bp, synthetic construct
  misc_feature 1..22: note = Description of Artificial Sequence: Syntheticoligonucleotide
  source 1..22: mol_type = other DNA
aggactcatatatgagtcctgg

SEQ ID NO: 9762 - DNA, 22 bp, synthetic construct
  misc_feature 1..22: note = Description of Artificial Sequence: Syntheticoligonucleotide
  source 1..22: mol_type = other DNA
gagactcatatatgagtctcgg

SEQ ID NO: 9763 - DNA, 22 bp, synthetic construct
  misc_feature 1..22: note = Description of Artificial Sequence: Syntheticoligonucleotide
  source 1..22: mol_type = other DNA
gggactcatatatgagtcccga

SEQ ID NO: 9764 - DNA, 22 bp, synthetic construct
  misc_feature 1..22: note = Description of Artificial Sequence: Syntheticoligonucleotide
  source 1..22: mol_type = other DNA
gggactcatatatgagtcccag

SEQ ID NO: 9765 - DNA, 22 bp, synthetic construct
  misc_feature 1..22: note = Description of Artificial Sequence: Syntheticoligonucleotide
  source 1..22: mol_type = other DNA
tggactcatatatgagtccagg

SEQ ID NO: 9766 - DNA, 22 bp, synthetic construct
  misc_feature 1..22: note = Description of Artificial Sequence: Syntheticoligonucleotide
  source 1..22: mol_type = other DNA
gtgactcatatatgagtcacgg

SEQ ID NO: 9767 - DNA, 22 bp, synthetic construct
  misc_feature 1..22: note = Description of Artificial Sequence: Syntheticoligonucleotide
  source 1..22: mol_type = other DNA
gcgactcatatatgagtcgccg

SEQ ID NO: 9768 - DNA, 22 bp, synthetic construct
  misc_feature 1..22: note = Description of Artificial Sequence: Syntheticoligonucleotide
  source 1..22: mol_type = other DNA
gcgactcatatatgagtcgctg

SEQ ID NO: 9769 - DNA, 22 bp, synthetic construct
  misc_feature 1..22: note = Description of Artificial Sequence: Syntheticoligonucleotide
  source 1..22: mol_type = other DNA
acgactcatatatgagtcgtcg

SEQ ID NO: 9770 - DNA, 22 bp, synthetic construct
  misc_feature 1..22: note = Description of Artificial Sequence: Syntheticoligonucleotide
  source 1..22: mol_type = other DNA
gagactcatatatgagtctccg

SEQ ID NO: 9771 - DNA, 22 bp, synthetic construct
  misc_feature 1..22: note = Description of Artificial Sequence: Syntheticoligonucleotide
  source 1..22: mol_type = other DNA
gcgactcatatatgagtcgcag

SEQ ID NO: 9772 - DNA, 22 bp, synthetic construct
  misc_feature 1..22: note = Description of Artificial Sequence: Syntheticoligonucleotide
  source 1..22: mol_type = other DNA
gtgactcatatatgagtcaccg

SEQ ID NO: 9773 - DNA, 22 bp, synthetic construct
  misc_feature 1..22: note = Description of Artificial Sequence: Syntheticoligonucleotide
  source 1..22: mol_type = other DNA
cggactcatatatgagtccgtg

SEQ ID NO: 9774 - DNA, 22 bp, synthetic construct
  misc_feature 1..22: note = Description of Artificial Sequence: Syntheticoligonucleotide
  source 1..22: mol_type = other DNA
cagactcatatatgagtctggg

SEQ ID NO: 9775 - DNA, 22 bp, synthetic construct
  misc_feature 1..22: note = Description of Artificial Sequence: Syntheticoligonucleotide
  source 1..22: mol_type = other DNA
cggactcatatatgagtccgag

SEQ ID NO: 9776 - DNA, 22 bp, synthetic construct
  misc_feature 1..22: note = Description of Artificial Sequence: Syntheticoligonucleotide
  source 1..22: mol_type = other DNA
ctgactcatatatgagtcaggg

SEQ ID NO: 9777 - DNA, 22 bp, synthetic construct
  misc_feature 1..22: note = Description of Artificial Sequence: Syntheticoligonucleotide
  source 1..22: mol_type = other DNA
acgactcatatatgagtcgtgg

SEQ ID NO: 9778 - DNA, 22 bp, synthetic construct
  misc_feature 1..22: note = Description of Artificial Sequence: Syntheticoligonucleotide
  source 1..22: mol_type = other DNA
ccgactcatatatgagtcggct

SEQ ID NO: 9779 - DNA, 22 bp, synthetic construct
  misc_feature 1..22: note = Description of Artificial Sequence: Syntheticoligonucleotide
  source 1..22: mol_type = other DNA
ccgactcatatatgagtcggca

SEQ ID NO: 9780 - DNA, 22 bp, synthetic construct
  misc_feature 1..22: note = Description of Artificial Sequence: Syntheticoligonucleotide
  source 1..22: mol_type = other DNA
gagactcatatatgagtctcgc

SEQ ID NO: 9781 - DNA, 22 bp, synthetic construct
  misc_feature 1..22: note = Description of Artificial Sequence: Syntheticoligonucleotide
  source 1..22: mol_type = other DNA
gtgactcatatatgagtcacgc

SEQ ID NO: 9782 - DNA, 22 bp, synthetic construct
  misc_feature 1..22: note = Description of Artificial Sequence: Syntheticoligonucleotide
  source 1..22: mol_type = other DNA
aggactcatatatgagtcctgc

SEQ ID NO: 9783 - DNA, 22 bp, synthetic construct
  misc_feature 1..22: note = Description of Artificial Sequence: Syntheticoligonucleotide
  source 1..22: mol_type = other DNA
tggactcatatatgagtccagc

SEQ ID NO: 9784 - DNA, 22 bp, synthetic construct
  misc_feature 1..22: note = Description of Artificial Sequence: Syntheticoligonucleotide
  source 1..22: mol_type = other DNA
aggactcatatatgagtcctcg

SEQ ID NO: 9785 - DNA, 22 bp, synthetic construct
  misc_feature 1..22: note = Description of Artificial Sequence: Syntheticoligonucleotide
  source 1..22: mol_type = other DNA
tggactcatatatgagtccacg

SEQ ID NO: 9786 - DNA, 22 bp, synthetic construct
  misc_feature 1..22: note = Description of Artificial Sequence: Syntheticoligonucleotide
  source 1..22: mol_type = other DNA
ccgactcatatatgagtcggtg

SEQ ID NO: 9787 - DNA, 22 bp, synthetic construct
  misc_feature 1..22: note = Description of Artificial Sequence: Syntheticoligonucleotide
  source 1..22: mol_type = other DNA
ccgactcatatatgagtcggag

SEQ ID NO: 9788 - DNA, 22 bp, synthetic construct
  misc_feature 1..22: note = Description of Artificial Sequence: Syntheticoligonucleotide
  source 1..22: mol_type = other DNA
gggactcatatatgagtcccgc

SEQ ID NO: 9789 - DNA, 22 bp, synthetic construct
  misc_feature 1..22: note = Description of Artificial Sequence: Syntheticoligonucleotide
  source 1..22: mol_type = other DNA
gggactcatatatgagtccctc

SEQ ID NO: 9790 - DNA, 22 bp, synthetic construct
  misc_feature 1..22: note = Description of Artificial Sequence: Syntheticoligonucleotide
  source 1..22: mol_type = other DNA
gggactcatatatgagtcccac

SEQ ID NO: 9791 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcattaatgagtcnnnn

SEQ ID NO: 9792 - DNA, 22 bp, synthetic construct
  misc_feature 1..22: note = Description of Artificial Sequence: Syntheticoligonucleotide
  source 1..22: mol_type = other DNA
cggactcattaatgagtccgcc

SEQ ID NO: 9793 - DNA, 22 bp, synthetic construct
  misc_feature 1..22: note = Description of Artificial Sequence: Syntheticoligonucleotide
  source 1..22: mol_type = other DNA
cggactcattaatgagtccgct

SEQ ID NO: 9794 - DNA, 22 bp, synthetic construct
  misc_feature 1..22: note = Description of Artificial Sequence: Syntheticoligonucleotide
  source 1..22: mol_type = other DNA
cggactcattaatgagtccgtc

SEQ ID NO: 9795 - DNA, 22 bp, synthetic construct
  misc_feature 1..22: note = Description of Artificial Sequence: Syntheticoligonucleotide
  source 1..22: mol_type = other DNA
aggactcattaatgagtcctcc

SEQ ID NO: 9796 - DNA, 22 bp, synthetic construct
  misc_feature 1..22: note = Description of Artificial Sequence: Syntheticoligonucleotide
  source 1..22: mol_type = other DNA
cagactcattaatgagtctgcc

SEQ ID NO: 9797 - DNA, 22 bp, synthetic construct
  misc_feature 1..22: note = Description of Artificial Sequence: Syntheticoligonucleotide
  source 1..22: mol_type = other DNA
cggactcattaatgagtccgca

SEQ ID NO: 9798 - DNA, 22 bp, synthetic construct
  misc_feature 1..22: note = Description of Artificial Sequence: Syntheticoligonucleotide
  source 1..22: mol_type = other DNA
cggactcattaatgagtccgac

SEQ ID NO: 9799 - DNA, 22 bp, synthetic construct
  misc_feature 1..22: note = Description of Artificial Sequence: Syntheticoligonucleotide
  source 1..22: mol_type = other DNA
tggactcattaatgagtccacc

SEQ ID NO: 9800 - DNA, 22 bp, synthetic construct
  misc_feature 1..22: note = Description of Artificial Sequence: Syntheticoligonucleotide
  source 1..22: mol_type = other DNA
ctgactcattaatgagtcagcc

SEQ ID NO: 9801 - DNA, 22 bp, synthetic construct
  misc_feature 1..22: note = Description of Artificial Sequence: Syntheticoligonucleotide
  source 1..22: mol_type = other DNA
ccgactcattaatgagtcgggc

SEQ ID NO: 9802 - DNA, 22 bp, synthetic construct
  misc_feature 1..22: note = Description of Artificial Sequence: Syntheticoligonucleotide
  source 1..22: mol_type = other DNA
ccgactcattaatgagtcgggt

SEQ ID NO: 9803 - DNA, 22 bp, synthetic construct
  misc_feature 1..22: note = Description of Artificial Sequence: Syntheticoligonucleotide
  source 1..22: mol_type = other DNA
ccgactcattaatgagtcggtc

SEQ ID NO: 9804 - DNA, 22 bp, synthetic construct
  misc_feature 1..22: note = Description of Artificial Sequence: Syntheticoligonucleotide
  source 1..22: mol_type = other DNA
acgactcattaatgagtcgtgc

SEQ ID NO: 9805 - DNA, 22 bp, synthetic construct
  misc_feature 1..22: note = Description of Artificial Sequence: Syntheticoligonucleotide
  source 1..22: mol_type = other DNA
cagactcattaatgagtctggc

SEQ ID NO: 9806 - DNA, 22 bp, synthetic construct
  misc_feature 1..22: note = Description of Artificial Sequence: Syntheticoligonucleotide
  source 1..22: mol_type = other DNA
ccgactcattaatgagtcggga

SEQ ID NO: 9807 - DNA, 22 bp, synthetic construct
  misc_feature 1..22: note = Description of Artificial Sequence: Syntheticoligonucleotide
  source 1..22: mol_type = other DNA
ccgactcattaatgagtcggac

SEQ ID NO: 9808 - DNA, 22 bp, synthetic construct
  misc_feature 1..22: note = Description of Artificial Sequence: Syntheticoligonucleotide
  source 1..22: mol_type = other DNA
ctgactcattaatgagtcaggc

SEQ ID NO: 9809 - DNA, 22 bp, synthetic construct
  misc_feature 1..22: note = Description of Artificial Sequence: Syntheticoligonucleotide
  source 1..22: mol_type = other DNA
gcgactcattaatgagtcgccc

SEQ ID NO: 9810 - DNA, 22 bp, synthetic construct
  misc_feature 1..22: note = Description of Artificial Sequence: Syntheticoligonucleotide
  source 1..22: mol_type = other DNA
gcgactcattaatgagtcgcct

SEQ ID NO: 9811 - DNA, 22 bp, synthetic construct
  misc_feature 1..22: note = Description of Artificial Sequence: Syntheticoligonucleotide
  source 1..22: mol_type = other DNA
gcgactcattaatgagtcgctc

SEQ ID NO: 9812 - DNA, 22 bp, synthetic construct
  misc_feature 1..22: note = Description of Artificial Sequence: Syntheticoligonucleotide
  source 1..22: mol_type = other DNA
acgactcattaatgagtcgtcc

SEQ ID NO: 9813 - DNA, 22 bp, synthetic construct
  misc_feature 1..22: note = Description of Artificial Sequence: Syntheticoligonucleotide
  source 1..22: mol_type = other DNA
gagactcattaatgagtctccc

SEQ ID NO: 9814 - DNA, 22 bp, synthetic construct
  misc_feature 1..22: note = Description of Artificial Sequence: Syntheticoligonucleotide
  source 1..22: mol_type = other DNA
gcgactcattaatgagtcgcca

SEQ ID NO: 9815 - DNA, 22 bp, synthetic construct
  misc_feature 1..22: note = Description of Artificial Sequence: Syntheticoligonucleotide
  source 1..22: mol_type = other DNA
gcgactcattaatgagtcgcac

SEQ ID NO: 9816 - DNA, 22 bp, synthetic construct
  misc_feature 1..22: note = Description of Artificial Sequence: Syntheticoligonucleotide
  source 1..22: mol_type = other DNA
gtgactcattaatgagtcaccc

SEQ ID NO: 9817 - DNA, 22 bp, synthetic construct
  misc_feature 1..22: note = Description of Artificial Sequence: Syntheticoligonucleotide
  source 1..22: mol_type = other DNA
gggactcattaatgagtcccgt

SEQ ID NO: 9818 - DNA, 22 bp, synthetic construct
  misc_feature 1..22: note = Description of Artificial Sequence: Syntheticoligonucleotide
  source 1..22: mol_type = other DNA
gggactcattaatgagtccctg

SEQ ID NO: 9819 - DNA, 22 bp, synthetic construct
  misc_feature 1..22: note = Description of Artificial Sequence: Syntheticoligonucleotide
  source 1..22: mol_type = other DNA
aggactcattaatgagtcctgg

SEQ ID NO: 9820 - DNA, 22 bp, synthetic construct
  misc_feature 1..22: note = Description of Artificial Sequence: Syntheticoligonucleotide
  source 1..22: mol_type = other DNA
gagactcattaatgagtctcgg

SEQ ID NO: 9821 - DNA, 22 bp, synthetic construct
  misc_feature 1..22: note = Description of Artificial Sequence: Syntheticoligonucleotide
  source 1..22: mol_type = other DNA
gggactcattaatgagtcccga

SEQ ID NO: 9822 - DNA, 22 bp, synthetic construct
  misc_feature 1..22: note = Description of Artificial Sequence: Syntheticoligonucleotide
  source 1..22: mol_type = other DNA
gggactcattaatgagtcccag

SEQ ID NO: 9823 - DNA, 22 bp, synthetic construct
  misc_feature 1..22: note = Description of Artificial Sequence: Syntheticoligonucleotide
  source 1..22: mol_type = other DNA
tggactcattaatgagtccagg

SEQ ID NO: 9824 - DNA, 22 bp, synthetic construct
  misc_feature 1..22: note = Description of Artificial Sequence: Syntheticoligonucleotide
  source 1..22: mol_type = other DNA
gtgactcattaatgagtcacgg

SEQ ID NO: 9825 - DNA, 22 bp, synthetic construct
  misc_feature 1..22: note = Description of Artificial Sequence: Syntheticoligonucleotide
  source 1..22: mol_type = other DNA
gcgactcattaatgagtcgccg

SEQ ID NO: 9826 - DNA, 22 bp, synthetic construct
  misc_feature 1..22: note = Description of Artificial Sequence: Syntheticoligonucleotide
  source 1..22: mol_type = other DNA
gcgactcattaatgagtcgctg

SEQ ID NO: 9827 - DNA, 22 bp, synthetic construct
  misc_feature 1..22: note = Description of Artificial Sequence: Syntheticoligonucleotide
  source 1..22: mol_type = other DNA
acgactcattaatgagtcgtcg

SEQ ID NO: 9828 - DNA, 22 bp, synthetic construct
  misc_feature 1..22: note = Description of Artificial Sequence: Syntheticoligonucleotide
  source 1..22: mol_type = other DNA
gagactcattaatgagtctccg

SEQ ID NO: 9829 - DNA, 22 bp, synthetic construct
  misc_feature 1..22: note = Description of Artificial Sequence: Syntheticoligonucleotide
  source 1..22: mol_type = other DNA
gcgactcattaatgagtcgcag

SEQ ID NO: 9830 - DNA, 22 bp, synthetic construct
  misc_feature 1..22: note = Description of Artificial Sequence: Syntheticoligonucleotide
  source 1..22: mol_type = other DNA
gtgactcattaatgagtcaccg

SEQ ID NO: 9831 - DNA, 22 bp, synthetic construct
  misc_feature 1..22: note = Description of Artificial Sequence: Syntheticoligonucleotide
  source 1..22: mol_type = other DNA
cggactcattaatgagtccgtg

SEQ ID NO: 9832 - DNA, 22 bp, synthetic construct
  misc_feature 1..22: note = Description of Artificial Sequence: Syntheticoligonucleotide
  source 1..22: mol_type = other DNA
cagactcattaatgagtctggg

SEQ ID NO: 9833 - DNA, 22 bp, synthetic construct
  misc_feature 1..22: note = Description of Artificial Sequence: Syntheticoligonucleotide
  source 1..22: mol_type = other DNA
cggactcattaatgagtccgag

SEQ ID NO: 9834 - DNA, 22 bp, synthetic construct
  misc_feature 1..22: note = Description of Artificial Sequence: Syntheticoligonucleotide
  source 1..22: mol_type = other DNA
ctgactcattaatgagtcaggg

SEQ ID NO: 9835 - DNA, 22 bp, synthetic construct
  misc_feature 1..22: note = Description of Artificial Sequence: Syntheticoligonucleotide
  source 1..22: mol_type = other DNA
acgactcattaatgagtcgtgg

SEQ ID NO: 9836 - DNA, 22 bp, synthetic construct
  misc_feature 1..22: note = Description of Artificial Sequence: Syntheticoligonucleotide
  source 1..22: mol_type = other DNA
ccgactcattaatgagtcggct

SEQ ID NO: 9837 - DNA, 22 bp, synthetic construct
  misc_feature 1..22: note = Description of Artificial Sequence: Syntheticoligonucleotide
  source 1..22: mol_type = other DNA
ccgactcattaatgagtcggca

SEQ ID NO: 9838 - DNA, 22 bp, synthetic construct
  misc_feature 1..22: note = Description of Artificial Sequence: Syntheticoligonucleotide
  source 1..22: mol_type = other DNA
gagactcattaatgagtctcgc

SEQ ID NO: 9839 - DNA, 22 bp, synthetic construct
  misc_feature 1..22: note = Description of Artificial Sequence: Syntheticoligonucleotide
  source 1..22: mol_type = other DNA
gtgactcattaatgagtcacgc

SEQ ID NO: 9840 - DNA, 22 bp, synthetic construct
  misc_feature 1..22: note = Description of Artificial Sequence: Syntheticoligonucleotide
  source 1..22: mol_type = other DNA
aggactcattaatgagtcctgc

SEQ ID NO: 9841 - DNA, 22 bp, synthetic construct
  misc_feature 1..22: note = Description of Artificial Sequence: Syntheticoligonucleotide
  source 1..22: mol_type = other DNA
tggactcattaatgagtccagc

SEQ ID NO: 9842 - DNA, 22 bp, synthetic construct
  misc_feature 1..22: note = Description of Artificial Sequence: Syntheticoligonucleotide
  source 1..22: mol_type = other DNA
aggactcattaatgagtcctcg

SEQ ID NO: 9843 - DNA, 22 bp, synthetic construct
  misc_feature 1..22: note = Description of Artificial Sequence: Syntheticoligonucleotide
  source 1..22: mol_type = other DNA
tggactcattaatgagtccacg

SEQ ID NO: 9844 - DNA, 22 bp, synthetic construct
  misc_feature 1..22: note = Description of Artificial Sequence: Syntheticoligonucleotide
  source 1..22: mol_type = other DNA
ccgactcattaatgagtcggtg

SEQ ID NO: 9845 - DNA, 22 bp, synthetic construct
  misc_feature 1..22: note = Description of Artificial Sequence: Syntheticoligonucleotide
  source 1..22: mol_type = other DNA
ccgactcattaatgagtcggag

SEQ ID NO: 9846 - DNA, 22 bp, synthetic construct
  misc_feature 1..22: note = Description of Artificial Sequence: Syntheticoligonucleotide
  source 1..22: mol_type = other DNA
gggactcattaatgagtcccgc

SEQ ID NO: 9847 - DNA, 22 bp, synthetic construct
  misc_feature 1..22: note = Description of Artificial Sequence: Syntheticoligonucleotide
  source 1..22: mol_type = other DNA
gggactcattaatgagtccctc

SEQ ID NO: 9848 - DNA, 22 bp, synthetic construct
  misc_feature 1..22: note = Description of Artificial Sequence: Syntheticoligonucleotide
  source 1..22: mol_type = other DNA
gggactcattaatgagtcccac

SEQ ID NO: 9849 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcatgcatgagtcnnnn

SEQ ID NO: 9850 - DNA, 22 bp, synthetic construct
  misc_feature 1..22: note = Description of Artificial Sequence: Syntheticoligonucleotide
  source 1..22: mol_type = other DNA
cggactcatgcatgagtccgcc

SEQ ID NO: 9851 - DNA, 22 bp, synthetic construct
  misc_feature 1..22: note = Description of Artificial Sequence: Syntheticoligonucleotide
  source 1..22: mol_type = other DNA
cggactcatgcatgagtccgct

SEQ ID NO: 9852 - DNA, 22 bp, synthetic construct
  misc_feature 1..22: note = Description of Artificial Sequence: Syntheticoligonucleotide
  source 1..22: mol_type = other DNA
cggactcatgcatgagtccgtc

SEQ ID NO: 9853 - DNA, 22 bp, synthetic construct
  misc_feature 1..22: note = Description of Artificial Sequence: Syntheticoligonucleotide
  source 1..22: mol_type = other DNA
aggactcatgcatgagtcctcc

SEQ ID NO: 9854 - DNA, 22 bp, synthetic construct
  misc_feature 1..22: note = Description of Artificial Sequence: Syntheticoligonucleotide
  source 1..22: mol_type = other DNA
cagactcatgcatgagtctgcc

SEQ ID NO: 9855 - DNA, 22 bp, synthetic construct
  misc_feature 1..22: note = Description of Artificial Sequence: Syntheticoligonucleotide
  source 1..22: mol_type = other DNA
cggactcatgcatgagtccgca

SEQ ID NO: 9856 - DNA, 22 bp, synthetic construct
  misc_feature 1..22: note = Description of Artificial Sequence: Syntheticoligonucleotide
  source 1..22: mol_type = other DNA
cggactcatgcatgagtccgac

SEQ ID NO: 9857 - DNA, 22 bp, synthetic construct
  misc_feature 1..22: note = Description of Artificial Sequence: Syntheticoligonucleotide
  source 1..22: mol_type = other DNA
tggactcatgcatgagtccacc

SEQ ID NO: 9858 - DNA, 22 bp, synthetic construct
  misc_feature 1..22: note = Description of Artificial Sequence: Syntheticoligonucleotide
  source 1..22: mol_type = other DNA
ctgactcatgcatgagtcagcc

SEQ ID NO: 9859 - DNA, 22 bp, synthetic construct
  misc_feature 1..22: note = Description of Artificial Sequence: Syntheticoligonucleotide
  source 1..22: mol_type = other DNA
ccgactcatgcatgagtcgggc

SEQ ID NO: 9860 - DNA, 22 bp, synthetic construct
  misc_feature 1..22: note = Description of Artificial Sequence: Syntheticoligonucleotide
  source 1..22: mol_type = other DNA
ccgactcatgcatgagtcgggt

SEQ ID NO: 9861 - DNA, 22 bp, synthetic construct
  misc_feature 1..22: note = Description of Artificial Sequence: Syntheticoligonucleotide
  source 1..22: mol_type = other DNA
ccgactcatgcatgagtcggtc

SEQ ID NO: 9862 - DNA, 22 bp, synthetic construct
  misc_feature 1..22: note = Description of Artificial Sequence: Syntheticoligonucleotide
  source 1..22: mol_type = other DNA
acgactcatgcatgagtcgtgc

SEQ ID NO: 9863 - DNA, 22 bp, synthetic construct
  misc_feature 1..22: note = Description of Artificial Sequence: Syntheticoligonucleotide
  source 1..22: mol_type = other DNA
cagactcatgcatgagtctggc

SEQ ID NO: 9864 - DNA, 22 bp, synthetic construct
  misc_feature 1..22: note = Description of Artificial Sequence: Syntheticoligonucleotide
  source 1..22: mol_type = other DNA
ccgactcatgcatgagtcggga

SEQ ID NO: 9865 - DNA, 22 bp, synthetic construct
  misc_feature 1..22: note = Description of Artificial Sequence: Syntheticoligonucleotide
  source 1..22: mol_type = other DNA
ccgactcatgcatgagtcggac

SEQ ID NO: 9866 - DNA, 22 bp, synthetic construct
  misc_feature 1..22: note = Description of Artificial Sequence: Syntheticoligonucleotide
  source 1..22: mol_type = other DNA
ctgactcatgcatgagtcaggc

SEQ ID NO: 9867 - DNA, 22 bp, synthetic construct
  misc_feature 1..22: note = Description of Artificial Sequence: Syntheticoligonucleotide
  source 1..22: mol_type = other DNA
gcgactcatgcatgagtcgccc

SEQ ID NO: 9868 - DNA, 22 bp, synthetic construct
  misc_feature 1..22: note = Description of Artificial Sequence: Syntheticoligonucleotide
  source 1..22: mol_type = other DNA
gcgactcatgcatgagtcgcct

SEQ ID NO: 9869 - DNA, 22 bp, synthetic construct
  misc_feature 1..22: note = Description of Artificial Sequence: Syntheticoligonucleotide
  source 1..22: mol_type = other DNA
gcgactcatgcatgagtcgctc

SEQ ID NO: 9870 - DNA, 22 bp, synthetic construct
  misc_feature 1..22: note = Description of Artificial Sequence: Syntheticoligonucleotide
  source 1..22: mol_type = other DNA
acgactcatgcatgagtcgtcc

SEQ ID NO: 9871 - DNA, 22 bp, synthetic construct
  misc_feature 1..22: note = Description of Artificial Sequence: Syntheticoligonucleotide
  source 1..22: mol_type = other DNA
gagactcatgcatgagtctccc

SEQ ID NO: 9872 - DNA, 22 bp, synthetic construct
  misc_feature 1..22: note = Description of Artificial Sequence: Syntheticoligonucleotide
  source 1..22: mol_type = other DNA
gcgactcatgcatgagtcgcca

SEQ ID NO: 9873 - DNA, 22 bp, synthetic construct
  misc_feature 1..22: note = Description of Artificial Sequence: Syntheticoligonucleotide
  source 1..22: mol_type = other DNA
gcgactcatgcatgagtcgcac

SEQ ID NO: 9874 - DNA, 22 bp, synthetic construct
  misc_feature 1..22: note = Description of Artificial Sequence: Syntheticoligonucleotide
  source 1..22: mol_type = other DNA
gtgactcatgcatgagtcaccc

SEQ ID NO: 9875 - DNA, 22 bp, synthetic construct
  misc_feature 1..22: note = Description of Artificial Sequence: Syntheticoligonucleotide
  source 1..22: mol_type = other DNA
gggactcatgcatgagtcccgt

SEQ ID NO: 9876 - DNA, 22 bp, synthetic construct
  misc_feature 1..22: note = Description of Artificial Sequence: Syntheticoligonucleotide
  source 1..22: mol_type = other DNA
gggactcatgcatgagtccctg

SEQ ID NO: 9877 - DNA, 22 bp, synthetic construct
  misc_feature 1..22: note = Description of Artificial Sequence: Syntheticoligonucleotide
  source 1..22: mol_type = other DNA
aggactcatgcatgagtcctgg

SEQ ID NO: 9878 - DNA, 22 bp, synthetic construct
  misc_feature 1..22: note = Description of Artificial Sequence: Syntheticoligonucleotide
  source 1..22: mol_type = other DNA
gagactcatgcatgagtctcgg

SEQ ID NO: 9879 - DNA, 22 bp, synthetic construct
  misc_feature 1..22: note = Description of Artificial Sequence: Syntheticoligonucleotide
  source 1..22: mol_type = other DNA
gggactcatgcatgagtcccga

SEQ ID NO: 9880 - DNA, 22 bp, synthetic construct
  misc_feature 1..22: note = Description of Artificial Sequence: Syntheticoligonucleotide
  source 1..22: mol_type = other DNA
gggactcatgcatgagtcccag

SEQ ID NO: 9881 - DNA, 22 bp, synthetic construct
  misc_feature 1..22: note = Description of Artificial Sequence: Syntheticoligonucleotide
  source 1..22: mol_type = other DNA
tggactcatgcatgagtccagg

SEQ ID NO: 9882 - DNA, 22 bp, synthetic construct
  misc_feature 1..22: note = Description of Artificial Sequence: Syntheticoligonucleotide
  source 1..22: mol_type = other DNA
gtgactcatgcatgagtcacgg

SEQ ID NO: 9883 - DNA, 22 bp, synthetic construct
  misc_feature 1..22: note = Description of Artificial Sequence: Syntheticoligonucleotide
  source 1..22: mol_type = other DNA
gcgactcatgcatgagtcgccg

SEQ ID NO: 9884 - DNA, 22 bp, synthetic construct
  misc_feature 1..22: note = Description of Artificial Sequence: Syntheticoligonucleotide
  source 1..22: mol_type = other DNA
gcgactcatgcatgagtcgctg

SEQ ID NO: 9885 - DNA, 22 bp, synthetic construct
  misc_feature 1..22: note = Description of Artificial Sequence: Syntheticoligonucleotide
  source 1..22: mol_type = other DNA
acgactcatgcatgagtcgtcg

SEQ ID NO: 9886 - DNA, 22 bp, synthetic construct
  misc_feature 1..22: note = Description of Artificial Sequence: Syntheticoligonucleotide
  source 1..22: mol_type = other DNA
gagactcatgcatgagtctccg

SEQ ID NO: 9887 - DNA, 22 bp, synthetic construct
  misc_feature 1..22: note = Description of Artificial Sequence: Syntheticoligonucleotide
  source 1..22: mol_type = other DNA
gcgactcatgcatgagtcgcag

SEQ ID NO: 9888 - DNA, 22 bp, synthetic construct
  misc_feature 1..22: note = Description of Artificial Sequence: Syntheticoligonucleotide
  source 1..22: mol_type = other DNA
gtgactcatgcatgagtcaccg

SEQ ID NO: 9889 - DNA, 22 bp, synthetic construct
  misc_feature 1..22: note = Description of Artificial Sequence: Syntheticoligonucleotide
  source 1..22: mol_type = other DNA
cggactcatgcatgagtccgtg

SEQ ID NO: 9890 - DNA, 22 bp, synthetic construct
  misc_feature 1..22: note = Description of Artificial Sequence: Syntheticoligonucleotide
  source 1..22: mol_type = other DNA
cagactcatgcatgagtctggg

SEQ ID NO: 9891 - DNA, 22 bp, synthetic construct
  misc_feature 1..22: note = Description of Artificial Sequence: Syntheticoligonucleotide
  source 1..22: mol_type = other DNA
cggactcatgcatgagtccgag

SEQ ID NO: 9892 - DNA, 22 bp, synthetic construct
  misc_feature 1..22: note = Description of Artificial Sequence: Syntheticoligonucleotide
  source 1..22: mol_type = other DNA
ctgactcatgcatgagtcaggg

SEQ ID NO: 9893 - DNA, 22 bp, synthetic construct
  misc_feature 1..22: note = Description of Artificial Sequence: Syntheticoligonucleotide
  source 1..22: mol_type = other DNA
acgactcatgcatgagtcgtgg

SEQ ID NO: 9894 - DNA, 22 bp, synthetic construct
  misc_feature 1..22: note = Description of Artificial Sequence: Syntheticoligonucleotide
  source 1..22: mol_type = other DNA
ccgactcatgcatgagtcggct

SEQ ID NO: 9895 - DNA, 22 bp, synthetic construct
  misc_feature 1..22: note = Description of Artificial Sequence: Syntheticoligonucleotide
  source 1..22: mol_type = other DNA
ccgactcatgcatgagtcggca

SEQ ID NO: 9896 - DNA, 22 bp, synthetic construct
  misc_feature 1..22: note = Description of Artificial Sequence: Syntheticoligonucleotide
  source 1..22: mol_type = other DNA
gagactcatgcatgagtctcgc

SEQ ID NO: 9897 - DNA, 22 bp, synthetic construct
  misc_feature 1..22: note = Description of Artificial Sequence: Syntheticoligonucleotide
  source 1..22: mol_type = other DNA
gtgactcatgcatgagtcacgc

SEQ ID NO: 9898 - DNA, 22 bp, synthetic construct
  misc_feature 1..22: note = Description of Artificial Sequence: Syntheticoligonucleotide
  source 1..22: mol_type = other DNA
aggactcatgcatgagtcctgc

SEQ ID NO: 9899 - DNA, 22 bp, synthetic construct
  misc_feature 1..22: note = Description of Artificial Sequence: Syntheticoligonucleotide
  source 1..22: mol_type = other DNA
tggactcatgcatgagtccagc

SEQ ID NO: 9900 - DNA, 22 bp, synthetic construct
  misc_feature 1..22: note = Description of Artificial Sequence: Syntheticoligonucleotide
  source 1..22: mol_type = other DNA
aggactcatgcatgagtcctcg

SEQ ID NO: 9901 - DNA, 22 bp, synthetic construct
  misc_feature 1..22: note = Description of Artificial Sequence: Syntheticoligonucleotide
  source 1..22: mol_type = other DNA
tggactcatgcatgagtccacg

SEQ ID NO: 9902 - DNA, 22 bp, synthetic construct
  misc_feature 1..22: note = Description of Artificial Sequence: Syntheticoligonucleotide
  source 1..22: mol_type = other DNA
ccgactcatgcatgagtcggtg

SEQ ID NO: 9903 - DNA, 22 bp, synthetic construct
  misc_feature 1..22: note = Description of Artificial Sequence: Syntheticoligonucleotide
  source 1..22: mol_type = other DNA
ccgactcatgcatgagtcggag

SEQ ID NO: 9904 - DNA, 22 bp, synthetic construct
  misc_feature 1..22: note = Description of Artificial Sequence: Syntheticoligonucleotide
  source 1..22: mol_type = other DNA
gggactcatgcatgagtcccgc

SEQ ID NO: 9905 - DNA, 22 bp, synthetic construct
  misc_feature 1..22: note = Description of Artificial Sequence: Syntheticoligonucleotide
  source 1..22: mol_type = other DNA
gggactcatgcatgagtccctc

SEQ ID NO: 9906 - DNA, 22 bp, synthetic construct
  misc_feature 1..22: note = Description of Artificial Sequence: Syntheticoligonucleotide
  source 1..22: mol_type = other DNA
gggactcatgcatgagtcccac

SEQ ID NO: 9907 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcatcgatgagtcnnnn

SEQ ID NO: 9908 - DNA, 22 bp, synthetic construct
  misc_feature 1..22: note = Description of Artificial Sequence: Syntheticoligonucleotide
  source 1..22: mol_type = other DNA
cggactcatcgatgagtccgcc

SEQ ID NO: 9909 - DNA, 22 bp, synthetic construct
  misc_feature 1..22: note = Description of Artificial Sequence: Syntheticoligonucleotide
  source 1..22: mol_type = other DNA
cggactcatcgatgagtccgct

SEQ ID NO: 9910 - DNA, 22 bp, synthetic construct
  misc_feature 1..22: note = Description of Artificial Sequence: Syntheticoligonucleotide
  source 1..22: mol_type = other DNA
cggactcatcgatgagtccgtc

SEQ ID NO: 9911 - DNA, 22 bp, synthetic construct
  misc_feature 1..22: note = Description of Artificial Sequence: Syntheticoligonucleotide
  source 1..22: mol_type = other DNA
aggactcatcgatgagtcctcc

SEQ ID NO: 9912 - DNA, 22 bp, synthetic construct
  misc_feature 1..22: note = Description of Artificial Sequence: Syntheticoligonucleotide
  source 1..22: mol_type = other DNA
cagactcatcgatgagtctgcc

SEQ ID NO: 9913 - DNA, 22 bp, synthetic construct
  misc_feature 1..22: note = Description of Artificial Sequence: Syntheticoligonucleotide
  source 1..22: mol_type = other DNA
cggactcatcgatgagtccgca

SEQ ID NO: 9914 - DNA, 22 bp, synthetic construct
  misc_feature 1..22: note = Description of Artificial Sequence: Syntheticoligonucleotide
  source 1..22: mol_type = other DNA
cggactcatcgatgagtccgac

SEQ ID NO: 9915 - DNA, 22 bp, synthetic construct
  misc_feature 1..22: note = Description of Artificial Sequence: Syntheticoligonucleotide
  source 1..22: mol_type = other DNA
tggactcatcgatgagtccacc

SEQ ID NO: 9916 - DNA, 22 bp, synthetic construct
  misc_feature 1..22: note = Description of Artificial Sequence: Syntheticoligonucleotide
  source 1..22: mol_type = other DNA
ctgactcatcgatgagtcagcc

SEQ ID NO: 9917 - DNA, 22 bp, synthetic construct
  misc_feature 1..22: note = Description of Artificial Sequence: Syntheticoligonucleotide
  source 1..22: mol_type = other DNA
ccgactcatcgatgagtcgggc

SEQ ID NO: 9918 - DNA, 22 bp, synthetic construct
  misc_feature 1..22: note = Description of Artificial Sequence: Syntheticoligonucleotide
  source 1..22: mol_type = other DNA
ccgactcatcgatgagtcgggt

SEQ ID NO: 9919 - DNA, 22 bp, synthetic construct
  misc_feature 1..22: note = Description of Artificial Sequence: Syntheticoligonucleotide
  source 1..22: mol_type = other DNA
ccgactcatcgatgagtcggtc

SEQ ID NO: 9920 - DNA, 22 bp, synthetic construct
  misc_feature 1..22: note = Description of Artificial Sequence: Syntheticoligonucleotide
  source 1..22: mol_type = other DNA
acgactcatcgatgagtcgtgc

SEQ ID NO: 9921 - DNA, 22 bp, synthetic construct
  misc_feature 1..22: note = Description of Artificial Sequence: Syntheticoligonucleotide
  source 1..22: mol_type = other DNA
cagactcatcgatgagtctggc

SEQ ID NO: 9922 - DNA, 22 bp, synthetic construct
  misc_feature 1..22: note = Description of Artificial Sequence: Syntheticoligonucleotide
  source 1..22: mol_type = other DNA
ccgactcatcgatgagtcggga

SEQ ID NO: 9923 - DNA, 22 bp, synthetic construct
  misc_feature 1..22: note = Description of Artificial Sequence: Syntheticoligonucleotide
  source 1..22: mol_type = other DNA
ccgactcatcgatgagtcggac

SEQ ID NO: 9924 - DNA, 22 bp, synthetic construct
  misc_feature 1..22: note = Description of Artificial Sequence: Syntheticoligonucleotide
  source 1..22: mol_type = other DNA
ctgactcatcgatgagtcaggc

SEQ ID NO: 9925 - DNA, 22 bp, synthetic construct
  misc_feature 1..22: note = Description of Artificial Sequence: Syntheticoligonucleotide
  source 1..22: mol_type = other DNA
gcgactcatcgatgagtcgccc

SEQ ID NO: 9926 - DNA, 22 bp, synthetic construct
  misc_feature 1..22: note = Description of Artificial Sequence: Syntheticoligonucleotide
  source 1..22: mol_type = other DNA
gcgactcatcgatgagtcgcct

SEQ ID NO: 9927 - DNA, 22 bp, synthetic construct
  misc_feature 1..22: note = Description of Artificial Sequence: Syntheticoligonucleotide
  source 1..22: mol_type = other DNA
gcgactcatcgatgagtcgctc

SEQ ID NO: 9928 - DNA, 22 bp, synthetic construct
  misc_feature 1..22: note = Description of Artificial Sequence: Syntheticoligonucleotide
  source 1..22: mol_type = other DNA
acgactcatcgatgagtcgtcc

SEQ ID NO: 9929 - DNA, 22 bp, synthetic construct
  misc_feature 1..22: note = Description of Artificial Sequence: Syntheticoligonucleotide
  source 1..22: mol_type = other DNA
gagactcatcgatgagtctccc

SEQ ID NO: 9930 - DNA, 22 bp, synthetic construct
  misc_feature 1..22: note = Description of Artificial Sequence: Syntheticoligonucleotide
  source 1..22: mol_type = other DNA
gcgactcatcgatgagtcgcca

SEQ ID NO: 9931 - DNA, 22 bp, synthetic construct
  misc_feature 1..22: note = Description of Artificial Sequence: Syntheticoligonucleotide
  source 1..22: mol_type = other DNA
gcgactcatcgatgagtcgcac

SEQ ID NO: 9932 - DNA, 22 bp, synthetic construct
  misc_feature 1..22: note = Description of Artificial Sequence: Syntheticoligonucleotide
  source 1..22: mol_type = other DNA
gtgactcatcgatgagtcaccc

SEQ ID NO: 9933 - DNA, 22 bp, synthetic construct
  misc_feature 1..22: note = Description of Artificial Sequence: Syntheticoligonucleotide
  source 1..22: mol_type = other DNA
gggactcatcgatgagtcccgt

SEQ ID NO: 9934 - DNA, 22 bp, synthetic construct
  misc_feature 1..22: note = Description of Artificial Sequence: Syntheticoligonucleotide
  source 1..22: mol_type = other DNA
gggactcatcgatgagtccctg

SEQ ID NO: 9935 - DNA, 22 bp, synthetic construct
  misc_feature 1..22: note = Description of Artificial Sequence: Syntheticoligonucleotide
  source 1..22: mol_type = other DNA
aggactcatcgatgagtcctgg

SEQ ID NO: 9936 - DNA, 22 bp, synthetic construct
  misc_feature 1..22: note = Description of Artificial Sequence: Syntheticoligonucleotide
  source 1..22: mol_type = other DNA
gagactcatcgatgagtctcgg

SEQ ID NO: 9937 - DNA, 22 bp, synthetic construct
  misc_feature 1..22: note = Description of Artificial Sequence: Syntheticoligonucleotide
  source 1..22: mol_type = other DNA
gggactcatcgatgagtcccga

SEQ ID NO: 9938 - DNA, 22 bp, synthetic construct
  misc_feature 1..22: note = Description of Artificial Sequence: Syntheticoligonucleotide
  source 1..22: mol_type = other DNA
gggactcatcgatgagtcccag

SEQ ID NO: 9939 - DNA, 22 bp, synthetic construct
  misc_feature 1..22: note = Description of Artificial Sequence: Syntheticoligonucleotide
  source 1..22: mol_type = other DNA
tggactcatcgatgagtccagg

SEQ ID NO: 9940 - DNA, 22 bp, synthetic construct
  misc_feature 1..22: note = Description of Artificial Sequence: Syntheticoligonucleotide
  source 1..22: mol_type = other DNA
gtgactcatcgatgagtcacgg

SEQ ID NO: 9941 - DNA, 22 bp, synthetic construct
  misc_feature 1..22: note = Description of Artificial Sequence: Syntheticoligonucleotide
  source 1..22: mol_type = other DNA
gcgactcatcgatgagtcgccg

SEQ ID NO: 9942 - DNA, 22 bp, synthetic construct
  misc_feature 1..22: note = Description of Artificial Sequence: Syntheticoligonucleotide
  source 1..22: mol_type = other DNA
gcgactcatcgatgagtcgctg

SEQ ID NO: 9943 - DNA, 22 bp, synthetic construct
  misc_feature 1..22: note = Description of Artificial Sequence: Syntheticoligonucleotide
  source 1..22: mol_type = other DNA
acgactcatcgatgagtcgtcg

SEQ ID NO: 9944 - DNA, 22 bp, synthetic construct
  misc_feature 1..22: note = Description of Artificial Sequence: Syntheticoligonucleotide
  source 1..22: mol_type = other DNA
gagactcatcgatgagtctccg

SEQ ID NO: 9945 - DNA, 22 bp, synthetic construct
  misc_feature 1..22: note = Description of Artificial Sequence: Syntheticoligonucleotide
  source 1..22: mol_type = other DNA
gcgactcatcgatgagtcgcag

SEQ ID NO: 9946 - DNA, 22 bp, synthetic construct
  misc_feature 1..22: note = Description of Artificial Sequence: Syntheticoligonucleotide
  source 1..22: mol_type = other DNA
gtgactcatcgatgagtcaccg

SEQ ID NO: 9947 - DNA, 22 bp, synthetic construct
  misc_feature 1..22: note = Description of Artificial Sequence: Syntheticoligonucleotide
  source 1..22: mol_type = other DNA
cggactcatcgatgagtccgtg

SEQ ID NO: 9948 - DNA, 22 bp, synthetic construct
  misc_feature 1..22: note = Description of Artificial Sequence: Syntheticoligonucleotide
  source 1..22: mol_type = other DNA
cagactcatcgatgagtctggg

SEQ ID NO: 9949 - DNA, 22 bp, synthetic construct
  misc_feature 1..22: note = Description of Artificial Sequence: Syntheticoligonucleotide
  source 1..22: mol_type = other DNA
cggactcatcgatgagtccgag

SEQ ID NO: 9950 - DNA, 22 bp, synthetic construct
  misc_feature 1..22: note = Description of Artificial Sequence: Syntheticoligonucleotide
  source 1..22: mol_type = other DNA
ctgactcatcgatgagtcaggg

SEQ ID NO: 9951 - DNA, 22 bp, synthetic construct
  misc_feature 1..22: note = Description of Artificial Sequence: Syntheticoligonucleotide
  source 1..22: mol_type = other DNA
acgactcatcgatgagtcgtgg

SEQ ID NO: 9952 - DNA, 22 bp, synthetic construct
  misc_feature 1..22: note = Description of Artificial Sequence: Syntheticoligonucleotide
  source 1..22: mol_type = other DNA
ccgactcatcgatgagtcggct

SEQ ID NO: 9953 - DNA, 22 bp, synthetic construct
  misc_feature 1..22: note = Description of Artificial Sequence: Syntheticoligonucleotide
  source 1..22: mol_type = other DNA
ccgactcatcgatgagtcggca

SEQ ID NO: 9954 - DNA, 22 bp, synthetic construct
  misc_feature 1..22: note = Description of Artificial Sequence: Syntheticoligonucleotide
  source 1..22: mol_type = other DNA
gagactcatcgatgagtctcgc

SEQ ID NO: 9955 - DNA, 22 bp, synthetic construct
  misc_feature 1..22: note = Description of Artificial Sequence: Syntheticoligonucleotide
  source 1..22: mol_type = other DNA
gtgactcatcgatgagtcacgc

SEQ ID NO: 9956 - DNA, 22 bp, synthetic construct
  misc_feature 1..22: note = Description of Artificial Sequence: Syntheticoligonucleotide
  source 1..22: mol_type = other DNA
aggactcatcgatgagtcctgc

SEQ ID NO: 9957 - DNA, 22 bp, synthetic construct
  misc_feature 1..22: note = Description of Artificial Sequence: Syntheticoligonucleotide
  source 1..22: mol_type = other DNA
tggactcatcgatgagtccagc

SEQ ID NO: 9958 - DNA, 22 bp, synthetic construct
  misc_feature 1..22: note = Description of Artificial Sequence: Syntheticoligonucleotide
  source 1..22: mol_type = other DNA
aggactcatcgatgagtcctcg

SEQ ID NO: 9959 - DNA, 22 bp, synthetic construct
  misc_feature 1..22: note = Description of Artificial Sequence: Syntheticoligonucleotide
  source 1..22: mol_type = other DNA
tggactcatcgatgagtccacg

SEQ ID NO: 9960 - DNA, 22 bp, synthetic construct
  misc_feature 1..22: note = Description of Artificial Sequence: Syntheticoligonucleotide
  source 1..22: mol_type = other DNA
ccgactcatcgatgagtcggtg

SEQ ID NO: 9961 - DNA, 22 bp, synthetic construct
  misc_feature 1..22: note = Description of Artificial Sequence: Syntheticoligonucleotide
  source 1..22: mol_type = other DNA
ccgactcatcgatgagtcggag

SEQ ID NO: 9962 - DNA, 22 bp, synthetic construct
  misc_feature 1..22: note = Description of Artificial Sequence: Syntheticoligonucleotide
  source 1..22: mol_type = other DNA
gggactcatcgatgagtcccgc

SEQ ID NO: 9963 - DNA, 22 bp, synthetic construct
  misc_feature 1..22: note = Description of Artificial Sequence: Syntheticoligonucleotide
  source 1..22: mol_type = other DNA
gggactcatcgatgagtccctc

SEQ ID NO: 9964 - DNA, 22 bp, synthetic construct
  misc_feature 1..22: note = Description of Artificial Sequence: Syntheticoligonucleotide
  source 1..22: mol_type = other DNA
gggactcatcgatgagtcccac

SEQ ID NO: 9965 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcttataagagtcnnnn

SEQ ID NO: 9966 - DNA, 22 bp, synthetic construct
  misc_feature 1..22: note = Description of Artificial Sequence: Syntheticoligonucleotide
  source 1..22: mol_type = other DNA
cggactcttataagagtccgcc

SEQ ID NO: 9967 - DNA, 22 bp, synthetic construct
  misc_feature 1..22: note = Description of Artificial Sequence: Syntheticoligonucleotide
  source 1..22: mol_type = other DNA
cggactcttataagagtccgct

SEQ ID NO: 9968 - DNA, 22 bp, synthetic construct
  misc_feature 1..22: note = Description of Artificial Sequence: Syntheticoligonucleotide
  source 1..22: mol_type = other DNA
cggactcttataagagtccgtc

SEQ ID NO: 9969 - DNA, 22 bp, synthetic construct
  misc_feature 1..22: note = Description of Artificial Sequence: Syntheticoligonucleotide
  source 1..22: mol_type = other DNA
aggactcttataagagtcctcc

SEQ ID NO: 9970 - DNA, 22 bp, synthetic construct
  misc_feature 1..22: note = Description of Artificial Sequence: Syntheticoligonucleotide
  source 1..22: mol_type = other DNA
cagactcttataagagtctgcc

SEQ ID NO: 9971 - DNA, 22 bp, synthetic construct
  misc_feature 1..22: note = Description of Artificial Sequence: Syntheticoligonucleotide
  source 1..22: mol_type = other DNA
cggactcttataagagtccgca

SEQ ID NO: 9972 - DNA, 22 bp, synthetic construct
  misc_feature 1..22: note = Description of Artificial Sequence: Syntheticoligonucleotide
  source 1..22: mol_type = other DNA
cggactcttataagagtccgac

SEQ ID NO: 9973 - DNA, 22 bp, synthetic construct
  misc_feature 1..22: note = Description of Artificial Sequence: Syntheticoligonucleotide
  source 1..22: mol_type = other DNA
tggactcttataagagtccacc

SEQ ID NO: 9974 - DNA, 22 bp, synthetic construct
  misc_feature 1..22: note = Description of Artificial Sequence: Syntheticoligonucleotide
  source 1..22: mol_type = other DNA
ctgactcttataagagtcagcc

SEQ ID NO: 9975 - DNA, 22 bp, synthetic construct
  misc_feature 1..22: note = Description of Artificial Sequence: Syntheticoligonucleotide
  source 1..22: mol_type = other DNA
ccgactcttataagagtcgggc

SEQ ID NO: 9976 - DNA, 22 bp, synthetic construct
  misc_feature 1..22: note = Description of Artificial Sequence: Syntheticoligonucleotide
  source 1..22: mol_type = other DNA
ccgactcttataagagtcgggt

SEQ ID NO: 9977 - DNA, 22 bp, synthetic construct
  misc_feature 1..22: note = Description of Artificial Sequence: Syntheticoligonucleotide
  source 1..22: mol_type = other DNA
ccgactcttataagagtcggtc

SEQ ID NO: 9978 - DNA, 22 bp, synthetic construct
  misc_feature 1..22: note = Description of Artificial Sequence: Syntheticoligonucleotide
  source 1..22: mol_type = other DNA
acgactcttataagagtcgtgc

SEQ ID NO: 9979 - DNA, 22 bp, synthetic construct
  misc_feature 1..22: note = Description of Artificial Sequence: Syntheticoligonucleotide
  source 1..22: mol_type = other DNA
cagactcttataagagtctggc

SEQ ID NO: 9980 - DNA, 22 bp, synthetic construct
  misc_feature 1..22: note = Description of Artificial Sequence: Syntheticoligonucleotide
  source 1..22: mol_type = other DNA
ccgactcttataagagtcggga

SEQ ID NO: 9981 - DNA, 22 bp, synthetic construct
  misc_feature 1..22: note = Description of Artificial Sequence: Syntheticoligonucleotide
  source 1..22: mol_type = other DNA
ccgactcttataagagtcggac

SEQ ID NO: 9982 - DNA, 22 bp, synthetic construct
  misc_feature 1..22: note = Description of Artificial Sequence: Syntheticoligonucleotide
  source 1..22: mol_type = other DNA
ctgactcttataagagtcaggc

SEQ ID NO: 9983 - DNA, 22 bp, synthetic construct
  misc_feature 1..22: note = Description of Artificial Sequence: Syntheticoligonucleotide
  source 1..22: mol_type = other DNA
gcgactcttataagagtcgccc

SEQ ID NO: 9984 - DNA, 22 bp, synthetic construct
  misc_feature 1..22: note = Description of Artificial Sequence: Syntheticoligonucleotide
  source 1..22: mol_type = other DNA
gcgactcttataagagtcgcct

SEQ ID NO: 9985 - DNA, 22 bp, synthetic construct
  misc_feature 1..22: note = Description of Artificial Sequence: Syntheticoligonucleotide
  source 1..22: mol_type = other DNA
gcgactcttataagagtcgctc

SEQ ID NO: 9986 - DNA, 22 bp, synthetic construct
  misc_feature 1..22: note = Description of Artificial Sequence: Syntheticoligonucleotide
  source 1..22: mol_type = other DNA
acgactcttataagagtcgtcc

SEQ ID NO: 9987 - DNA, 22 bp, synthetic construct
  misc_feature 1..22: note = Description of Artificial Sequence: Syntheticoligonucleotide
  source 1..22: mol_type = other DNA
gagactcttataagagtctccc

SEQ ID NO: 9988 - DNA, 22 bp, synthetic construct
  misc_feature 1..22: note = Description of Artificial Sequence: Syntheticoligonucleotide
  source 1..22: mol_type = other DNA
gcgactcttataagagtcgcca

SEQ ID NO: 9989 - DNA, 22 bp, synthetic construct
  misc_feature 1..22: note = Description of Artificial Sequence: Syntheticoligonucleotide
  source 1..22: mol_type = other DNA
gcgactcttataagagtcgcac

SEQ ID NO: 9990 - DNA, 22 bp, synthetic construct
  misc_feature 1..22: note = Description of Artificial Sequence: Syntheticoligonucleotide
  source 1..22: mol_type = other DNA
gtgactcttataagagtcaccc

SEQ ID NO: 9991 - DNA, 22 bp, synthetic construct
  misc_feature 1..22: note = Description of Artificial Sequence: Syntheticoligonucleotide
  source 1..22: mol_type = other DNA
gggactcttataagagtcccgt

SEQ ID NO: 9992 - DNA, 22 bp, synthetic construct
  misc_feature 1..22: note = Description of Artificial Sequence: Syntheticoligonucleotide
  source 1..22: mol_type = other DNA
gggactcttataagagtccctg

SEQ ID NO: 9993 - DNA, 22 bp, synthetic construct
  misc_feature 1..22: note = Description of Artificial Sequence: Syntheticoligonucleotide
  source 1..22: mol_type = other DNA
aggactcttataagagtcctgg

SEQ ID NO: 9994 - DNA, 22 bp, synthetic construct
  misc_feature 1..22: note = Description of Artificial Sequence: Syntheticoligonucleotide
  source 1..22: mol_type = other DNA
gagactcttataagagtctcgg

SEQ ID NO: 9995 - DNA, 22 bp, synthetic construct
  misc_feature 1..22: note = Description of Artificial Sequence: Syntheticoligonucleotide
  source 1..22: mol_type = other DNA
gggactcttataagagtcccga

SEQ ID NO: 9996 - DNA, 22 bp, synthetic construct
  misc_feature 1..22: note = Description of Artificial Sequence: Syntheticoligonucleotide
  source 1..22: mol_type = other DNA
gggactcttataagagtcccag

SEQ ID NO: 9997 - DNA, 22 bp, synthetic construct
  misc_feature 1..22: note = Description of Artificial Sequence: Syntheticoligonucleotide
  source 1..22: mol_type = other DNA
tggactcttataagagtccagg

SEQ ID NO: 9998 - DNA, 22 bp, synthetic construct
  misc_feature 1..22: note = Description of Artificial Sequence: Syntheticoligonucleotide
  source 1..22: mol_type = other DNA
gtgactcttataagagtcacgg

SEQ ID NO: 9999 - DNA, 22 bp, synthetic construct
  misc_feature 1..22: note = Description of Artificial Sequence: Syntheticoligonucleotide
  source 1..22: mol_type = other DNA
gcgactcttataagagtcgccg

SEQ ID NO: 10000 - DNA, 22 bp, synthetic construct
  misc_feature 1..22: note = Description of Artificial Sequence: Syntheticoligonucleotide
  source 1..22: mol_type = other DNA
gcgactcttataagagtcgctg

SEQ ID NO: 10001 - DNA, 22 bp, synthetic construct
  misc_feature 1..22: note = Description of Artificial Sequence: Syntheticoligonucleotide
  source 1..22: mol_type = other DNA
acgactcttataagagtcgtcg

SEQ ID NO: 10002 - DNA, 22 bp, synthetic construct
  misc_feature 1..22: note = Description of Artificial Sequence: Syntheticoligonucleotide
  source 1..22: mol_type = other DNA
gagactcttataagagtctccg

SEQ ID NO: 10003 - DNA, 22 bp, synthetic construct
  misc_feature 1..22: note = Description of Artificial Sequence: Syntheticoligonucleotide
  source 1..22: mol_type = other DNA
gcgactcttataagagtcgcag

SEQ ID NO: 10004 - DNA, 22 bp, synthetic construct
  misc_feature 1..22: note = Description of Artificial Sequence: Syntheticoligonucleotide
  source 1..22: mol_type = other DNA
gtgactcttataagagtcaccg

SEQ ID NO: 10005 - DNA, 22 bp, synthetic construct
  misc_feature 1..22: note = Description of Artificial Sequence: Syntheticoligonucleotide
  source 1..22: mol_type = other DNA
cggactcttataagagtccgtg

SEQ ID NO: 10006 - DNA, 22 bp, synthetic construct
  misc_feature 1..22: note = Description of Artificial Sequence: Syntheticoligonucleotide
  source 1..22: mol_type = other DNA
cagactcttataagagtctggg

SEQ ID NO: 10007 - DNA, 22 bp, synthetic construct
  misc_feature 1..22: note = Description of Artificial Sequence: Syntheticoligonucleotide
  source 1..22: mol_type = other DNA
cggactcttataagagtccgag

SEQ ID NO: 10008 - DNA, 22 bp, synthetic construct
  misc_feature 1..22: note = Description of Artificial Sequence: Syntheticoligonucleotide
  source 1..22: mol_type = other DNA
ctgactcttataagagtcaggg

SEQ ID NO: 10009 - DNA, 22 bp, synthetic construct
  misc_feature 1..22: note = Description of Artificial Sequence: Syntheticoligonucleotide
  source 1..22: mol_type = other DNA
acgactcttataagagtcgtgg

SEQ ID NO: 10010 - DNA, 22 bp, synthetic construct
  misc_feature 1..22: note = Description of Artificial Sequence: Syntheticoligonucleotide
  source 1..22: mol_type = other DNA
ccgactcttataagagtcggct

SEQ ID NO: 10011 - DNA, 22 bp, synthetic construct
  misc_feature 1..22: note = Description of Artificial Sequence: Syntheticoligonucleotide
  source 1..22: mol_type = other DNA
ccgactcttataagagtcggca

SEQ ID NO: 10012 - DNA, 22 bp, synthetic construct
  misc_feature 1..22: note = Description of Artificial Sequence: Syntheticoligonucleotide
  source 1..22: mol_type = other DNA
gagactcttataagagtctcgc

SEQ ID NO: 10013 - DNA, 22 bp, synthetic construct
  misc_feature 1..22: note = Description of Artificial Sequence: Syntheticoligonucleotide
  source 1..22: mol_type = other DNA
gtgactcttataagagtcacgc

SEQ ID NO: 10014 - DNA, 22 bp, synthetic construct
  misc_feature 1..22: note = Description of Artificial Sequence: Syntheticoligonucleotide
  source 1..22: mol_type = other DNA
aggactcttataagagtcctgc

SEQ ID NO: 10015 - DNA, 22 bp, synthetic construct
  misc_feature 1..22: note = Description of Artificial Sequence: Syntheticoligonucleotide
  source 1..22: mol_type = other DNA
tggactcttataagagtccagc

SEQ ID NO: 10016 - DNA, 22 bp, synthetic construct
  misc_feature 1..22: note = Description of Artificial Sequence: Syntheticoligonucleotide
  source 1..22: mol_type = other DNA
aggactcttataagagtcctcg

SEQ ID NO: 10017 - DNA, 22 bp, synthetic construct
  misc_feature 1..22: note = Description of Artificial Sequence: Syntheticoligonucleotide
  source 1..22: mol_type = other DNA
tggactcttataagagtccacg

SEQ ID NO: 10018 - DNA, 22 bp, synthetic construct
  misc_feature 1..22: note = Description of Artificial Sequence: Syntheticoligonucleotide
  source 1..22: mol_type = other DNA
ccgactcttataagagtcggtg

SEQ ID NO: 10019 - DNA, 22 bp, synthetic construct
  misc_feature 1..22: note = Description of Artificial Sequence: Syntheticoligonucleotide
  source 1..22: mol_type = other DNA
ccgactcttataagagtcggag

SEQ ID NO: 10020 - DNA, 22 bp, synthetic construct
  misc_feature 1..22: note = Description of Artificial Sequence: Syntheticoligonucleotide
  source 1..22: mol_type = other DNA
gggactcttataagagtcccgc

SEQ ID NO: 10021 - DNA, 22 bp, synthetic construct
  misc_feature 1..22: note = Description of Artificial Sequence: Syntheticoligonucleotide
  source 1..22: mol_type = other DNA
gggactcttataagagtccctc

SEQ ID NO: 10022 - DNA, 22 bp, synthetic construct
  misc_feature 1..22: note = Description of Artificial Sequence: Syntheticoligonucleotide
  source 1..22: mol_type = other DNA
gggactcttataagagtcccac

SEQ ID NO: 10023 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactctttaaagagtcnnnn

SEQ ID NO: 10024 - DNA, 22 bp, synthetic construct
  misc_feature 1..22: note = Description of Artificial Sequence: Syntheticoligonucleotide
  source 1..22: mol_type = other DNA
cggactctttaaagagtccgcc

SEQ ID NO: 10025 - DNA, 22 bp, synthetic construct
  misc_feature 1..22: note = Description of Artificial Sequence: Syntheticoligonucleotide
  source 1..22: mol_type = other DNA
cggactctttaaagagtccgct

SEQ ID NO: 10026 - DNA, 22 bp, synthetic construct
  misc_feature 1..22: note = Description of Artificial Sequence: Syntheticoligonucleotide
  source 1..22: mol_type = other DNA
cggactctttaaagagtccgtc

SEQ ID NO: 10027 - DNA, 22 bp, synthetic construct
  misc_feature 1..22: note = Description of Artificial Sequence: Syntheticoligonucleotide
  source 1..22: mol_type = other DNA
aggactctttaaagagtcctcc

SEQ ID NO: 10028 - DNA, 22 bp, synthetic construct
  misc_feature 1..22: note = Description of Artificial Sequence: Syntheticoligonucleotide
  source 1..22: mol_type = other DNA
cagactctttaaagagtctgcc

SEQ ID NO: 10029 - DNA, 22 bp, synthetic construct
  misc_feature 1..22: note = Description of Artificial Sequence: Syntheticoligonucleotide
  source 1..22: mol_type = other DNA
cggactctttaaagagtccgca

SEQ ID NO: 10030 - DNA, 22 bp, synthetic construct
  misc_feature 1..22: note = Description of Artificial Sequence: Syntheticoligonucleotide
  source 1..22: mol_type = other DNA
cggactctttaaagagtccgac

SEQ ID NO: 10031 - DNA, 22 bp, synthetic construct
  misc_feature 1..22: note = Description of Artificial Sequence: Syntheticoligonucleotide
  source 1..22: mol_type = other DNA
tggactctttaaagagtccacc

SEQ ID NO: 10032 - DNA, 22 bp, synthetic construct
  misc_feature 1..22: note = Description of Artificial Sequence: Syntheticoligonucleotide
  source 1..22: mol_type = other DNA
ctgactctttaaagagtcagcc

SEQ ID NO: 10033 - DNA, 22 bp, synthetic construct
  misc_feature 1..22: note = Description of Artificial Sequence: Syntheticoligonucleotide
  source 1..22: mol_type = other DNA
ccgactctttaaagagtcgggc

SEQ ID NO: 10034 - DNA, 22 bp, synthetic construct
  misc_feature 1..22: note = Description of Artificial Sequence: Syntheticoligonucleotide
  source 1..22: mol_type = other DNA
ccgactctttaaagagtcgggt

SEQ ID NO: 10035 - DNA, 22 bp, synthetic construct
  misc_feature 1..22: note = Description of Artificial Sequence: Syntheticoligonucleotide
  source 1..22: mol_type = other DNA
ccgactctttaaagagtcggtc

SEQ ID NO: 10036 - DNA, 22 bp, synthetic construct
  misc_feature 1..22: note = Description of Artificial Sequence: Syntheticoligonucleotide
  source 1..22: mol_type = other DNA
acgactctttaaagagtcgtgc

SEQ ID NO: 10037 - DNA, 22 bp, synthetic construct
  misc_feature 1..22: note = Description of Artificial Sequence: Syntheticoligonucleotide
  source 1..22: mol_type = other DNA
cagactctttaaagagtctggc

SEQ ID NO: 10038 - DNA, 22 bp, synthetic construct
  misc_feature 1..22: note = Description of Artificial Sequence: Syntheticoligonucleotide
  source 1..22: mol_type = other DNA
ccgactctttaaagagtcggga

SEQ ID NO: 10039 - DNA, 22 bp, synthetic construct
  misc_feature 1..22: note = Description of Artificial Sequence: Syntheticoligonucleotide
  source 1..22: mol_type = other DNA
ccgactctttaaagagtcggac

SEQ ID NO: 10040 - DNA, 22 bp, synthetic construct
  misc_feature 1..22: note = Description of Artificial Sequence: Syntheticoligonucleotide
  source 1..22: mol_type = other DNA
ctgactctttaaagagtcaggc

SEQ ID NO: 10041 - DNA, 22 bp, synthetic construct
  misc_feature 1..22: note = Description of Artificial Sequence: Syntheticoligonucleotide
  source 1..22: mol_type = other DNA
gcgactctttaaagagtcgccc

SEQ ID NO: 10042 - DNA, 22 bp, synthetic construct
  misc_feature 1..22: note = Description of Artificial Sequence: Syntheticoligonucleotide
  source 1..22: mol_type = other DNA
gcgactctttaaagagtcgcct

SEQ ID NO: 10043 - DNA, 22 bp, synthetic construct
  misc_feature 1..22: note = Description of Artificial Sequence: Syntheticoligonucleotide
  source 1..22: mol_type = other DNA
gcgactctttaaagagtcgctc

SEQ ID NO: 10044 - DNA, 22 bp, synthetic construct
  misc_feature 1..22: note = Description of Artificial Sequence: Syntheticoligonucleotide
  source 1..22: mol_type = other DNA
acgactctttaaagagtcgtcc

SEQ ID NO: 10045 - DNA, 22 bp, synthetic construct
  misc_feature 1..22: note = Description of Artificial Sequence: Syntheticoligonucleotide
  source 1..22: mol_type = other DNA
gagactctttaaagagtctccc

SEQ ID NO: 10046 - DNA, 22 bp, synthetic construct
  misc_feature 1..22: note = Description of Artificial Sequence: Syntheticoligonucleotide
  source 1..22: mol_type = other DNA
gcgactctttaaagagtcgcca

SEQ ID NO: 10047 - DNA, 22 bp, synthetic construct
  misc_feature 1..22: note = Description of Artificial Sequence: Syntheticoligonucleotide
  source 1..22: mol_type = other DNA
gcgactctttaaagagtcgcac

SEQ ID NO: 10048 - DNA, 22 bp, synthetic construct
  misc_feature 1..22: note = Description of Artificial Sequence: Syntheticoligonucleotide
  source 1..22: mol_type = other DNA
gtgactctttaaagagtcaccc

SEQ ID NO: 10049 - DNA, 22 bp, synthetic construct
  misc_feature 1..22: note = Description of Artificial Sequence: Syntheticoligonucleotide
  source 1..22: mol_type = other DNA
gggactctttaaagagtcccgt

SEQ ID NO: 10050 - DNA, 22 bp, synthetic construct
  misc_feature 1..22: note = Description of Artificial Sequence: Syntheticoligonucleotide
  source 1..22: mol_type = other DNA
gggactctttaaagagtccctg

SEQ ID NO: 10051 - DNA, 22 bp, synthetic construct
  misc_feature 1..22: note = Description of Artificial Sequence: Syntheticoligonucleotide
  source 1..22: mol_type = other DNA
aggactctttaaagagtcctgg

SEQ ID NO: 10052 - DNA, 22 bp, synthetic construct
  misc_feature 1..22: note = Description of Artificial Sequence: Syntheticoligonucleotide
  source 1..22: mol_type = other DNA
gagactctttaaagagtctcgg

SEQ ID NO: 10053 - DNA, 22 bp, synthetic construct
  misc_feature 1..22: note = Description of Artificial Sequence: Syntheticoligonucleotide
  source 1..22: mol_type = other DNA
gggactctttaaagagtcccga

SEQ ID NO: 10054 - DNA, 22 bp, synthetic construct
  misc_feature 1..22: note = Description of Artificial Sequence: Syntheticoligonucleotide
  source 1..22: mol_type = other DNA
gggactctttaaagagtcccag

SEQ ID NO: 10055 - DNA, 22 bp, synthetic construct
  misc_feature 1..22: note = Description of Artificial Sequence: Syntheticoligonucleotide
  source 1..22: mol_type = other DNA
tggactctttaaagagtccagg

SEQ ID NO: 10056 - DNA, 22 bp, synthetic construct
  misc_feature 1..22: note = Description of Artificial Sequence: Syntheticoligonucleotide
  source 1..22: mol_type = other DNA
gtgactctttaaagagtcacgg

SEQ ID NO: 10057 - DNA, 22 bp, synthetic construct
  misc_feature 1..22: note = Description of Artificial Sequence: Syntheticoligonucleotide
  source 1..22: mol_type = other DNA
gcgactctttaaagagtcgccg

SEQ ID NO: 10058 - DNA, 22 bp, synthetic construct
  misc_feature 1..22: note = Description of Artificial Sequence: Syntheticoligonucleotide
  source 1..22: mol_type = other DNA
gcgactctttaaagagtcgctg

SEQ ID NO: 10059 - DNA, 22 bp, synthetic construct
  misc_feature 1..22: note = Description of Artificial Sequence: Syntheticoligonucleotide
  source 1..22: mol_type = other DNA
acgactctttaaagagtcgtcg

SEQ ID NO: 10060 - DNA, 22 bp, synthetic construct
  misc_feature 1..22: note = Description of Artificial Sequence: Syntheticoligonucleotide
  source 1..22: mol_type = other DNA
gagactctttaaagagtctccg

SEQ ID NO: 10061 - DNA, 22 bp, synthetic construct
  misc_feature 1..22: note = Description of Artificial Sequence: Syntheticoligonucleotide
  source 1..22: mol_type = other DNA
gcgactctttaaagagtcgcag

SEQ ID NO: 10062 - DNA, 22 bp, synthetic construct
  misc_feature 1..22: note = Description of Artificial Sequence: Syntheticoligonucleotide
  source 1..22: mol_type = other DNA
gtgactctttaaagagtcaccg

SEQ ID NO: 10063 - DNA, 22 bp, synthetic construct
  misc_feature 1..22: note = Description of Artificial Sequence: Syntheticoligonucleotide
  source 1..22: mol_type = other DNA
cggactctttaaagagtccgtg

SEQ ID NO: 10064 - DNA, 22 bp, synthetic construct
  misc_feature 1..22: note = Description of Artificial Sequence: Syntheticoligonucleotide
  source 1..22: mol_type = other DNA
cagactctttaaagagtctggg

SEQ ID NO: 10065 - DNA, 22 bp, synthetic construct
  misc_feature 1..22: note = Description of Artificial Sequence: Syntheticoligonucleotide
  source 1..22: mol_type = other DNA
cggactctttaaagagtccgag

SEQ ID NO: 10066 - DNA, 22 bp, synthetic construct
  misc_feature 1..22: note = Description of Artificial Sequence: Syntheticoligonucleotide
  source 1..22: mol_type = other DNA
ctgactctttaaagagtcaggg

SEQ ID NO: 10067 - DNA, 22 bp, synthetic construct
  misc_feature 1..22: note = Description of Artificial Sequence: Syntheticoligonucleotide
  source 1..22: mol_type = other DNA
acgactctttaaagagtcgtgg

SEQ ID NO: 10068 - DNA, 22 bp, synthetic construct
  misc_feature 1..22: note = Description of Artificial Sequence: Syntheticoligonucleotide
  source 1..22: mol_type = other DNA
ccgactctttaaagagtcggct

SEQ ID NO: 10069 - DNA, 22 bp, synthetic construct
  misc_feature 1..22: note = Description of Artificial Sequence: Syntheticoligonucleotide
  source 1..22: mol_type = other DNA
ccgactctttaaagagtcggca

SEQ ID NO: 10070 - DNA, 22 bp, synthetic construct
  misc_feature 1..22: note = Description of Artificial Sequence: Syntheticoligonucleotide
  source 1..22: mol_type = other DNA
gagactctttaaagagtctcgc

SEQ ID NO: 10071 - DNA, 22 bp, synthetic construct
  misc_feature 1..22: note = Description of Artificial Sequence: Syntheticoligonucleotide
  source 1..22: mol_type = other DNA
gtgactctttaaagagtcacgc

SEQ ID NO: 10072 - DNA, 22 bp, synthetic construct
  misc_feature 1..22: note = Description of Artificial Sequence: Syntheticoligonucleotide
  source 1..22: mol_type = other DNA
aggactctttaaagagtcctgc

SEQ ID NO: 10073 - DNA, 22 bp, synthetic construct
  misc_feature 1..22: note = Description of Artificial Sequence: Syntheticoligonucleotide
  source 1..22: mol_type = other DNA
tggactctttaaagagtccagc

SEQ ID NO: 10074 - DNA, 22 bp, synthetic construct
  misc_feature 1..22: note = Description of Artificial Sequence: Syntheticoligonucleotide
  source 1..22: mol_type = other DNA
aggactctttaaagagtcctcg

SEQ ID NO: 10075 - DNA, 22 bp, synthetic construct
  misc_feature 1..22: note = Description of Artificial Sequence: Syntheticoligonucleotide
  source 1..22: mol_type = other DNA
tggactctttaaagagtccacg

SEQ ID NO: 10076 - DNA, 22 bp, synthetic construct
  misc_feature 1..22: note = Description of Artificial Sequence: Syntheticoligonucleotide
  source 1..22: mol_type = other DNA
ccgactctttaaagagtcggtg

SEQ ID NO: 10077 - DNA, 22 bp, synthetic construct
  misc_feature 1..22: note = Description of Artificial Sequence: Syntheticoligonucleotide
  source 1..22: mol_type = other DNA
ccgactctttaaagagtcggag

SEQ ID NO: 10078 - DNA, 22 bp, synthetic construct
  misc_feature 1..22: note = Description of Artificial Sequence: Syntheticoligonucleotide
  source 1..22: mol_type = other DNA
gggactctttaaagagtcccgc

SEQ ID NO: 10079 - DNA, 22 bp, synthetic construct
  misc_feature 1..22: note = Description of Artificial Sequence: Syntheticoligonucleotide
  source 1..22: mol_type = other DNA
gggactctttaaagagtccctc

SEQ ID NO: 10080 - DNA, 22 bp, synthetic construct
  misc_feature 1..22: note = Description of Artificial Sequence: Syntheticoligonucleotide
  source 1..22: mol_type = other DNA
gggactctttaaagagtcccac

SEQ ID NO: 10081 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcttgcaagagtcnnnn

SEQ ID NO: 10082 - DNA, 22 bp, synthetic construct
  misc_feature 1..22: note = Description of Artificial Sequence: Syntheticoligonucleotide
  source 1..22: mol_type = other DNA
cggactcttgcaagagtccgcc

SEQ ID NO: 10083 - DNA, 22 bp, synthetic construct
  misc_feature 1..22: note = Description of Artificial Sequence: Syntheticoligonucleotide
  source 1..22: mol_type = other DNA
cggactcttgcaagagtccgct

SEQ ID NO: 10084 - DNA, 22 bp, synthetic construct
  misc_feature 1..22: note = Description of Artificial Sequence: Syntheticoligonucleotide
  source 1..22: mol_type = other DNA
cggactcttgcaagagtccgtc

SEQ ID NO: 10085 - DNA, 22 bp, synthetic construct
  misc_feature 1..22: note = Description of Artificial Sequence: Syntheticoligonucleotide
  source 1..22: mol_type = other DNA
aggactcttgcaagagtcctcc

SEQ ID NO: 10086 - DNA, 22 bp, synthetic construct
  misc_feature 1..22: note = Description of Artificial Sequence: Syntheticoligonucleotide
  source 1..22: mol_type = other DNA
cagactcttgcaagagtctgcc

SEQ ID NO: 10087 - DNA, 22 bp, synthetic construct
  misc_feature 1..22: note = Description of Artificial Sequence: Syntheticoligonucleotide
  source 1..22: mol_type = other DNA
cggactcttgcaagagtccgca

SEQ ID NO: 10088 - DNA, 22 bp, synthetic construct
  misc_feature 1..22: note = Description of Artificial Sequence: Syntheticoligonucleotide
  source 1..22: mol_type = other DNA
cggactcttgcaagagtccgac

SEQ ID NO: 10089 - DNA, 22 bp, synthetic construct
  misc_feature 1..22: note = Description of Artificial Sequence: Syntheticoligonucleotide
  source 1..22: mol_type = other DNA
tggactcttgcaagagtccacc

SEQ ID NO: 10090 - DNA, 22 bp, synthetic construct
  misc_feature 1..22: note = Description of Artificial Sequence: Syntheticoligonucleotide
  source 1..22: mol_type = other DNA
ctgactcttgcaagagtcagcc

SEQ ID NO: 10091 - DNA, 22 bp, synthetic construct
  misc_feature 1..22: note = Description of Artificial Sequence: Syntheticoligonucleotide
  source 1..22: mol_type = other DNA
ccgactcttgcaagagtcgggc

SEQ ID NO: 10092 - DNA, 22 bp, synthetic construct
  misc_feature 1..22: note = Description of Artificial Sequence: Syntheticoligonucleotide
  source 1..22: mol_type = other DNA
ccgactcttgcaagagtcgggt

SEQ ID NO: 10093 - DNA, 22 bp, synthetic construct
  misc_feature 1..22: note = Description of Artificial Sequence: Syntheticoligonucleotide
  source 1..22: mol_type = other DNA
ccgactcttgcaagagtcggtc

SEQ ID NO: 10094 - DNA, 22 bp, synthetic construct
  misc_feature 1..22: note = Description of Artificial Sequence: Syntheticoligonucleotide
  source 1..22: mol_type = other DNA
acgactcttgcaagagtcgtgc

SEQ ID NO: 10095 - DNA, 22 bp, synthetic construct
  misc_feature 1..22: note = Description of Artificial Sequence: Syntheticoligonucleotide
  source 1..22: mol_type = other DNA
cagactcttgcaagagtctggc

SEQ ID NO: 10096 - DNA, 22 bp, synthetic construct
  misc_feature 1..22: note = Description of Artificial Sequence: Syntheticoligonucleotide
  source 1..22: mol_type = other DNA
ccgactcttgcaagagtcggga

SEQ ID NO: 10097 - DNA, 22 bp, synthetic construct
  misc_feature 1..22: note = Description of Artificial Sequence: Syntheticoligonucleotide
  source 1..22: mol_type = other DNA
ccgactcttgcaagagtcggac

SEQ ID NO: 10098 - DNA, 22 bp, synthetic construct
  misc_feature 1..22: note = Description of Artificial Sequence: Syntheticoligonucleotide
  source 1..22: mol_type = other DNA
ctgactcttgcaagagtcaggc

SEQ ID NO: 10099 - DNA, 22 bp, synthetic construct
  misc_feature 1..22: note = Description of Artificial Sequence: Syntheticoligonucleotide
  source 1..22: mol_type = other DNA
gcgactcttgcaagagtcgccc

SEQ ID NO: 10100 - DNA, 22 bp, synthetic construct
  misc_feature 1..22: note = Description of Artificial Sequence: Syntheticoligonucleotide
  source 1..22: mol_type = other DNA
gcgactcttgcaagagtcgcct

SEQ ID NO: 10101 - DNA, 22 bp, synthetic construct
  misc_feature 1..22: note = Description of Artificial Sequence: Syntheticoligonucleotide
  source 1..22: mol_type = other DNA
gcgactcttgcaagagtcgctc

SEQ ID NO: 10102 - DNA, 22 bp, synthetic construct
  misc_feature 1..22: note = Description of Artificial Sequence: Syntheticoligonucleotide
  source 1..22: mol_type = other DNA
acgactcttgcaagagtcgtcc

SEQ ID NO: 10103 - DNA, 22 bp, synthetic construct
  misc_feature 1..22: note = Description of Artificial Sequence: Syntheticoligonucleotide
  source 1..22: mol_type = other DNA
gagactcttgcaagagtctccc

SEQ ID NO: 10104 - DNA, 22 bp, synthetic construct
  misc_feature 1..22: note = Description of Artificial Sequence: Syntheticoligonucleotide
  source 1..22: mol_type = other DNA
gcgactcttgcaagagtcgcca

SEQ ID NO: 10105 - DNA, 22 bp, synthetic construct
  misc_feature 1..22: note = Description of Artificial Sequence: Syntheticoligonucleotide
  source 1..22: mol_type = other DNA
gcgactcttgcaagagtcgcac

SEQ ID NO: 10106 - DNA, 22 bp, synthetic construct
  misc_feature 1..22: note = Description of Artificial Sequence: Syntheticoligonucleotide
  source 1..22: mol_type = other DNA
gtgactcttgcaagagtcaccc

SEQ ID NO: 10107 - DNA, 22 bp, synthetic construct
  misc_feature 1..22: note = Description of Artificial Sequence: Syntheticoligonucleotide
  source 1..22: mol_type = other DNA
gggactcttgcaagagtcccgt

SEQ ID NO: 10108 - DNA, 22 bp, synthetic construct
  misc_feature 1..22: note = Description of Artificial Sequence: Syntheticoligonucleotide
  source 1..22: mol_type = other DNA
gggactcttgcaagagtccctg

SEQ ID NO: 10109 - DNA, 22 bp, synthetic construct
  misc_feature 1..22: note = Description of Artificial Sequence: Syntheticoligonucleotide
  source 1..22: mol_type = other DNA
aggactcttgcaagagtcctgg

SEQ ID NO: 10110 - DNA, 22 bp, synthetic construct
  misc_feature 1..22: note = Description of Artificial Sequence: Syntheticoligonucleotide
  source 1..22: mol_type = other DNA
gagactcttgcaagagtctcgg

SEQ ID NO: 10111 - DNA, 22 bp, synthetic construct
  misc_feature 1..22: note = Description of Artificial Sequence: Syntheticoligonucleotide
  source 1..22: mol_type = other DNA
gggactcttgcaagagtcccga

SEQ ID NO: 10112 - DNA, 22 bp, synthetic construct
  misc_feature 1..22: note = Description of Artificial Sequence: Syntheticoligonucleotide
  source 1..22: mol_type = other DNA
gggactcttgcaagagtcccag

SEQ ID NO: 10113 - DNA, 22 bp, synthetic construct
  misc_feature 1..22: note = Description of Artificial Sequence: Syntheticoligonucleotide
  source 1..22: mol_type = other DNA
tggactcttgcaagagtccagg

SEQ ID NO: 10114 - DNA, 22 bp, synthetic construct
  misc_feature 1..22: note = Description of Artificial Sequence: Syntheticoligonucleotide
  source 1..22: mol_type = other DNA
gtgactcttgcaagagtcacgg

SEQ ID NO: 10115 - DNA, 22 bp, synthetic construct
  misc_feature 1..22: note = Description of Artificial Sequence: Syntheticoligonucleotide
  source 1..22: mol_type = other DNA
gcgactcttgcaagagtcgccg

SEQ ID NO: 10116 - DNA, 22 bp, synthetic construct
  misc_feature 1..22: note = Description of Artificial Sequence: Syntheticoligonucleotide
  source 1..22: mol_type = other DNA
gcgactcttgcaagagtcgctg

SEQ ID NO: 10117 - DNA, 22 bp, synthetic construct
  misc_feature 1..22: note = Description of Artificial Sequence: Syntheticoligonucleotide
  source 1..22: mol_type = other DNA
acgactcttgcaagagtcgtcg

SEQ ID NO: 10118 - DNA, 22 bp, synthetic construct
  misc_feature 1..22: note = Description of Artificial Sequence: Syntheticoligonucleotide
  source 1..22: mol_type = other DNA
gagactcttgcaagagtctccg

SEQ ID NO: 10119 - DNA, 22 bp, synthetic construct
  misc_feature 1..22: note = Description of Artificial Sequence: Syntheticoligonucleotide
  source 1..22: mol_type = other DNA
gcgactcttgcaagagtcgcag

SEQ ID NO: 10120 - DNA, 22 bp, synthetic construct
  misc_feature 1..22: note = Description of Artificial Sequence: Syntheticoligonucleotide
  source 1..22: mol_type = other DNA
gtgactcttgcaagagtcaccg

SEQ ID NO: 10121 - DNA, 22 bp, synthetic construct
  misc_feature 1..22: note = Description of Artificial Sequence: Syntheticoligonucleotide
  source 1..22: mol_type = other DNA
cggactcttgcaagagtccgtg

SEQ ID NO: 10122 - DNA, 22 bp, synthetic construct
  misc_feature 1..22: note = Description of Artificial Sequence: Syntheticoligonucleotide
  source 1..22: mol_type = other DNA
cagactcttgcaagagtctggg

SEQ ID NO: 10123 - DNA, 22 bp, synthetic construct
  misc_feature 1..22: note = Description of Artificial Sequence: Syntheticoligonucleotide
  source 1..22: mol_type = other DNA
cggactcttgcaagagtccgag

SEQ ID NO: 10124 - DNA, 22 bp, synthetic construct
  misc_feature 1..22: note = Description of Artificial Sequence: Syntheticoligonucleotide
  source 1..22: mol_type = other DNA
ctgactcttgcaagagtcaggg

SEQ ID NO: 10125 - DNA, 22 bp, synthetic construct
  misc_feature 1..22: note = Description of Artificial Sequence: Syntheticoligonucleotide
  source 1..22: mol_type = other DNA
acgactcttgcaagagtcgtgg

SEQ ID NO: 10126 - DNA, 22 bp, synthetic construct
  misc_feature 1..22: note = Description of Artificial Sequence: Syntheticoligonucleotide
  source 1..22: mol_type = other DNA
ccgactcttgcaagagtcggct

SEQ ID NO: 10127 - DNA, 22 bp, synthetic construct
  misc_feature 1..22: note = Description of Artificial Sequence: Syntheticoligonucleotide
  source 1..22: mol_type = other DNA
ccgactcttgcaagagtcggca

SEQ ID NO: 10128 - DNA, 22 bp, synthetic construct
  misc_feature 1..22: note = Description of Artificial Sequence: Syntheticoligonucleotide
  source 1..22: mol_type = other DNA
gagactcttgcaagagtctcgc

SEQ ID NO: 10129 - DNA, 22 bp, synthetic construct
  misc_feature 1..22: note = Description of Artificial Sequence: Syntheticoligonucleotide
  source 1..22: mol_type = other DNA
gtgactcttgcaagagtcacgc

SEQ ID NO: 10130 - DNA, 22 bp, synthetic construct
  misc_feature 1..22: note = Description of Artificial Sequence: Syntheticoligonucleotide
  source 1..22: mol_type = other DNA
aggactcttgcaagagtcctgc

SEQ ID NO: 10131 - DNA, 22 bp, synthetic construct
  misc_feature 1..22: note = Description of Artificial Sequence: Syntheticoligonucleotide
  source 1..22: mol_type = other DNA
tggactcttgcaagagtccagc

SEQ ID NO: 10132 - DNA, 22 bp, synthetic construct
  misc_feature 1..22: note = Description of Artificial Sequence: Syntheticoligonucleotide
  source 1..22: mol_type = other DNA
aggactcttgcaagagtcctcg

SEQ ID NO: 10133 - DNA, 22 bp, synthetic construct
  misc_feature 1..22: note = Description of Artificial Sequence: Syntheticoligonucleotide
  source 1..22: mol_type = other DNA
tggactcttgcaagagtccacg

SEQ ID NO: 10134 - DNA, 22 bp, synthetic construct
  misc_feature 1..22: note = Description of Artificial Sequence: Syntheticoligonucleotide
  source 1..22: mol_type = other DNA
ccgactcttgcaagagtcggtg

SEQ ID NO: 10135 - DNA, 22 bp, synthetic construct
  misc_feature 1..22: note = Description of Artificial Sequence: Syntheticoligonucleotide
  source 1..22: mol_type = other DNA
ccgactcttgcaagagtcggag

SEQ ID NO: 10136 - DNA, 22 bp, synthetic construct
  misc_feature 1..22: note = Description of Artificial Sequence: Syntheticoligonucleotide
  source 1..22: mol_type = other DNA
gggactcttgcaagagtcccgc

SEQ ID NO: 10137 - DNA, 22 bp, synthetic construct
  misc_feature 1..22: note = Description of Artificial Sequence: Syntheticoligonucleotide
  source 1..22: mol_type = other DNA
gggactcttgcaagagtccctc

SEQ ID NO: 10138 - DNA, 22 bp, synthetic construct
  misc_feature 1..22: note = Description of Artificial Sequence: Syntheticoligonucleotide
  source 1..22: mol_type = other DNA
gggactcttgcaagagtcccac

SEQ ID NO: 10139 - DNA, 22 bp, synthetic construct
  misc_feature 1..22: note = Description of Artificial Sequence: Syntheticoligonucleotide
  misc_difference 1..2: note = a, c, t, or g
  misc_difference 19..22: note = a, c, t, or g
  source 1..22: mol_type = other DNA
nngactcttcgaagagtcnnnn

SEQ ID NO: 10140 - DNA, 22 bp, synthetic construct
  misc_feature 1..22: note = Description of Artificial Sequence: Syntheticoligonucleotide
  source 1..22: mol_type = other DNA
cggactcttcgaagagtccgcc

SEQ ID NO: 10141 - DNA, 22 bp, synthetic construct
  misc_feature 1..22: note = Description of Artificial Sequence: Syntheticoligonucleotide
  source 1..22: mol_type = other DNA
cggactcttcgaagagtccgct

SEQ ID NO: 10142 - DNA, 22 bp, synthetic construct
  misc_feature 1..22: note = Description of Artificial Sequence: Syntheticoligonucleotide
  source 1..22: mol_type = other DNA
cggactcttcgaagagtccgtc

SEQ ID NO: 10143 - DNA, 22 bp, synthetic construct
  misc_feature 1..22: note = Description of Artificial Sequence: Syntheticoligonucleotide
  source 1..22: mol_type = other DNA
aggactcttcgaagagtcctcc

SEQ ID NO: 10144 - DNA, 22 bp, synthetic construct
  misc_feature 1..22: note = Description of Artificial Sequence: Syntheticoligonucleotide
  source 1..22: mol_type = other DNA
cagactcttcgaagagtctgcc

SEQ ID NO: 10145 - DNA, 22 bp, synthetic construct
  misc_feature 1..22: note = Description of Artificial Sequence: Syntheticoligonucleotide
  source 1..22: mol_type = other DNA
cggactcttcgaagagtccgca

SEQ ID NO: 10146 - DNA, 22 bp, synthetic construct
  misc_feature 1..22: note = Description of Artificial Sequence: Syntheticoligonucleotide
  source 1..22: mol_type = other DNA
cggactcttcgaagagtccgac

SEQ ID NO: 10147 - DNA, 22 bp, synthetic construct
  misc_feature 1..22: note = Description of Artificial Sequence: Syntheticoligonucleotide
  source 1..22: mol_type = other DNA
tggactcttcgaagagtccacc

SEQ ID NO: 10148 - DNA, 22 bp, synthetic construct
  misc_feature 1..22: note = Description of Artificial Sequence: Syntheticoligonucleotide
  source 1..22: mol_type = other DNA
ctgactcttcgaagagtcagcc

SEQ ID NO: 10149 - DNA, 22 bp, synthetic construct
  misc_feature 1..22: note = Description of Artificial Sequence: Syntheticoligonucleotide
  source 1..22: mol_type = other DNA
ccgactcttcgaagagtcgggc

SEQ ID NO: 10150 - DNA, 22 bp, synthetic construct
  misc_feature 1..22: note = Description of Artificial Sequence: Syntheticoligonucleotide
  source 1..22: mol_type = other DNA
ccgactcttcgaagagtcgggt

SEQ ID NO: 10151 - DNA, 22 bp, synthetic construct
  misc_feature 1..22: note = Description of Artificial Sequence: Syntheticoligonucleotide
  source 1..22: mol_type = other DNA
ccgactcttcgaagagtcggtc

SEQ ID NO: 10152 - DNA, 22 bp, synthetic construct
  misc_feature 1..22: note = Description of Artificial Sequence: Syntheticoligonucleotide
  source 1..22: mol_type = other DNA
acgactcttcgaagagtcgtgc

SEQ ID NO: 10153 - DNA, 22 bp, synthetic construct
  misc_feature 1..22: note = Description of Artificial Sequence: Syntheticoligonucleotide
  source 1..22: mol_type = other DNA
cagactcttcgaagagtctggc

SEQ ID NO: 10154 - DNA, 22 bp, synthetic construct
  misc_feature 1..22: note = Description of Artificial Sequence: Syntheticoligonucleotide
  source 1..22: mol_type = other DNA
ccgactcttcgaagagtcggga

SEQ ID NO: 10155 - DNA, 22 bp, synthetic construct
  misc_feature 1..22: note = Description of Artificial Sequence: Syntheticoligonucleotide
  source 1..22: mol_type = other DNA
ccgactcttcgaagagtcggac

SEQ ID NO: 10156 - DNA, 22 bp, synthetic construct
  misc_feature 1..22: note = Description of Artificial Sequence: Syntheticoligonucleotide
  source 1..22: mol_type = other DNA
ctgactcttcgaagagtcaggc

SEQ ID NO: 10157 - DNA, 22 bp, synthetic construct
  misc_feature 1..22: note = Description of Artificial Sequence: Syntheticoligonucleotide
  source 1..22: mol_type = other DNA
gcgactcttcgaagagtcgccc

SEQ ID NO: 10158 - DNA, 22 bp, synthetic construct
  misc_feature 1..22: note = Description of Artificial Sequence: Syntheticoligonucleotide
  source 1..22: mol_type = other DNA
gcgactcttcgaagagtcgcct

SEQ ID NO: 10159 - DNA, 22 bp, synthetic construct
  misc_feature 1..22: note = Description of Artificial Sequence: Syntheticoligonucleotide
  source 1..22: mol_type = other DNA
gcgactcttcgaagagtcgctc

SEQ ID NO: 10160 - DNA, 22 bp, synthetic construct
  misc_feature 1..22: note = Description of Artificial Sequence: Syntheticoligonucleotide
  source 1..22: mol_type = other DNA
acgactcttcgaagagtcgtcc

SEQ ID NO: 10161 - DNA, 22 bp, synthetic construct
  misc_feature 1..22: note = Description of Artificial Sequence: Syntheticoligonucleotide
  source 1..22: mol_type = other DNA
gagactcttcgaagagtctccc

SEQ ID NO: 10162 - DNA, 22 bp, synthetic construct
  misc_feature 1..22: note = Description of Artificial Sequence: Syntheticoligonucleotide
  source 1..22: mol_type = other DNA
gcgactcttcgaagagtcgcca

SEQ ID NO: 10163 - DNA, 22 bp, synthetic construct
  misc_feature 1..22: note = Description of Artificial Sequence: Syntheticoligonucleotide
  source 1..22: mol_type = other DNA
gcgactcttcgaagagtcgcac

SEQ ID NO: 10164 - DNA, 22 bp, synthetic construct
  misc_feature 1..22: note = Description of Artificial Sequence: Syntheticoligonucleotide
  source 1..22: mol_type = other DNA
gtgactcttcgaagagtcaccc

SEQ ID NO: 10165 - DNA, 22 bp, synthetic construct
  misc_feature 1..22: note = Description of Artificial Sequence: Syntheticoligonucleotide
  source 1..22: mol_type = other DNA
gggactcttcgaagagtcccgt

SEQ ID NO: 10166 - DNA, 22 bp, synthetic construct
  misc_feature 1..22: note = Description of Artificial Sequence: Syntheticoligonucleotide
  source 1..22: mol_type = other DNA
gggactcttcgaagagtccctg

SEQ ID NO: 10167 - DNA, 22 bp, synthetic construct
  misc_feature 1..22: note = Description of Artificial Sequence: Syntheticoligonucleotide
  source 1..22: mol_type = other DNA
aggactcttcgaagagtcctgg

SEQ ID NO: 10168 - DNA, 22 bp, synthetic construct
  misc_feature 1..22: note = Description of Artificial Sequence: Syntheticoligonucleotide
  source 1..22: mol_type = other DNA
gagactcttcgaagagtctcgg

SEQ ID NO: 10169 - DNA, 22 bp, synthetic construct
  misc_feature 1..22: note = Description of Artificial Sequence: Syntheticoligonucleotide
  source 1..22: mol_type = other DNA
gggactcttcgaagagtcccga

SEQ ID NO: 10170 - DNA, 22 bp, synthetic construct
  misc_feature 1..22: note = Description of Artificial Sequence: Syntheticoligonucleotide
  source 1..22: mol_type = other DNA
gggactcttcgaagagtcccag

SEQ ID NO: 10171 - DNA, 22 bp, synthetic construct
  misc_feature 1..22: note = Description of Artificial Sequence: Syntheticoligonucleotide
  source 1..22: mol_type = other DNA
tggactcttcgaagagtccagg

SEQ ID NO: 10172 - DNA, 22 bp, synthetic construct
  misc_feature 1..22: note = Description of Artificial Sequence: Syntheticoligonucleotide
  source 1..22: mol_type = other DNA
gtgactcttcgaagagtcacgg

SEQ ID NO: 10173 - DNA, 22 bp, synthetic construct
  misc_feature 1..22: note = Description of Artificial Sequence: Syntheticoligonucleotide
  source 1..22: mol_type = other DNA
gcgactcttcgaagagtcgccg

SEQ ID NO: 10174 - DNA, 22 bp, synthetic construct
  misc_feature 1..22: note = Description of Artificial Sequence: Syntheticoligonucleotide
  source 1..22: mol_type = other DNA
gcgactcttcgaagagtcgctg

SEQ ID NO: 10175 - DNA, 22 bp, synthetic construct
  misc_feature 1..22: note = Description of Artificial Sequence: Syntheticoligonucleotide
  source 1..22: mol_type = other DNA
acgactcttcgaagagtcgtcg

SEQ ID NO: 10176 - DNA, 22 bp, synthetic construct
  misc_feature 1..22: note = Description of Artificial Sequence: Syntheticoligonucleotide
  source 1..22: mol_type = other DNA
gagactcttcgaagagtctccg

SEQ ID NO: 10177 - DNA, 22 bp, synthetic construct
  misc_feature 1..22: note = Description of Artificial Sequence: Syntheticoligonucleotide
  source 1..22: mol_type = other DNA
gcgactcttcgaagagtcgcag

SEQ ID NO: 10178 - DNA, 22 bp, synthetic construct
  misc_feature 1..22: note = Description of Artificial Sequence: Syntheticoligonucleotide
  source 1..22: mol_type = other DNA
gtgactcttcgaagagtcaccg

SEQ ID NO: 10179 - DNA, 22 bp, synthetic construct
  misc_feature 1..22: note = Description of Artificial Sequence: Syntheticoligonucleotide
  source 1..22: mol_type = other DNA
cggactcttcgaagagtccgtg

SEQ ID NO: 10180 - DNA, 22 bp, synthetic construct
  misc_feature 1..22: note = Description of Artificial Sequence: Syntheticoligonucleotide
  source 1..22: mol_type = other DNA
cagactcttcgaagagtctggg

SEQ ID NO: 10181 - DNA, 22 bp, synthetic construct
  misc_feature 1..22: note = Description of Artificial Sequence: Syntheticoligonucleotide
  source 1..22: mol_type = other DNA
cggactcttcgaagagtccgag

SEQ ID NO: 10182 - DNA, 22 bp, synthetic construct
  misc_feature 1..22: note = Description of Artificial Sequence: Syntheticoligonucleotide
  source 1..22: mol_type = other DNA
ctgactcttcgaagagtcaggg

SEQ ID NO: 10183 - DNA, 22 bp, synthetic construct
  misc_feature 1..22: note = Description of Artificial Sequence: Syntheticoligonucleotide
  source 1..22: mol_type = other DNA
acgactcttcgaagagtcgtgg

SEQ ID NO: 10184 - DNA, 22 bp, synthetic construct
  misc_feature 1..22: note = Description of Artificial Sequence: Syntheticoligonucleotide
  source 1..22: mol_type = other DNA
ccgactcttcgaagagtcggct

SEQ ID NO: 10185 - DNA, 22 bp, synthetic construct
  misc_feature 1..22: note = Description of Artificial Sequence: Syntheticoligonucleotide
  source 1..22: mol_type = other DNA
ccgactcttcgaagagtcggca

SEQ ID NO: 10186 - DNA, 22 bp, synthetic construct
  misc_feature 1..22: note = Description of Artificial Sequence: Syntheticoligonucleotide
  source 1..22: mol_type = other DNA
gagactcttcgaagagtctcgc

SEQ ID NO: 10187 - DNA, 22 bp, synthetic construct
  misc_feature 1..22: note = Description of Artificial Sequence: Syntheticoligonucleotide
  source 1..22: mol_type = other DNA
gtgactcttcgaagagtcacgc

SEQ ID NO: 10188 - DNA, 22 bp, synthetic construct
  misc_feature 1..22: note = Description of Artificial Sequence: Syntheticoligonucleotide
  source 1..22: mol_type = other DNA
aggactcttcgaagagtcctgc

SEQ ID NO: 10189 - DNA, 22 bp, synthetic construct
  misc_feature 1..22: note = Description of Artificial Sequence: Syntheticoligonucleotide
  source 1..22: mol_type = other DNA
tggactcttcgaagagtccagc

SEQ ID NO: 10190 - DNA, 22 bp, synthetic construct
  misc_feature 1..22: note = Description of Artificial Sequence: Syntheticoligonucleotide
  source 1..22: mol_type = other DNA
aggactcttcgaagagtcctcg

SEQ ID NO: 10191 - DNA, 22 bp, synthetic construct
  misc_feature 1..22: note = Description of Artificial Sequence: Syntheticoligonucleotide
  source 1..22: mol_type = other DNA
tggactcttcgaagagtccacg

SEQ ID NO: 10192 - DNA, 22 bp, synthetic construct
  misc_feature 1..22: note = Description of Artificial Sequence: Syntheticoligonucleotide
  source 1..22: mol_type = other DNA
ccgactcttcgaagagtcggtg

SEQ ID NO: 10193 - DNA, 22 bp, synthetic construct
  misc_feature 1..22: note = Description of Artificial Sequence: Syntheticoligonucleotide
  source 1..22: mol_type = other DNA
ccgactcttcgaagagtcggag

SEQ ID NO: 10194 - DNA, 22 bp, synthetic construct
  misc_feature 1..22: note = Description of Artificial Sequence: Syntheticoligonucleotide
  source 1..22: mol_type = other DNA
gggactcttcgaagagtcccgc

SEQ ID NO: 10195 - DNA, 22 bp, synthetic construct
  misc_feature 1..22: note = Description of Artificial Sequence: Syntheticoligonucleotide
  source 1..22: mol_type = other DNA
gggactcttcgaagagtccctc

SEQ ID NO: 10196 - DNA, 22 bp, synthetic construct
  misc_feature 1..22: note = Description of Artificial Sequence: Syntheticoligonucleotide
  source 1..22: mol_type = other DNA
gggactcttcgaagagtcccac

SEQ ID NO: 10197 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactccgatcggagtcn

SEQ ID NO: 10198 - DNA, 18 bp, synthetic construct
  misc_feature 1..18: note = Description of Artificial Sequence: Syntheticoligonucleotide
  source 1..18: mol_type = other DNA
ggactccgatcggagtcc

SEQ ID NO: 10199 - DNA, 18 bp, synthetic construct
  misc_feature 1..18: note = Description of Artificial Sequence: Syntheticoligonucleotide
  source 1..18: mol_type = other DNA
agactccgatcggagtct

SEQ ID NO: 10200 - DNA, 18 bp, synthetic construct
  misc_feature 1..18: note = Description of Artificial Sequence: Syntheticoligonucleotide
  source 1..18: mol_type = other DNA
tgactccgatcggagtca

SEQ ID NO: 10201 - DNA, 18 bp, synthetic construct
  misc_feature 1..18: note = Description of Artificial Sequence: Syntheticoligonucleotide
  source 1..18: mol_type = other DNA
cgactccgatcggagtcg

SEQ ID NO: 10202 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcgtgcacgagtcn

SEQ ID NO: 10203 - DNA, 18 bp, synthetic construct
  misc_feature 1..18: note = Description of Artificial Sequence: Syntheticoligonucleotide
  source 1..18: mol_type = other DNA
ggactcgtgcacgagtcc

SEQ ID NO: 10204 - DNA, 18 bp, synthetic construct
  misc_feature 1..18: note = Description of Artificial Sequence: Syntheticoligonucleotide
  source 1..18: mol_type = other DNA
agactcgtgcacgagtct

SEQ ID NO: 10205 - DNA, 18 bp, synthetic construct
  misc_feature 1..18: note = Description of Artificial Sequence: Syntheticoligonucleotide
  source 1..18: mol_type = other DNA
tgactcgtgcacgagtca

SEQ ID NO: 10206 - DNA, 18 bp, synthetic construct
  misc_feature 1..18: note = Description of Artificial Sequence: Syntheticoligonucleotide
  source 1..18: mol_type = other DNA
cgactcgtgcacgagtcg

SEQ ID NO: 10207 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactccccggggagtcn

SEQ ID NO: 10208 - DNA, 18 bp, synthetic construct
  misc_feature 1..18: note = Description of Artificial Sequence: Syntheticoligonucleotide
  source 1..18: mol_type = other DNA
ggactccccggggagtcc

SEQ ID NO: 10209 - DNA, 18 bp, synthetic construct
  misc_feature 1..18: note = Description of Artificial Sequence: Syntheticoligonucleotide
  source 1..18: mol_type = other DNA
agactccccggggagtct

SEQ ID NO: 10210 - DNA, 18 bp, synthetic construct
  misc_feature 1..18: note = Description of Artificial Sequence: Syntheticoligonucleotide
  source 1..18: mol_type = other DNA
tgactccccggggagtca

SEQ ID NO: 10211 - DNA, 18 bp, synthetic construct
  misc_feature 1..18: note = Description of Artificial Sequence: Syntheticoligonucleotide
  source 1..18: mol_type = other DNA
cgactccccggggagtcg

SEQ ID NO: 10212 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcggtaccgagtcn

SEQ ID NO: 10213 - DNA, 18 bp, synthetic construct
  misc_feature 1..18: note = Description of Artificial Sequence: Syntheticoligonucleotide
  source 1..18: mol_type = other DNA
ggactcggtaccgagtcc

SEQ ID NO: 10214 - DNA, 18 bp, synthetic construct
  misc_feature 1..18: note = Description of Artificial Sequence: Syntheticoligonucleotide
  source 1..18: mol_type = other DNA
agactcggtaccgagtct

SEQ ID NO: 10215 - DNA, 18 bp, synthetic construct
  misc_feature 1..18: note = Description of Artificial Sequence: Syntheticoligonucleotide
  source 1..18: mol_type = other DNA
tgactcggtaccgagtca

SEQ ID NO: 10216 - DNA, 18 bp, synthetic construct
  misc_feature 1..18: note = Description of Artificial Sequence: Syntheticoligonucleotide
  source 1..18: mol_type = other DNA
cgactcggtaccgagtcg

SEQ ID NO: 10217 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcaccggtgagtcn

SEQ ID NO: 10218 - DNA, 18 bp, synthetic construct
  misc_feature 1..18: note = Description of Artificial Sequence: Syntheticoligonucleotide
  source 1..18: mol_type = other DNA
ggactcaccggtgagtcc

SEQ ID NO: 10219 - DNA, 18 bp, synthetic construct
  misc_feature 1..18: note = Description of Artificial Sequence: Syntheticoligonucleotide
  source 1..18: mol_type = other DNA
agactcaccggtgagtct

SEQ ID NO: 10220 - DNA, 18 bp, synthetic construct
  misc_feature 1..18: note = Description of Artificial Sequence: Syntheticoligonucleotide
  source 1..18: mol_type = other DNA
tgactcaccggtgagtca

SEQ ID NO: 10221 - DNA, 18 bp, synthetic construct
  misc_feature 1..18: note = Description of Artificial Sequence: Syntheticoligonucleotide
  source 1..18: mol_type = other DNA
cgactcaccggtgagtcg

SEQ ID NO: 10222 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactccatatggagtcn

SEQ ID NO: 10223 - DNA, 18 bp, synthetic construct
  misc_feature 1..18: note = Description of Artificial Sequence: Syntheticoligonucleotide
  source 1..18: mol_type = other DNA
ggactccatatggagtcc

SEQ ID NO: 10224 - DNA, 18 bp, synthetic construct
  misc_feature 1..18: note = Description of Artificial Sequence: Syntheticoligonucleotide
  source 1..18: mol_type = other DNA
cgactccatatggagtcg

SEQ ID NO: 10225 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcgttaacgagtcn

SEQ ID NO: 10226 - DNA, 18 bp, synthetic construct
  misc_feature 1..18: note = Description of Artificial Sequence: Syntheticoligonucleotide
  source 1..18: mol_type = other DNA
ggactcgttaacgagtcc

SEQ ID NO: 10227 - DNA, 18 bp, synthetic construct
  misc_feature 1..18: note = Description of Artificial Sequence: Syntheticoligonucleotide
  source 1..18: mol_type = other DNA
cgactcgttaacgagtcg

SEQ ID NO: 10228 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactctctagagagtcn

SEQ ID NO: 10229 - DNA, 18 bp, synthetic construct
  misc_feature 1..18: note = Description of Artificial Sequence: Syntheticoligonucleotide
  source 1..18: mol_type = other DNA
ggactctctagagagtcc

SEQ ID NO: 10230 - DNA, 18 bp, synthetic construct
  misc_feature 1..18: note = Description of Artificial Sequence: Syntheticoligonucleotide
  source 1..18: mol_type = other DNA
cgactctctagagagtcg

SEQ ID NO: 10231 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcatgcatgagtcn

SEQ ID NO: 10232 - DNA, 18 bp, synthetic construct
  misc_feature 1..18: note = Description of Artificial Sequence: Syntheticoligonucleotide
  source 1..18: mol_type = other DNA
ggactcatgcatgagtcc

SEQ ID NO: 10233 - DNA, 18 bp, synthetic construct
  misc_feature 1..18: note = Description of Artificial Sequence: Syntheticoligonucleotide
  source 1..18: mol_type = other DNA
tgactcatgcatgagtca

SEQ ID NO: 10234 - DNA, 18 bp, synthetic construct
  misc_feature 1..18: note = Description of Artificial Sequence: Syntheticoligonucleotide
  source 1..18: mol_type = other DNA
cgactcatgcatgagtcg

SEQ ID NO: 10235 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcactagtgagtcn

SEQ ID NO: 10236 - DNA, 18 bp, synthetic construct
  misc_feature 1..18: note = Description of Artificial Sequence: Syntheticoligonucleotide
  source 1..18: mol_type = other DNA
cgactcactagtgagtcg

SEQ ID NO: 10237 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactccgtacggagtcn

SEQ ID NO: 10238 - DNA, 18 bp, synthetic construct
  misc_feature 1..18: note = Description of Artificial Sequence: Syntheticoligonucleotide
  source 1..18: mol_type = other DNA
ggactccgtacggagtcc

SEQ ID NO: 10239 - DNA, 18 bp, synthetic construct
  misc_feature 1..18: note = Description of Artificial Sequence: Syntheticoligonucleotide
  source 1..18: mol_type = other DNA
agactccgtacggagtct

SEQ ID NO: 10240 - DNA, 18 bp, synthetic construct
  misc_feature 1..18: note = Description of Artificial Sequence: Syntheticoligonucleotide
  source 1..18: mol_type = other DNA
tgactccgtacggagtca

SEQ ID NO: 10241 - DNA, 18 bp, synthetic construct
  misc_feature 1..18: note = Description of Artificial Sequence: Syntheticoligonucleotide
  source 1..18: mol_type = other DNA
cgactccgtacggagtcg

SEQ ID NO: 10242 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcctgcaggagtcn

SEQ ID NO: 10243 - DNA, 18 bp, synthetic construct
  misc_feature 1..18: note = Description of Artificial Sequence: Syntheticoligonucleotide
  source 1..18: mol_type = other DNA
ggactcctgcaggagtcc

SEQ ID NO: 10244 - DNA, 18 bp, synthetic construct
  misc_feature 1..18: note = Description of Artificial Sequence: Syntheticoligonucleotide
  source 1..18: mol_type = other DNA
agactcctgcaggagtct

SEQ ID NO: 10245 - DNA, 18 bp, synthetic construct
  misc_feature 1..18: note = Description of Artificial Sequence: Syntheticoligonucleotide
  source 1..18: mol_type = other DNA
tgactcctgcaggagtca

SEQ ID NO: 10246 - DNA, 18 bp, synthetic construct
  misc_feature 1..18: note = Description of Artificial Sequence: Syntheticoligonucleotide
  source 1..18: mol_type = other DNA
cgactcctgcaggagtcg

SEQ ID NO: 10247 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcgtcgacgagtcn

SEQ ID NO: 10248 - DNA, 18 bp, synthetic construct
  misc_feature 1..18: note = Description of Artificial Sequence: Syntheticoligonucleotide
  source 1..18: mol_type = other DNA
ggactcgtcgacgagtcc

SEQ ID NO: 10249 - DNA, 18 bp, synthetic construct
  misc_feature 1..18: note = Description of Artificial Sequence: Syntheticoligonucleotide
  source 1..18: mol_type = other DNA
agactcgtcgacgagtct

SEQ ID NO: 10250 - DNA, 18 bp, synthetic construct
  misc_feature 1..18: note = Description of Artificial Sequence: Syntheticoligonucleotide
  source 1..18: mol_type = other DNA
tgactcgtcgacgagtca

SEQ ID NO: 10251 - DNA, 18 bp, synthetic construct
  misc_feature 1..18: note = Description of Artificial Sequence: Syntheticoligonucleotide
  source 1..18: mol_type = other DNA
cgactcgtcgacgagtcg

SEQ ID NO: 10252 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcagcgctgagtcn

SEQ ID NO: 10253 - DNA, 18 bp, synthetic construct
  misc_feature 1..18: note = Description of Artificial Sequence: Syntheticoligonucleotide
  source 1..18: mol_type = other DNA
ggactcagcgctgagtcc

SEQ ID NO: 10254 - DNA, 18 bp, synthetic construct
  misc_feature 1..18: note = Description of Artificial Sequence: Syntheticoligonucleotide
  source 1..18: mol_type = other DNA
agactcagcgctgagtct

SEQ ID NO: 10255 - DNA, 18 bp, synthetic construct
  misc_feature 1..18: note = Description of Artificial Sequence: Syntheticoligonucleotide
  source 1..18: mol_type = other DNA
tgactcagcgctgagtca

SEQ ID NO: 10256 - DNA, 18 bp, synthetic construct
  misc_feature 1..18: note = Description of Artificial Sequence: Syntheticoligonucleotide
  source 1..18: mol_type = other DNA
cgactcagcgctgagtcg

SEQ ID NO: 10257 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcggcgccgagtcn

SEQ ID NO: 10258 - DNA, 18 bp, synthetic construct
  misc_feature 1..18: note = Description of Artificial Sequence: Syntheticoligonucleotide
  source 1..18: mol_type = other DNA
ggactcggcgccgagtcc

SEQ ID NO: 10259 - DNA, 18 bp, synthetic construct
  misc_feature 1..18: note = Description of Artificial Sequence: Syntheticoligonucleotide
  source 1..18: mol_type = other DNA
agactcggcgccgagtct

SEQ ID NO: 10260 - DNA, 18 bp, synthetic construct
  misc_feature 1..18: note = Description of Artificial Sequence: Syntheticoligonucleotide
  source 1..18: mol_type = other DNA
tgactcggcgccgagtca

SEQ ID NO: 10261 - DNA, 18 bp, synthetic construct
  misc_feature 1..18: note = Description of Artificial Sequence: Syntheticoligonucleotide
  source 1..18: mol_type = other DNA
cgactcggcgccgagtcg

SEQ ID NO: 10262 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcacatgtgagtcn

SEQ ID NO: 10263 - DNA, 18 bp, synthetic construct
  misc_feature 1..18: note = Description of Artificial Sequence: Syntheticoligonucleotide
  source 1..18: mol_type = other DNA
ggactcacatgtgagtcc

SEQ ID NO: 10264 - DNA, 18 bp, synthetic construct
  misc_feature 1..18: note = Description of Artificial Sequence: Syntheticoligonucleotide
  source 1..18: mol_type = other DNA
cgactcacatgtgagtcg

SEQ ID NO: 10265 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactctagctagagtcn

SEQ ID NO: 10266 - DNA, 18 bp, synthetic construct
  misc_feature 1..18: note = Description of Artificial Sequence: Syntheticoligonucleotide
  source 1..18: mol_type = other DNA
ggactctagctagagtcc

SEQ ID NO: 10267 - DNA, 18 bp, synthetic construct
  misc_feature 1..18: note = Description of Artificial Sequence: Syntheticoligonucleotide
  source 1..18: mol_type = other DNA
cgactctagctagagtcg

SEQ ID NO: 10268 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcagtactgagtcn

SEQ ID NO: 10269 - DNA, 18 bp, synthetic construct
  misc_feature 1..18: note = Description of Artificial Sequence: Syntheticoligonucleotide
  source 1..18: mol_type = other DNA
ggactcagtactgagtcc

SEQ ID NO: 10270 - DNA, 18 bp, synthetic construct
  misc_feature 1..18: note = Description of Artificial Sequence: Syntheticoligonucleotide
  source 1..18: mol_type = other DNA
cgactcagtactgagtcg

SEQ ID NO: 10271 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcaacgttgagtcn

SEQ ID NO: 10272 - DNA, 18 bp, synthetic construct
  misc_feature 1..18: note = Description of Artificial Sequence: Syntheticoligonucleotide
  source 1..18: mol_type = other DNA
ggactcaacgttgagtcc

SEQ ID NO: 10273 - DNA, 18 bp, synthetic construct
  misc_feature 1..18: note = Description of Artificial Sequence: Syntheticoligonucleotide
  source 1..18: mol_type = other DNA
tgactcaacgttgagtca

SEQ ID NO: 10274 - DNA, 18 bp, synthetic construct
  misc_feature 1..18: note = Description of Artificial Sequence: Syntheticoligonucleotide
  source 1..18: mol_type = other DNA
cgactcaacgttgagtcg

SEQ ID NO: 10275 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactctgtacagagtcn

SEQ ID NO: 10276 - DNA, 18 bp, synthetic construct
  misc_feature 1..18: note = Description of Artificial Sequence: Syntheticoligonucleotide
  source 1..18: mol_type = other DNA
cgactctgtacagagtcg

SEQ ID NO: 10277 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcgcatgcgagtcn

SEQ ID NO: 10278 - DNA, 18 bp, synthetic construct
  misc_feature 1..18: note = Description of Artificial Sequence: Syntheticoligonucleotide
  source 1..18: mol_type = other DNA
ggactcgcatgcgagtcc

SEQ ID NO: 10279 - DNA, 18 bp, synthetic construct
  misc_feature 1..18: note = Description of Artificial Sequence: Syntheticoligonucleotide
  source 1..18: mol_type = other DNA
agactcgcatgcgagtct

SEQ ID NO: 10280 - DNA, 18 bp, synthetic construct
  misc_feature 1..18: note = Description of Artificial Sequence: Syntheticoligonucleotide
  source 1..18: mol_type = other DNA
tgactcgcatgcgagtca

SEQ ID NO: 10281 - DNA, 18 bp, synthetic construct
  misc_feature 1..18: note = Description of Artificial Sequence: Syntheticoligonucleotide
  source 1..18: mol_type = other DNA
cgactcgcatgcgagtcg

SEQ ID NO: 10282 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactccagctggagtcn

SEQ ID NO: 10283 - DNA, 18 bp, synthetic construct
  misc_feature 1..18: note = Description of Artificial Sequence: Syntheticoligonucleotide
  source 1..18: mol_type = other DNA
ggactccagctggagtcc

SEQ ID NO: 10284 - DNA, 18 bp, synthetic construct
  misc_feature 1..18: note = Description of Artificial Sequence: Syntheticoligonucleotide
  source 1..18: mol_type = other DNA
agactccagctggagtct

SEQ ID NO: 10285 - DNA, 18 bp, synthetic construct
  misc_feature 1..18: note = Description of Artificial Sequence: Syntheticoligonucleotide
  source 1..18: mol_type = other DNA
tgactccagctggagtca

SEQ ID NO: 10286 - DNA, 18 bp, synthetic construct
  misc_feature 1..18: note = Description of Artificial Sequence: Syntheticoligonucleotide
  source 1..18: mol_type = other DNA
cgactccagctggagtcg

SEQ ID NO: 10287 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcctcgaggagtcn

SEQ ID NO: 10288 - DNA, 18 bp, synthetic construct
  misc_feature 1..18: note = Description of Artificial Sequence: Syntheticoligonucleotide
  source 1..18: mol_type = other DNA
ggactcctcgaggagtcc

SEQ ID NO: 10289 - DNA, 18 bp, synthetic construct
  misc_feature 1..18: note = Description of Artificial Sequence: Syntheticoligonucleotide
  source 1..18: mol_type = other DNA
agactcctcgaggagtct

SEQ ID NO: 10290 - DNA, 18 bp, synthetic construct
  misc_feature 1..18: note = Description of Artificial Sequence: Syntheticoligonucleotide
  source 1..18: mol_type = other DNA
tgactcctcgaggagtca

SEQ ID NO: 10291 - DNA, 18 bp, synthetic construct
  misc_feature 1..18: note = Description of Artificial Sequence: Syntheticoligonucleotide
  source 1..18: mol_type = other DNA
cgactcctcgaggagtcg

SEQ ID NO: 10292 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactccctagggagtcn

SEQ ID NO: 10293 - DNA, 18 bp, synthetic construct
  misc_feature 1..18: note = Description of Artificial Sequence: Syntheticoligonucleotide
  source 1..18: mol_type = other DNA
ggactccctagggagtcc

SEQ ID NO: 10294 - DNA, 18 bp, synthetic construct
  misc_feature 1..18: note = Description of Artificial Sequence: Syntheticoligonucleotide
  source 1..18: mol_type = other DNA
agactccctagggagtct

SEQ ID NO: 10295 - DNA, 18 bp, synthetic construct
  misc_feature 1..18: note = Description of Artificial Sequence: Syntheticoligonucleotide
  source 1..18: mol_type = other DNA
tgactccctagggagtca

SEQ ID NO: 10296 - DNA, 18 bp, synthetic construct
  misc_feature 1..18: note = Description of Artificial Sequence: Syntheticoligonucleotide
  source 1..18: mol_type = other DNA
cgactccctagggagtcg

SEQ ID NO: 10297 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcacgcgtgagtcn

SEQ ID NO: 10298 - DNA, 18 bp, synthetic construct
  misc_feature 1..18: note = Description of Artificial Sequence: Syntheticoligonucleotide
  source 1..18: mol_type = other DNA
ggactcacgcgtgagtcc

SEQ ID NO: 10299 - DNA, 18 bp, synthetic construct
  misc_feature 1..18: note = Description of Artificial Sequence: Syntheticoligonucleotide
  source 1..18: mol_type = other DNA
agactcacgcgtgagtct

SEQ ID NO: 10300 - DNA, 18 bp, synthetic construct
  misc_feature 1..18: note = Description of Artificial Sequence: Syntheticoligonucleotide
  source 1..18: mol_type = other DNA
tgactcacgcgtgagtca

SEQ ID NO: 10301 - DNA, 18 bp, synthetic construct
  misc_feature 1..18: note = Description of Artificial Sequence: Syntheticoligonucleotide
  source 1..18: mol_type = other DNA
cgactcacgcgtgagtcg

SEQ ID NO: 10302 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcagatctgagtcn

SEQ ID NO: 10303 - DNA, 18 bp, synthetic construct
  misc_feature 1..18: note = Description of Artificial Sequence: Syntheticoligonucleotide
  source 1..18: mol_type = other DNA
ggactcagatctgagtcc

SEQ ID NO: 10304 - DNA, 18 bp, synthetic construct
  misc_feature 1..18: note = Description of Artificial Sequence: Syntheticoligonucleotide
  source 1..18: mol_type = other DNA
cgactcagatctgagtcg

SEQ ID NO: 10305 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcttgcaagagtcn

SEQ ID NO: 10306 - DNA, 18 bp, synthetic construct
  misc_feature 1..18: note = Description of Artificial Sequence: Syntheticoligonucleotide
  source 1..18: mol_type = other DNA
ggactcttgcaagagtcc

SEQ ID NO: 10307 - DNA, 18 bp, synthetic construct
  misc_feature 1..18: note = Description of Artificial Sequence: Syntheticoligonucleotide
  source 1..18: mol_type = other DNA
cgactcttgcaagagtcg

SEQ ID NO: 10308 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactctacgtagagtcn

SEQ ID NO: 10309 - DNA, 18 bp, synthetic construct
  misc_feature 1..18: note = Description of Artificial Sequence: Syntheticoligonucleotide
  source 1..18: mol_type = other DNA
ggactctacgtagagtcc

SEQ ID NO: 10310 - DNA, 18 bp, synthetic construct
  misc_feature 1..18: note = Description of Artificial Sequence: Syntheticoligonucleotide
  source 1..18: mol_type = other DNA
cgactctacgtagagtcg

SEQ ID NO: 10311 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcgctagcgagtcn

SEQ ID NO: 10312 - DNA, 18 bp, synthetic construct
  misc_feature 1..18: note = Description of Artificial Sequence: Syntheticoligonucleotide
  source 1..18: mol_type = other DNA
ggactcgctagcgagtcc

SEQ ID NO: 10313 - DNA, 18 bp, synthetic construct
  misc_feature 1..18: note = Description of Artificial Sequence: Syntheticoligonucleotide
  source 1..18: mol_type = other DNA
agactcgctagcgagtct

SEQ ID NO: 10314 - DNA, 18 bp, synthetic construct
  misc_feature 1..18: note = Description of Artificial Sequence: Syntheticoligonucleotide
  source 1..18: mol_type = other DNA
tgactcgctagcgagtca

SEQ ID NO: 10315 - DNA, 18 bp, synthetic construct
  misc_feature 1..18: note = Description of Artificial Sequence: Syntheticoligonucleotide
  source 1..18: mol_type = other DNA
cgactcgctagcgagtcg

SEQ ID NO: 10316 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactctcgcgagagtcn

SEQ ID NO: 10317 - DNA, 18 bp, synthetic construct
  misc_feature 1..18: note = Description of Artificial Sequence: Syntheticoligonucleotide
  source 1..18: mol_type = other DNA
ggactctcgcgagagtcc

SEQ ID NO: 10318 - DNA, 18 bp, synthetic construct
  misc_feature 1..18: note = Description of Artificial Sequence: Syntheticoligonucleotide
  source 1..18: mol_type = other DNA
agactctcgcgagagtct

SEQ ID NO: 10319 - DNA, 18 bp, synthetic construct
  misc_feature 1..18: note = Description of Artificial Sequence: Syntheticoligonucleotide
  source 1..18: mol_type = other DNA
tgactctcgcgagagtca

SEQ ID NO: 10320 - DNA, 18 bp, synthetic construct
  misc_feature 1..18: note = Description of Artificial Sequence: Syntheticoligonucleotide
  source 1..18: mol_type = other DNA
cgactctcgcgagagtcg

SEQ ID NO: 10321 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactccacgtggagtcn

SEQ ID NO: 10322 - DNA, 18 bp, synthetic construct
  misc_feature 1..18: note = Description of Artificial Sequence: Syntheticoligonucleotide
  source 1..18: mol_type = other DNA
ggactccacgtggagtcc

SEQ ID NO: 10323 - DNA, 18 bp, synthetic construct
  misc_feature 1..18: note = Description of Artificial Sequence: Syntheticoligonucleotide
  source 1..18: mol_type = other DNA
agactccacgtggagtct

SEQ ID NO: 10324 - DNA, 18 bp, synthetic construct
  misc_feature 1..18: note = Description of Artificial Sequence: Syntheticoligonucleotide
  source 1..18: mol_type = other DNA
tgactccacgtggagtca

SEQ ID NO: 10325 - DNA, 18 bp, synthetic construct
  misc_feature 1..18: note = Description of Artificial Sequence: Syntheticoligonucleotide
  source 1..18: mol_type = other DNA
cgactccacgtggagtcg

SEQ ID NO: 10326 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactctccggagagtcn

SEQ ID NO: 10327 - DNA, 18 bp, synthetic construct
  misc_feature 1..18: note = Description of Artificial Sequence: Syntheticoligonucleotide
  source 1..18: mol_type = other DNA
ggactctccggagagtcc

SEQ ID NO: 10328 - DNA, 18 bp, synthetic construct
  misc_feature 1..18: note = Description of Artificial Sequence: Syntheticoligonucleotide
  source 1..18: mol_type = other DNA
agactctccggagagtct

SEQ ID NO: 10329 - DNA, 18 bp, synthetic construct
  misc_feature 1..18: note = Description of Artificial Sequence: Syntheticoligonucleotide
  source 1..18: mol_type = other DNA
tgactctccggagagtca

SEQ ID NO: 10330 - DNA, 18 bp, synthetic construct
  misc_feature 1..18: note = Description of Artificial Sequence: Syntheticoligonucleotide
  source 1..18: mol_type = other DNA
cgactctccggagagtcg

SEQ ID NO: 10331 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcgggcccgagtcn

SEQ ID NO: 10332 - DNA, 18 bp, synthetic construct
  misc_feature 1..18: note = Description of Artificial Sequence: Syntheticoligonucleotide
  source 1..18: mol_type = other DNA
ggactcgggcccgagtcc

SEQ ID NO: 10333 - DNA, 18 bp, synthetic construct
  misc_feature 1..18: note = Description of Artificial Sequence: Syntheticoligonucleotide
  source 1..18: mol_type = other DNA
agactcgggcccgagtct

SEQ ID NO: 10334 - DNA, 18 bp, synthetic construct
  misc_feature 1..18: note = Description of Artificial Sequence: Syntheticoligonucleotide
  source 1..18: mol_type = other DNA
tgactcgggcccgagtca

SEQ ID NO: 10335 - DNA, 18 bp, synthetic construct
  misc_feature 1..18: note = Description of Artificial Sequence: Syntheticoligonucleotide
  source 1..18: mol_type = other DNA
cgactcgggcccgagtcg

SEQ ID NO: 10336 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcgtatacgagtcn

SEQ ID NO: 10337 - DNA, 18 bp, synthetic construct
  misc_feature 1..18: note = Description of Artificial Sequence: Syntheticoligonucleotide
  source 1..18: mol_type = other DNA
ggactcgtatacgagtcc

SEQ ID NO: 10338 - DNA, 18 bp, synthetic construct
  misc_feature 1..18: note = Description of Artificial Sequence: Syntheticoligonucleotide
  source 1..18: mol_type = other DNA
cgactcgtatacgagtcg

SEQ ID NO: 10339 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactccttaaggagtcn

SEQ ID NO: 10340 - DNA, 18 bp, synthetic construct
  misc_feature 1..18: note = Description of Artificial Sequence: Syntheticoligonucleotide
  source 1..18: mol_type = other DNA
ggactccttaaggagtcc

SEQ ID NO: 10341 - DNA, 18 bp, synthetic construct
  misc_feature 1..18: note = Description of Artificial Sequence: Syntheticoligonucleotide
  source 1..18: mol_type = other DNA
cgactccttaaggagtcg

SEQ ID NO: 10342 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcatcgatgagtcn

SEQ ID NO: 10343 - DNA, 18 bp, synthetic construct
  misc_feature 1..18: note = Description of Artificial Sequence: Syntheticoligonucleotide
  source 1..18: mol_type = other DNA
ggactcatcgatgagtcc

SEQ ID NO: 10344 - DNA, 18 bp, synthetic construct
  misc_feature 1..18: note = Description of Artificial Sequence: Syntheticoligonucleotide
  source 1..18: mol_type = other DNA
cgactcatcgatgagtcg

SEQ ID NO: 10345 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcggatccgagtcn

SEQ ID NO: 10346 - DNA, 18 bp, synthetic construct
  misc_feature 1..18: note = Description of Artificial Sequence: Syntheticoligonucleotide
  source 1..18: mol_type = other DNA
ggactcggatccgagtcc

SEQ ID NO: 10347 - DNA, 18 bp, synthetic construct
  misc_feature 1..18: note = Description of Artificial Sequence: Syntheticoligonucleotide
  source 1..18: mol_type = other DNA
agactcggatccgagtct

SEQ ID NO: 10348 - DNA, 18 bp, synthetic construct
  misc_feature 1..18: note = Description of Artificial Sequence: Syntheticoligonucleotide
  source 1..18: mol_type = other DNA
tgactcggatccgagtca

SEQ ID NO: 10349 - DNA, 18 bp, synthetic construct
  misc_feature 1..18: note = Description of Artificial Sequence: Syntheticoligonucleotide
  source 1..18: mol_type = other DNA
cgactcggatccgagtcg

SEQ ID NO: 10350 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcccgcgggagtcn

SEQ ID NO: 10351 - DNA, 18 bp, synthetic construct
  misc_feature 1..18: note = Description of Artificial Sequence: Syntheticoligonucleotide
  source 1..18: mol_type = other DNA
ggactcccgcgggagtcc

SEQ ID NO: 10352 - DNA, 18 bp, synthetic construct
  misc_feature 1..18: note = Description of Artificial Sequence: Syntheticoligonucleotide
  source 1..18: mol_type = other DNA
agactcccgcgggagtct

SEQ ID NO: 10353 - DNA, 18 bp, synthetic construct
  misc_feature 1..18: note = Description of Artificial Sequence: Syntheticoligonucleotide
  source 1..18: mol_type = other DNA
tgactcccgcgggagtca

SEQ ID NO: 10354 - DNA, 18 bp, synthetic construct
  misc_feature 1..18: note = Description of Artificial Sequence: Syntheticoligonucleotide
  source 1..18: mol_type = other DNA
cgactcccgcgggagtcg

SEQ ID NO: 10355 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactctgcgcagagtcn

SEQ ID NO: 10356 - DNA, 18 bp, synthetic construct
  misc_feature 1..18: note = Description of Artificial Sequence: Syntheticoligonucleotide
  source 1..18: mol_type = other DNA
ggactctgcgcagagtcc

SEQ ID NO: 10357 - DNA, 18 bp, synthetic construct
  misc_feature 1..18: note = Description of Artificial Sequence: Syntheticoligonucleotide
  source 1..18: mol_type = other DNA
agactctgcgcagagtct

SEQ ID NO: 10358 - DNA, 18 bp, synthetic construct
  misc_feature 1..18: note = Description of Artificial Sequence: Syntheticoligonucleotide
  source 1..18: mol_type = other DNA
tgactctgcgcagagtca

SEQ ID NO: 10359 - DNA, 18 bp, synthetic construct
  misc_feature 1..18: note = Description of Artificial Sequence: Syntheticoligonucleotide
  source 1..18: mol_type = other DNA
cgactctgcgcagagtcg

SEQ ID NO: 10360 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactccggccggagtcn

SEQ ID NO: 10361 - DNA, 18 bp, synthetic construct
  misc_feature 1..18: note = Description of Artificial Sequence: Syntheticoligonucleotide
  source 1..18: mol_type = other DNA
ggactccggccggagtcc

SEQ ID NO: 10362 - DNA, 18 bp, synthetic construct
  misc_feature 1..18: note = Description of Artificial Sequence: Syntheticoligonucleotide
  source 1..18: mol_type = other DNA
agactccggccggagtct

SEQ ID NO: 10363 - DNA, 18 bp, synthetic construct
  misc_feature 1..18: note = Description of Artificial Sequence: Syntheticoligonucleotide
  source 1..18: mol_type = other DNA
tgactccggccggagtca

SEQ ID NO: 10364 - DNA, 18 bp, synthetic construct
  misc_feature 1..18: note = Description of Artificial Sequence: Syntheticoligonucleotide
  source 1..18: mol_type = other DNA
cgactccggccggagtcg

SEQ ID NO: 10365 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactctggccagagtcn

SEQ ID NO: 10366 - DNA, 18 bp, synthetic construct
  misc_feature 1..18: note = Description of Artificial Sequence: Syntheticoligonucleotide
  source 1..18: mol_type = other DNA
ggactctggccagagtcc

SEQ ID NO: 10367 - DNA, 18 bp, synthetic construct
  misc_feature 1..18: note = Description of Artificial Sequence: Syntheticoligonucleotide
  source 1..18: mol_type = other DNA
agactctggccagagtct

SEQ ID NO: 10368 - DNA, 18 bp, synthetic construct
  misc_feature 1..18: note = Description of Artificial Sequence: Syntheticoligonucleotide
  source 1..18: mol_type = other DNA
tgactctggccagagtca

SEQ ID NO: 10369 - DNA, 18 bp, synthetic construct
  misc_feature 1..18: note = Description of Artificial Sequence: Syntheticoligonucleotide
  source 1..18: mol_type = other DNA
cgactctggccagagtcg

SEQ ID NO: 10370 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcaagcttgagtcn

SEQ ID NO: 10371 - DNA, 18 bp, synthetic construct
  misc_feature 1..18: note = Description of Artificial Sequence: Syntheticoligonucleotide
  source 1..18: mol_type = other DNA
ggactcaagcttgagtcc

SEQ ID NO: 10372 - DNA, 18 bp, synthetic construct
  misc_feature 1..18: note = Description of Artificial Sequence: Syntheticoligonucleotide
  source 1..18: mol_type = other DNA
cgactcaagcttgagtcg

SEQ ID NO: 10373 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactctgatcagagtcn

SEQ ID NO: 10374 - DNA, 18 bp, synthetic construct
  misc_feature 1..18: note = Description of Artificial Sequence: Syntheticoligonucleotide
  source 1..18: mol_type = other DNA
ggactctgatcagagtcc

SEQ ID NO: 10375 - DNA, 18 bp, synthetic construct
  misc_feature 1..18: note = Description of Artificial Sequence: Syntheticoligonucleotide
  source 1..18: mol_type = other DNA
cgactctgatcagagtcg

SEQ ID NO: 10376 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactccaattggagtcn

SEQ ID NO: 10377 - DNA, 18 bp, synthetic construct
  misc_feature 1..18: note = Description of Artificial Sequence: Syntheticoligonucleotide
  source 1..18: mol_type = other DNA
ggactccaattggagtcc

SEQ ID NO: 10378 - DNA, 18 bp, synthetic construct
  misc_feature 1..18: note = Description of Artificial Sequence: Syntheticoligonucleotide
  source 1..18: mol_type = other DNA
cgactccaattggagtcg

SEQ ID NO: 10379 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcccatgggagtcn

SEQ ID NO: 10380 - DNA, 18 bp, synthetic construct
  misc_feature 1..18: note = Description of Artificial Sequence: Syntheticoligonucleotide
  source 1..18: mol_type = other DNA
ggactcccatgggagtcc

SEQ ID NO: 10381 - DNA, 18 bp, synthetic construct
  misc_feature 1..18: note = Description of Artificial Sequence: Syntheticoligonucleotide
  source 1..18: mol_type = other DNA
agactcccatgggagtct

SEQ ID NO: 10382 - DNA, 18 bp, synthetic construct
  misc_feature 1..18: note = Description of Artificial Sequence: Syntheticoligonucleotide
  source 1..18: mol_type = other DNA
tgactcccatgggagtca

SEQ ID NO: 10383 - DNA, 18 bp, synthetic construct
  misc_feature 1..18: note = Description of Artificial Sequence: Syntheticoligonucleotide
  source 1..18: mol_type = other DNA
cgactcccatgggagtcg

SEQ ID NO: 10384 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcaggcctgagtcn

SEQ ID NO: 10385 - DNA, 18 bp, synthetic construct
  misc_feature 1..18: note = Description of Artificial Sequence: Syntheticoligonucleotide
  source 1..18: mol_type = other DNA
ggactcaggcctgagtcc

SEQ ID NO: 10386 - DNA, 18 bp, synthetic construct
  misc_feature 1..18: note = Description of Artificial Sequence: Syntheticoligonucleotide
  source 1..18: mol_type = other DNA
agactcaggcctgagtct

SEQ ID NO: 10387 - DNA, 18 bp, synthetic construct
  misc_feature 1..18: note = Description of Artificial Sequence: Syntheticoligonucleotide
  source 1..18: mol_type = other DNA
tgactcaggcctgagtca

SEQ ID NO: 10388 - DNA, 18 bp, synthetic construct
  misc_feature 1..18: note = Description of Artificial Sequence: Syntheticoligonucleotide
  source 1..18: mol_type = other DNA
cgactcaggcctgagtcg

SEQ ID NO: 10389 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcgccggcgagtcn

SEQ ID NO: 10390 - DNA, 18 bp, synthetic construct
  misc_feature 1..18: note = Description of Artificial Sequence: Syntheticoligonucleotide
  source 1..18: mol_type = other DNA
ggactcgccggcgagtcc

SEQ ID NO: 10391 - DNA, 18 bp, synthetic construct
  misc_feature 1..18: note = Description of Artificial Sequence: Syntheticoligonucleotide
  source 1..18: mol_type = other DNA
agactcgccggcgagtct

SEQ ID NO: 10392 - DNA, 18 bp, synthetic construct
  misc_feature 1..18: note = Description of Artificial Sequence: Syntheticoligonucleotide
  source 1..18: mol_type = other DNA
tgactcgccggcgagtca

SEQ ID NO: 10393 - DNA, 18 bp, synthetic construct
  misc_feature 1..18: note = Description of Artificial Sequence: Syntheticoligonucleotide
  source 1..18: mol_type = other DNA
cgactcgccggcgagtcg

SEQ ID NO: 10394 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactccgcgcggagtcn

SEQ ID NO: 10395 - DNA, 18 bp, synthetic construct
  misc_feature 1..18: note = Description of Artificial Sequence: Syntheticoligonucleotide
  source 1..18: mol_type = other DNA
ggactccgcgcggagtcc

SEQ ID NO: 10396 - DNA, 18 bp, synthetic construct
  misc_feature 1..18: note = Description of Artificial Sequence: Syntheticoligonucleotide
  source 1..18: mol_type = other DNA
agactccgcgcggagtct

SEQ ID NO: 10397 - DNA, 18 bp, synthetic construct
  misc_feature 1..18: note = Description of Artificial Sequence: Syntheticoligonucleotide
  source 1..18: mol_type = other DNA
tgactccgcgcggagtca

SEQ ID NO: 10398 - DNA, 18 bp, synthetic construct
  misc_feature 1..18: note = Description of Artificial Sequence: Syntheticoligonucleotide
  source 1..18: mol_type = other DNA
cgactccgcgcggagtcg

SEQ ID NO: 10399 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcgcgcgcgagtcn

SEQ ID NO: 10400 - DNA, 18 bp, synthetic construct
  misc_feature 1..18: note = Description of Artificial Sequence: Syntheticoligonucleotide
  source 1..18: mol_type = other DNA
ggactcgcgcgcgagtcc

SEQ ID NO: 10401 - DNA, 18 bp, synthetic construct
  misc_feature 1..18: note = Description of Artificial Sequence: Syntheticoligonucleotide
  source 1..18: mol_type = other DNA
agactcgcgcgcgagtct

SEQ ID NO: 10402 - DNA, 18 bp, synthetic construct
  misc_feature 1..18: note = Description of Artificial Sequence: Syntheticoligonucleotide
  source 1..18: mol_type = other DNA
tgactcgcgcgcgagtca

SEQ ID NO: 10403 - DNA, 18 bp, synthetic construct
  misc_feature 1..18: note = Description of Artificial Sequence: Syntheticoligonucleotide
  source 1..18: mol_type = other DNA
cgactcgcgcgcgagtcg

SEQ ID NO: 10404 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactctcatgagagtcn

SEQ ID NO: 10405 - DNA, 18 bp, synthetic construct
  misc_feature 1..18: note = Description of Artificial Sequence: Syntheticoligonucleotide
  source 1..18: mol_type = other DNA
ggactctcatgagagtcc

SEQ ID NO: 10406 - DNA, 18 bp, synthetic construct
  misc_feature 1..18: note = Description of Artificial Sequence: Syntheticoligonucleotide
  source 1..18: mol_type = other DNA
cgactctcatgagagtcg

SEQ ID NO: 10407 - DNA, 18 bp, synthetic construct
  misc_feature 1..18: note = Description of Artificial Sequence: Syntheticoligonucleotide
  misc_difference 1: note = a, c, t, or g
  misc_difference 18: note = a, c, t, or g
  source 1..18: mol_type = other DNA
ngactcttcgaagagtcn

SEQ ID NO: 10408 - DNA, 18 bp, synthetic construct
  misc_feature 1..18: note = Description of Artificial Sequence: Syntheticoligonucleotide
  source 1..18: mol_type = other DNA
ggactcttcgaagagtcc

SEQ ID NO: 10409 - DNA, 18 bp, synthetic construct
  misc_feature 1..18: note = Description of Artificial Sequence: Syntheticoligonucleotide
  source 1..18: mol_type = other DNA
cgactcttcgaagagtcg

SEQ ID NO: 10410 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactccgcggagtcnnnn

SEQ ID NO: 10411 - DNA, 22 bp, synthetic construct
  misc_feature 1..22: note = Description of Artificial Sequence: Syntheticoligonucleotide
  source 1..22: mol_type = other DNA
ggcggactccgcggagtccgcc

SEQ ID NO: 10412 - DNA, 22 bp, synthetic construct
  misc_feature 1..22: note = Description of Artificial Sequence: Syntheticoligonucleotide
  source 1..22: mol_type = other DNA
agcggactccgcggagtccgct

SEQ ID NO: 10413 - DNA, 22 bp, synthetic construct
  misc_feature 1..22: note = Description of Artificial Sequence: Syntheticoligonucleotide
  source 1..22: mol_type = other DNA
gacggactccgcggagtccgtc

SEQ ID NO: 10414 - DNA, 22 bp, synthetic construct
  misc_feature 1..22: note = Description of Artificial Sequence: Syntheticoligonucleotide
  source 1..22: mol_type = other DNA
ggaggactccgcggagtcctcc

SEQ ID NO: 10415 - DNA, 22 bp, synthetic construct
  misc_feature 1..22: note = Description of Artificial Sequence: Syntheticoligonucleotide
  source 1..22: mol_type = other DNA
ggcagactccgcggagtctgcc

SEQ ID NO: 10416 - DNA, 22 bp, synthetic construct
  misc_feature 1..22: note = Description of Artificial Sequence: Syntheticoligonucleotide
  source 1..22: mol_type = other DNA
tgcggactccgcggagtccgca

SEQ ID NO: 10417 - DNA, 22 bp, synthetic construct
  misc_feature 1..22: note = Description of Artificial Sequence: Syntheticoligonucleotide
  source 1..22: mol_type = other DNA
gtcggactccgcggagtccgac

SEQ ID NO: 10418 - DNA, 22 bp, synthetic construct
  misc_feature 1..22: note = Description of Artificial Sequence: Syntheticoligonucleotide
  source 1..22: mol_type = other DNA
ggtggactccgcggagtccacc

SEQ ID NO: 10419 - DNA, 22 bp, synthetic construct
  misc_feature 1..22: note = Description of Artificial Sequence: Syntheticoligonucleotide
  source 1..22: mol_type = other DNA
ggctgactccgcggagtcagcc

SEQ ID NO: 10420 - DNA, 22 bp, synthetic construct
  misc_feature 1..22: note = Description of Artificial Sequence: Syntheticoligonucleotide
  source 1..22: mol_type = other DNA
gcccgactccgcggagtcgggc

SEQ ID NO: 10421 - DNA, 22 bp, synthetic construct
  misc_feature 1..22: note = Description of Artificial Sequence: Syntheticoligonucleotide
  source 1..22: mol_type = other DNA
acccgactccgcggagtcgggt

SEQ ID NO: 10422 - DNA, 22 bp, synthetic construct
  misc_feature 1..22: note = Description of Artificial Sequence: Syntheticoligonucleotide
  source 1..22: mol_type = other DNA
gaccgactccgcggagtcggtc

SEQ ID NO: 10423 - DNA, 22 bp, synthetic construct
  misc_feature 1..22: note = Description of Artificial Sequence: Syntheticoligonucleotide
  source 1..22: mol_type = other DNA
gcacgactccgcggagtcgtgc

SEQ ID NO: 10424 - DNA, 22 bp, synthetic construct
  misc_feature 1..22: note = Description of Artificial Sequence: Syntheticoligonucleotide
  source 1..22: mol_type = other DNA
gccagactccgcggagtctggc

SEQ ID NO: 10425 - DNA, 22 bp, synthetic construct
  misc_feature 1..22: note = Description of Artificial Sequence: Syntheticoligonucleotide
  source 1..22: mol_type = other DNA
tcccgactccgcggagtcggga

SEQ ID NO: 10426 - DNA, 22 bp, synthetic construct
  misc_feature 1..22: note = Description of Artificial Sequence: Syntheticoligonucleotide
  source 1..22: mol_type = other DNA
gtccgactccgcggagtcggac

SEQ ID NO: 10427 - DNA, 22 bp, synthetic construct
  misc_feature 1..22: note = Description of Artificial Sequence: Syntheticoligonucleotide
  source 1..22: mol_type = other DNA
gcctgactccgcggagtcaggc

SEQ ID NO: 10428 - DNA, 22 bp, synthetic construct
  misc_feature 1..22: note = Description of Artificial Sequence: Syntheticoligonucleotide
  source 1..22: mol_type = other DNA
gggcgactccgcggagtcgccc

SEQ ID NO: 10429 - DNA, 22 bp, synthetic construct
  misc_feature 1..22: note = Description of Artificial Sequence: Syntheticoligonucleotide
  source 1..22: mol_type = other DNA
aggcgactccgcggagtcgcct

SEQ ID NO: 10430 - DNA, 22 bp, synthetic construct
  misc_feature 1..22: note = Description of Artificial Sequence: Syntheticoligonucleotide
  source 1..22: mol_type = other DNA
gagcgactccgcggagtcgctc

SEQ ID NO: 10431 - DNA, 22 bp, synthetic construct
  misc_feature 1..22: note = Description of Artificial Sequence: Syntheticoligonucleotide
  source 1..22: mol_type = other DNA
ggacgactccgcggagtcgtcc

SEQ ID NO: 10432 - DNA, 22 bp, synthetic construct
  misc_feature 1..22: note = Description of Artificial Sequence: Syntheticoligonucleotide
  source 1..22: mol_type = other DNA
gggagactccgcggagtctccc

SEQ ID NO: 10433 - DNA, 22 bp, synthetic construct
  misc_feature 1..22: note = Description of Artificial Sequence: Syntheticoligonucleotide
  source 1..22: mol_type = other DNA
tggcgactccgcggagtcgcca

SEQ ID NO: 10434 - DNA, 22 bp, synthetic construct
  misc_feature 1..22: note = Description of Artificial Sequence: Syntheticoligonucleotide
  source 1..22: mol_type = other DNA
gtgcgactccgcggagtcgcac

SEQ ID NO: 10435 - DNA, 22 bp, synthetic construct
  misc_feature 1..22: note = Description of Artificial Sequence: Syntheticoligonucleotide
  source 1..22: mol_type = other DNA
gggtgactccgcggagtcaccc

SEQ ID NO: 10436 - DNA, 22 bp, synthetic construct
  misc_feature 1..22: note = Description of Artificial Sequence: Syntheticoligonucleotide
  source 1..22: mol_type = other DNA
acgggactccgcggagtcccgt

SEQ ID NO: 10437 - DNA, 22 bp, synthetic construct
  misc_feature 1..22: note = Description of Artificial Sequence: Syntheticoligonucleotide
  source 1..22: mol_type = other DNA
cagggactccgcggagtccctg

SEQ ID NO: 10438 - DNA, 22 bp, synthetic construct
  misc_feature 1..22: note = Description of Artificial Sequence: Syntheticoligonucleotide
  source 1..22: mol_type = other DNA
ccaggactccgcggagtcctgg

SEQ ID NO: 10439 - DNA, 22 bp, synthetic construct
  misc_feature 1..22: note = Description of Artificial Sequence: Syntheticoligonucleotide
  source 1..22: mol_type = other DNA
ccgagactccgcggagtctcgg

SEQ ID NO: 10440 - DNA, 22 bp, synthetic construct
  misc_feature 1..22: note = Description of Artificial Sequence: Syntheticoligonucleotide
  source 1..22: mol_type = other DNA
tcgggactccgcggagtcccga

SEQ ID NO: 10441 - DNA, 22 bp, synthetic construct
  misc_feature 1..22: note = Description of Artificial Sequence: Syntheticoligonucleotide
  source 1..22: mol_type = other DNA
ctgggactccgcggagtcccag

SEQ ID NO: 10442 - DNA, 22 bp, synthetic construct
  misc_feature 1..22: note = Description of Artificial Sequence: Syntheticoligonucleotide
  source 1..22: mol_type = other DNA
cctggactccgcggagtccagg

SEQ ID NO: 10443 - DNA, 22 bp, synthetic construct
  misc_feature 1..22: note = Description of Artificial Sequence: Syntheticoligonucleotide
  source 1..22: mol_type = other DNA
ccgtgactccgcggagtcacgg

SEQ ID NO: 10444 - DNA, 22 bp, synthetic construct
  misc_feature 1..22: note = Description of Artificial Sequence: Syntheticoligonucleotide
  source 1..22: mol_type = other DNA
cggcgactccgcggagtcgccg

SEQ ID NO: 10445 - DNA, 22 bp, synthetic construct
  misc_feature 1..22: note = Description of Artificial Sequence: Syntheticoligonucleotide
  source 1..22: mol_type = other DNA
cagcgactccgcggagtcgctg

SEQ ID NO: 10446 - DNA, 22 bp, synthetic construct
  misc_feature 1..22: note = Description of Artificial Sequence: Syntheticoligonucleotide
  source 1..22: mol_type = other DNA
cgacgactccgcggagtcgtcg

SEQ ID NO: 10447 - DNA, 22 bp, synthetic construct
  misc_feature 1..22: note = Description of Artificial Sequence: Syntheticoligonucleotide
  source 1..22: mol_type = other DNA
cggagactccgcggagtctccg

SEQ ID NO: 10448 - DNA, 22 bp, synthetic construct
  misc_feature 1..22: note = Description of Artificial Sequence: Syntheticoligonucleotide
  source 1..22: mol_type = other DNA
ctgcgactccgcggagtcgcag

SEQ ID NO: 10449 - DNA, 22 bp, synthetic construct
  misc_feature 1..22: note = Description of Artificial Sequence: Syntheticoligonucleotide
  source 1..22: mol_type = other DNA
cggtgactccgcggagtcaccg

SEQ ID NO: 10450 - DNA, 22 bp, synthetic construct
  misc_feature 1..22: note = Description of Artificial Sequence: Syntheticoligonucleotide
  source 1..22: mol_type = other DNA
cacggactccgcggagtccgtg

SEQ ID NO: 10451 - DNA, 22 bp, synthetic construct
  misc_feature 1..22: note = Description of Artificial Sequence: Syntheticoligonucleotide
  source 1..22: mol_type = other DNA
cccagactccgcggagtctggg

SEQ ID NO: 10452 - DNA, 22 bp, synthetic construct
  misc_feature 1..22: note = Description of Artificial Sequence: Syntheticoligonucleotide
  source 1..22: mol_type = other DNA
ctcggactccgcggagtccgag

SEQ ID NO: 10453 - DNA, 22 bp, synthetic construct
  misc_feature 1..22: note = Description of Artificial Sequence: Syntheticoligonucleotide
  source 1..22: mol_type = other DNA
ccctgactccgcggagtcaggg

SEQ ID NO: 10454 - DNA, 22 bp, synthetic construct
  misc_feature 1..22: note = Description of Artificial Sequence: Syntheticoligonucleotide
  source 1..22: mol_type = other DNA
ccacgactccgcggagtcgtgg

SEQ ID NO: 10455 - DNA, 22 bp, synthetic construct
  misc_feature 1..22: note = Description of Artificial Sequence: Syntheticoligonucleotide
  source 1..22: mol_type = other DNA
agccgactccgcggagtcggct

SEQ ID NO: 10456 - DNA, 22 bp, synthetic construct
  misc_feature 1..22: note = Description of Artificial Sequence: Syntheticoligonucleotide
  source 1..22: mol_type = other DNA
tgccgactccgcggagtcggca

SEQ ID NO: 10457 - DNA, 22 bp, synthetic construct
  misc_feature 1..22: note = Description of Artificial Sequence: Syntheticoligonucleotide
  source 1..22: mol_type = other DNA
gcgagactccgcggagtctcgc

SEQ ID NO: 10458 - DNA, 22 bp, synthetic construct
  misc_feature 1..22: note = Description of Artificial Sequence: Syntheticoligonucleotide
  source 1..22: mol_type = other DNA
gcgtgactccgcggagtcacgc

SEQ ID NO: 10459 - DNA, 22 bp, synthetic construct
  misc_feature 1..22: note = Description of Artificial Sequence: Syntheticoligonucleotide
  source 1..22: mol_type = other DNA
gcaggactccgcggagtcctgc

SEQ ID NO: 10460 - DNA, 22 bp, synthetic construct
  misc_feature 1..22: note = Description of Artificial Sequence: Syntheticoligonucleotide
  source 1..22: mol_type = other DNA
gctggactccgcggagtccagc

SEQ ID NO: 10461 - DNA, 22 bp, synthetic construct
  misc_feature 1..22: note = Description of Artificial Sequence: Syntheticoligonucleotide
  source 1..22: mol_type = other DNA
cgaggactccgcggagtcctcg

SEQ ID NO: 10462 - DNA, 22 bp, synthetic construct
  misc_feature 1..22: note = Description of Artificial Sequence: Syntheticoligonucleotide
  source 1..22: mol_type = other DNA
cgtggactccgcggagtccacg

SEQ ID NO: 10463 - DNA, 22 bp, synthetic construct
  misc_feature 1..22: note = Description of Artificial Sequence: Syntheticoligonucleotide
  source 1..22: mol_type = other DNA
caccgactccgcggagtcggtg

SEQ ID NO: 10464 - DNA, 22 bp, synthetic construct
  misc_feature 1..22: note = Description of Artificial Sequence: Syntheticoligonucleotide
  source 1..22: mol_type = other DNA
ctccgactccgcggagtcggag

SEQ ID NO: 10465 - DNA, 22 bp, synthetic construct
  misc_feature 1..22: note = Description of Artificial Sequence: Syntheticoligonucleotide
  source 1..22: mol_type = other DNA
gcgggactccgcggagtcccgc

SEQ ID NO: 10466 - DNA, 22 bp, synthetic construct
  misc_feature 1..22: note = Description of Artificial Sequence: Syntheticoligonucleotide
  source 1..22: mol_type = other DNA
gagggactccgcggagtccctc

SEQ ID NO: 10467 - DNA, 22 bp, synthetic construct
  misc_feature 1..22: note = Description of Artificial Sequence: Syntheticoligonucleotide
  source 1..22: mol_type = other DNA
gtgggactccgcggagtcccac

SEQ ID NO: 10468 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactctgcagagtcnnnn

SEQ ID NO: 10469 - DNA, 22 bp, synthetic construct
  misc_feature 1..22: note = Description of Artificial Sequence: Syntheticoligonucleotide
  source 1..22: mol_type = other DNA
ggcggactctgcagagtccgcc

SEQ ID NO: 10470 - DNA, 22 bp, synthetic construct
  misc_feature 1..22: note = Description of Artificial Sequence: Syntheticoligonucleotide
  source 1..22: mol_type = other DNA
agcggactctgcagagtccgct

SEQ ID NO: 10471 - DNA, 22 bp, synthetic construct
  misc_feature 1..22: note = Description of Artificial Sequence: Syntheticoligonucleotide
  source 1..22: mol_type = other DNA
gacggactctgcagagtccgtc

SEQ ID NO: 10472 - DNA, 22 bp, synthetic construct
  misc_feature 1..22: note = Description of Artificial Sequence: Syntheticoligonucleotide
  source 1..22: mol_type = other DNA
ggaggactctgcagagtcctcc

SEQ ID NO: 10473 - DNA, 22 bp, synthetic construct
  misc_feature 1..22: note = Description of Artificial Sequence: Syntheticoligonucleotide
  source 1..22: mol_type = other DNA
ggcagactctgcagagtctgcc

SEQ ID NO: 10474 - DNA, 22 bp, synthetic construct
  misc_feature 1..22: note = Description of Artificial Sequence: Syntheticoligonucleotide
  source 1..22: mol_type = other DNA
tgcggactctgcagagtccgca

SEQ ID NO: 10475 - DNA, 22 bp, synthetic construct
  misc_feature 1..22: note = Description of Artificial Sequence: Syntheticoligonucleotide
  source 1..22: mol_type = other DNA
gtcggactctgcagagtccgac

SEQ ID NO: 10476 - DNA, 22 bp, synthetic construct
  misc_feature 1..22: note = Description of Artificial Sequence: Syntheticoligonucleotide
  source 1..22: mol_type = other DNA
ggtggactctgcagagtccacc

SEQ ID NO: 10477 - DNA, 22 bp, synthetic construct
  misc_feature 1..22: note = Description of Artificial Sequence: Syntheticoligonucleotide
  source 1..22: mol_type = other DNA
ggctgactctgcagagtcagcc

SEQ ID NO: 10478 - DNA, 22 bp, synthetic construct
  misc_feature 1..22: note = Description of Artificial Sequence: Syntheticoligonucleotide
  source 1..22: mol_type = other DNA
gcccgactctgcagagtcgggc

SEQ ID NO: 10479 - DNA, 22 bp, synthetic construct
  misc_feature 1..22: note = Description of Artificial Sequence: Syntheticoligonucleotide
  source 1..22: mol_type = other DNA
acccgactctgcagagtcgggt

SEQ ID NO: 10480 - DNA, 22 bp, synthetic construct
  misc_feature 1..22: note = Description of Artificial Sequence: Syntheticoligonucleotide
  source 1..22: mol_type = other DNA
gaccgactctgcagagtcggtc

SEQ ID NO: 10481 - DNA, 22 bp, synthetic construct
  misc_feature 1..22: note = Description of Artificial Sequence: Syntheticoligonucleotide
  source 1..22: mol_type = other DNA
gcacgactctgcagagtcgtgc

SEQ ID NO: 10482 - DNA, 22 bp, synthetic construct
  misc_feature 1..22: note = Description of Artificial Sequence: Syntheticoligonucleotide
  source 1..22: mol_type = other DNA
gccagactctgcagagtctggc

SEQ ID NO: 10483 - DNA, 22 bp, synthetic construct
  misc_feature 1..22: note = Description of Artificial Sequence: Syntheticoligonucleotide
  source 1..22: mol_type = other DNA
tcccgactctgcagagtcggga

SEQ ID NO: 10484 - DNA, 22 bp, synthetic construct
  misc_feature 1..22: note = Description of Artificial Sequence: Syntheticoligonucleotide
  source 1..22: mol_type = other DNA
gtccgactctgcagagtcggac

SEQ ID NO: 10485 - DNA, 22 bp, synthetic construct
  misc_feature 1..22: note = Description of Artificial Sequence: Syntheticoligonucleotide
  source 1..22: mol_type = other DNA
gcctgactctgcagagtcaggc

SEQ ID NO: 10486 - DNA, 22 bp, synthetic construct
  misc_feature 1..22: note = Description of Artificial Sequence: Syntheticoligonucleotide
  source 1..22: mol_type = other DNA
gggcgactctgcagagtcgccc

SEQ ID NO: 10487 - DNA, 22 bp, synthetic construct
  misc_feature 1..22: note = Description of Artificial Sequence: Syntheticoligonucleotide
  source 1..22: mol_type = other DNA
aggcgactctgcagagtcgcct

SEQ ID NO: 10488 - DNA, 22 bp, synthetic construct
  misc_feature 1..22: note = Description of Artificial Sequence: Syntheticoligonucleotide
  source 1..22: mol_type = other DNA
gagcgactctgcagagtcgctc

SEQ ID NO: 10489 - DNA, 22 bp, synthetic construct
  misc_feature 1..22: note = Description of Artificial Sequence: Syntheticoligonucleotide
  source 1..22: mol_type = other DNA
ggacgactctgcagagtcgtcc

SEQ ID NO: 10490 - DNA, 22 bp, synthetic construct
  misc_feature 1..22: note = Description of Artificial Sequence: Syntheticoligonucleotide
  source 1..22: mol_type = other DNA
gggagactctgcagagtctccc

SEQ ID NO: 10491 - DNA, 22 bp, synthetic construct
  misc_feature 1..22: note = Description of Artificial Sequence: Syntheticoligonucleotide
  source 1..22: mol_type = other DNA
tggcgactctgcagagtcgcca

SEQ ID NO: 10492 - DNA, 22 bp, synthetic construct
  misc_feature 1..22: note = Description of Artificial Sequence: Syntheticoligonucleotide
  source 1..22: mol_type = other DNA
gtgcgactctgcagagtcgcac

SEQ ID NO: 10493 - DNA, 22 bp, synthetic construct
  misc_feature 1..22: note = Description of Artificial Sequence: Syntheticoligonucleotide
  source 1..22: mol_type = other DNA
gggtgactctgcagagtcaccc

SEQ ID NO: 10494 - DNA, 22 bp, synthetic construct
  misc_feature 1..22: note = Description of Artificial Sequence: Syntheticoligonucleotide
  source 1..22: mol_type = other DNA
acgggactctgcagagtcccgt

SEQ ID NO: 10495 - DNA, 22 bp, synthetic construct
  misc_feature 1..22: note = Description of Artificial Sequence: Syntheticoligonucleotide
  source 1..22: mol_type = other DNA
cagggactctgcagagtccctg

SEQ ID NO: 10496 - DNA, 22 bp, synthetic construct
  misc_feature 1..22: note = Description of Artificial Sequence: Syntheticoligonucleotide
  source 1..22: mol_type = other DNA
ccaggactctgcagagtcctgg

SEQ ID NO: 10497 - DNA, 22 bp, synthetic construct
  misc_feature 1..22: note = Description of Artificial Sequence: Syntheticoligonucleotide
  source 1..22: mol_type = other DNA
ccgagactctgcagagtctcgg

SEQ ID NO: 10498 - DNA, 22 bp, synthetic construct
  misc_feature 1..22: note = Description of Artificial Sequence: Syntheticoligonucleotide
  source 1..22: mol_type = other DNA
tcgggactctgcagagtcccga

SEQ ID NO: 10499 - DNA, 22 bp, synthetic construct
  misc_feature 1..22: note = Description of Artificial Sequence: Syntheticoligonucleotide
  source 1..22: mol_type = other DNA
ctgggactctgcagagtcccag

SEQ ID NO: 10500 - DNA, 22 bp, synthetic construct
  misc_feature 1..22: note = Description of Artificial Sequence: Syntheticoligonucleotide
  source 1..22: mol_type = other DNA
cctggactctgcagagtccagg

SEQ ID NO: 10501 - DNA, 22 bp, synthetic construct
  misc_feature 1..22: note = Description of Artificial Sequence: Syntheticoligonucleotide
  source 1..22: mol_type = other DNA
ccgtgactctgcagagtcacgg

SEQ ID NO: 10502 - DNA, 22 bp, synthetic construct
  misc_feature 1..22: note = Description of Artificial Sequence: Syntheticoligonucleotide
  source 1..22: mol_type = other DNA
cggcgactctgcagagtcgccg

SEQ ID NO: 10503 - DNA, 22 bp, synthetic construct
  misc_feature 1..22: note = Description of Artificial Sequence: Syntheticoligonucleotide
  source 1..22: mol_type = other DNA
cagcgactctgcagagtcgctg

SEQ ID NO: 10504 - DNA, 22 bp, synthetic construct
  misc_feature 1..22: note = Description of Artificial Sequence: Syntheticoligonucleotide
  source 1..22: mol_type = other DNA
cgacgactctgcagagtcgtcg

SEQ ID NO: 10505 - DNA, 22 bp, synthetic construct
  misc_feature 1..22: note = Description of Artificial Sequence: Syntheticoligonucleotide
  source 1..22: mol_type = other DNA
cggagactctgcagagtctccg

SEQ ID NO: 10506 - DNA, 22 bp, synthetic construct
  misc_feature 1..22: note = Description of Artificial Sequence: Syntheticoligonucleotide
  source 1..22: mol_type = other DNA
ctgcgactctgcagagtcgcag

SEQ ID NO: 10507 - DNA, 22 bp, synthetic construct
  misc_feature 1..22: note = Description of Artificial Sequence: Syntheticoligonucleotide
  source 1..22: mol_type = other DNA
cggtgactctgcagagtcaccg

SEQ ID NO: 10508 - DNA, 22 bp, synthetic construct
  misc_feature 1..22: note = Description of Artificial Sequence: Syntheticoligonucleotide
  source 1..22: mol_type = other DNA
cacggactctgcagagtccgtg

SEQ ID NO: 10509 - DNA, 22 bp, synthetic construct
  misc_feature 1..22: note = Description of Artificial Sequence: Syntheticoligonucleotide
  source 1..22: mol_type = other DNA
cccagactctgcagagtctggg

SEQ ID NO: 10510 - DNA, 22 bp, synthetic construct
  misc_feature 1..22: note = Description of Artificial Sequence: Syntheticoligonucleotide
  source 1..22: mol_type = other DNA
ctcggactctgcagagtccgag

SEQ ID NO: 10511 - DNA, 22 bp, synthetic construct
  misc_feature 1..22: note = Description of Artificial Sequence: Syntheticoligonucleotide
  source 1..22: mol_type = other DNA
ccctgactctgcagagtcaggg

SEQ ID NO: 10512 - DNA, 22 bp, synthetic construct
  misc_feature 1..22: note = Description of Artificial Sequence: Syntheticoligonucleotide
  source 1..22: mol_type = other DNA
ccacgactctgcagagtcgtgg

SEQ ID NO: 10513 - DNA, 22 bp, synthetic construct
  misc_feature 1..22: note = Description of Artificial Sequence: Syntheticoligonucleotide
  source 1..22: mol_type = other DNA
agccgactctgcagagtcggct

SEQ ID NO: 10514 - DNA, 22 bp, synthetic construct
  misc_feature 1..22: note = Description of Artificial Sequence: Syntheticoligonucleotide
  source 1..22: mol_type = other DNA
tgccgactctgcagagtcggca

SEQ ID NO: 10515 - DNA, 22 bp, synthetic construct
  misc_feature 1..22: note = Description of Artificial Sequence: Syntheticoligonucleotide
  source 1..22: mol_type = other DNA
gcgagactctgcagagtctcgc

SEQ ID NO: 10516 - DNA, 22 bp, synthetic construct
  misc_feature 1..22: note = Description of Artificial Sequence: Syntheticoligonucleotide
  source 1..22: mol_type = other DNA
gcgtgactctgcagagtcacgc

SEQ ID NO: 10517 - DNA, 22 bp, synthetic construct
  misc_feature 1..22: note = Description of Artificial Sequence: Syntheticoligonucleotide
  source 1..22: mol_type = other DNA
gcaggactctgcagagtcctgc

SEQ ID NO: 10518 - DNA, 22 bp, synthetic construct
  misc_feature 1..22: note = Description of Artificial Sequence: Syntheticoligonucleotide
  source 1..22: mol_type = other DNA
gctggactctgcagagtccagc

SEQ ID NO: 10519 - DNA, 22 bp, synthetic construct
  misc_feature 1..22: note = Description of Artificial Sequence: Syntheticoligonucleotide
  source 1..22: mol_type = other DNA
cgaggactctgcagagtcctcg

SEQ ID NO: 10520 - DNA, 22 bp, synthetic construct
  misc_feature 1..22: note = Description of Artificial Sequence: Syntheticoligonucleotide
  source 1..22: mol_type = other DNA
cgtggactctgcagagtccacg

SEQ ID NO: 10521 - DNA, 22 bp, synthetic construct
  misc_feature 1..22: note = Description of Artificial Sequence: Syntheticoligonucleotide
  source 1..22: mol_type = other DNA
caccgactctgcagagtcggtg

SEQ ID NO: 10522 - DNA, 22 bp, synthetic construct
  misc_feature 1..22: note = Description of Artificial Sequence: Syntheticoligonucleotide
  source 1..22: mol_type = other DNA
ctccgactctgcagagtcggag

SEQ ID NO: 10523 - DNA, 22 bp, synthetic construct
  misc_feature 1..22: note = Description of Artificial Sequence: Syntheticoligonucleotide
  source 1..22: mol_type = other DNA
gcgggactctgcagagtcccgc

SEQ ID NO: 10524 - DNA, 22 bp, synthetic construct
  misc_feature 1..22: note = Description of Artificial Sequence: Syntheticoligonucleotide
  source 1..22: mol_type = other DNA
gagggactctgcagagtccctc

SEQ ID NO: 10525 - DNA, 22 bp, synthetic construct
  misc_feature 1..22: note = Description of Artificial Sequence: Syntheticoligonucleotide
  source 1..22: mol_type = other DNA
gtgggactctgcagagtcccac

SEQ ID NO: 10526 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactcgcgcgagtcnnnn

SEQ ID NO: 10527 - DNA, 22 bp, synthetic construct
  misc_feature 1..22: note = Description of Artificial Sequence: Syntheticoligonucleotide
  source 1..22: mol_type = other DNA
ggcggactcgcgcgagtccgcc

SEQ ID NO: 10528 - DNA, 22 bp, synthetic construct
  misc_feature 1..22: note = Description of Artificial Sequence: Syntheticoligonucleotide
  source 1..22: mol_type = other DNA
agcggactcgcgcgagtccgct

SEQ ID NO: 10529 - DNA, 22 bp, synthetic construct
  misc_feature 1..22: note = Description of Artificial Sequence: Syntheticoligonucleotide
  source 1..22: mol_type = other DNA
gacggactcgcgcgagtccgtc

SEQ ID NO: 10530 - DNA, 22 bp, synthetic construct
  misc_feature 1..22: note = Description of Artificial Sequence: Syntheticoligonucleotide
  source 1..22: mol_type = other DNA
ggaggactcgcgcgagtcctcc

SEQ ID NO: 10531 - DNA, 22 bp, synthetic construct
  misc_feature 1..22: note = Description of Artificial Sequence: Syntheticoligonucleotide
  source 1..22: mol_type = other DNA
ggcagactcgcgcgagtctgcc

SEQ ID NO: 10532 - DNA, 22 bp, synthetic construct
  misc_feature 1..22: note = Description of Artificial Sequence: Syntheticoligonucleotide
  source 1..22: mol_type = other DNA
tgcggactcgcgcgagtccgca

SEQ ID NO: 10533 - DNA, 22 bp, synthetic construct
  misc_feature 1..22: note = Description of Artificial Sequence: Syntheticoligonucleotide
  source 1..22: mol_type = other DNA
gtcggactcgcgcgagtccgac

SEQ ID NO: 10534 - DNA, 22 bp, synthetic construct
  misc_feature 1..22: note = Description of Artificial Sequence: Syntheticoligonucleotide
  source 1..22: mol_type = other DNA
ggtggactcgcgcgagtccacc

SEQ ID NO: 10535 - DNA, 22 bp, synthetic construct
  misc_feature 1..22: note = Description of Artificial Sequence: Syntheticoligonucleotide
  source 1..22: mol_type = other DNA
ggctgactcgcgcgagtcagcc

SEQ ID NO: 10536 - DNA, 22 bp, synthetic construct
  misc_feature 1..22: note = Description of Artificial Sequence: Syntheticoligonucleotide
  source 1..22: mol_type = other DNA
gcccgactcgcgcgagtcgggc

SEQ ID NO: 10537 - DNA, 22 bp, synthetic construct
  misc_feature 1..22: note = Description of Artificial Sequence: Syntheticoligonucleotide
  source 1..22: mol_type = other DNA
acccgactcgcgcgagtcgggt

SEQ ID NO: 10538 - DNA, 22 bp, synthetic construct
  misc_feature 1..22: note = Description of Artificial Sequence: Syntheticoligonucleotide
  source 1..22: mol_type = other DNA
gaccgactcgcgcgagtcggtc

SEQ ID NO: 10539 - DNA, 22 bp, synthetic construct
  misc_feature 1..22: note = Description of Artificial Sequence: Syntheticoligonucleotide
  source 1..22: mol_type = other DNA
gcacgactcgcgcgagtcgtgc

SEQ ID NO: 10540 - DNA, 22 bp, synthetic construct
  misc_feature 1..22: note = Description of Artificial Sequence: Syntheticoligonucleotide
  source 1..22: mol_type = other DNA
gccagactcgcgcgagtctggc

SEQ ID NO: 10541 - DNA, 22 bp, synthetic construct
  misc_feature 1..22: note = Description of Artificial Sequence: Syntheticoligonucleotide
  source 1..22: mol_type = other DNA
tcccgactcgcgcgagtcggga

SEQ ID NO: 10542 - DNA, 22 bp, synthetic construct
  misc_feature 1..22: note = Description of Artificial Sequence: Syntheticoligonucleotide
  source 1..22: mol_type = other DNA
gtccgactcgcgcgagtcggac

SEQ ID NO: 10543 - DNA, 22 bp, synthetic construct
  misc_feature 1..22: note = Description of Artificial Sequence: Syntheticoligonucleotide
  source 1..22: mol_type = other DNA
gcctgactcgcgcgagtcaggc

SEQ ID NO: 10544 - DNA, 22 bp, synthetic construct
  misc_feature 1..22: note = Description of Artificial Sequence: Syntheticoligonucleotide
  source 1..22: mol_type = other DNA
gggcgactcgcgcgagtcgccc

SEQ ID NO: 10545 - DNA, 22 bp, synthetic construct
  misc_feature 1..22: note = Description of Artificial Sequence: Syntheticoligonucleotide
  source 1..22: mol_type = other DNA
aggcgactcgcgcgagtcgcct

SEQ ID NO: 10546 - DNA, 22 bp, synthetic construct
  misc_feature 1..22: note = Description of Artificial Sequence: Syntheticoligonucleotide
  source 1..22: mol_type = other DNA
gagcgactcgcgcgagtcgctc

SEQ ID NO: 10547 - DNA, 22 bp, synthetic construct
  misc_feature 1..22: note = Description of Artificial Sequence: Syntheticoligonucleotide
  source 1..22: mol_type = other DNA
ggacgactcgcgcgagtcgtcc

SEQ ID NO: 10548 - DNA, 22 bp, synthetic construct
  misc_feature 1..22: note = Description of Artificial Sequence: Syntheticoligonucleotide
  source 1..22: mol_type = other DNA
gggagactcgcgcgagtctccc

SEQ ID NO: 10549 - DNA, 22 bp, synthetic construct
  misc_feature 1..22: note = Description of Artificial Sequence: Syntheticoligonucleotide
  source 1..22: mol_type = other DNA
tggcgactcgcgcgagtcgcca

SEQ ID NO: 10550 - DNA, 22 bp, synthetic construct
  misc_feature 1..22: note = Description of Artificial Sequence: Syntheticoligonucleotide
  source 1..22: mol_type = other DNA
gtgcgactcgcgcgagtcgcac

SEQ ID NO: 10551 - DNA, 22 bp, synthetic construct
  misc_feature 1..22: note = Description of Artificial Sequence: Syntheticoligonucleotide
  source 1..22: mol_type = other DNA
gggtgactcgcgcgagtcaccc

SEQ ID NO: 10552 - DNA, 22 bp, synthetic construct
  misc_feature 1..22: note = Description of Artificial Sequence: Syntheticoligonucleotide
  source 1..22: mol_type = other DNA
acgggactcgcgcgagtcccgt

SEQ ID NO: 10553 - DNA, 22 bp, synthetic construct
  misc_feature 1..22: note = Description of Artificial Sequence: Syntheticoligonucleotide
  source 1..22: mol_type = other DNA
cagggactcgcgcgagtccctg

SEQ ID NO: 10554 - DNA, 22 bp, synthetic construct
  misc_feature 1..22: note = Description of Artificial Sequence: Syntheticoligonucleotide
  source 1..22: mol_type = other DNA
ccaggactcgcgcgagtcctgg

SEQ ID NO: 10555 - DNA, 22 bp, synthetic construct
  misc_feature 1..22: note = Description of Artificial Sequence: Syntheticoligonucleotide
  source 1..22: mol_type = other DNA
ccgagactcgcgcgagtctcgg

SEQ ID NO: 10556 - DNA, 22 bp, synthetic construct
  misc_feature 1..22: note = Description of Artificial Sequence: Syntheticoligonucleotide
  source 1..22: mol_type = other DNA
tcgggactcgcgcgagtcccga

SEQ ID NO: 10557 - DNA, 22 bp, synthetic construct
  misc_feature 1..22: note = Description of Artificial Sequence: Syntheticoligonucleotide
  source 1..22: mol_type = other DNA
ctgggactcgcgcgagtcccag

SEQ ID NO: 10558 - DNA, 22 bp, synthetic construct
  misc_feature 1..22: note = Description of Artificial Sequence: Syntheticoligonucleotide
  source 1..22: mol_type = other DNA
cctggactcgcgcgagtccagg

SEQ ID NO: 10559 - DNA, 22 bp, synthetic construct
  misc_feature 1..22: note = Description of Artificial Sequence: Syntheticoligonucleotide
  source 1..22: mol_type = other DNA
ccgtgactcgcgcgagtcacgg

SEQ ID NO: 10560 - DNA, 22 bp, synthetic construct
  misc_feature 1..22: note = Description of Artificial Sequence: Syntheticoligonucleotide
  source 1..22: mol_type = other DNA
cggcgactcgcgcgagtcgccg

SEQ ID NO: 10561 - DNA, 22 bp, synthetic construct
  misc_feature 1..22: note = Description of Artificial Sequence: Syntheticoligonucleotide
  source 1..22: mol_type = other DNA
cagcgactcgcgcgagtcgctg

SEQ ID NO: 10562 - DNA, 22 bp, synthetic construct
  misc_feature 1..22: note = Description of Artificial Sequence: Syntheticoligonucleotide
  source 1..22: mol_type = other DNA
cgacgactcgcgcgagtcgtcg

SEQ ID NO: 10563 - DNA, 22 bp, synthetic construct
  misc_feature 1..22: note = Description of Artificial Sequence: Syntheticoligonucleotide
  source 1..22: mol_type = other DNA
cggagactcgcgcgagtctccg

SEQ ID NO: 10564 - DNA, 22 bp, synthetic construct
  misc_feature 1..22: note = Description of Artificial Sequence: Syntheticoligonucleotide
  source 1..22: mol_type = other DNA
ctgcgactcgcgcgagtcgcag

SEQ ID NO: 10565 - DNA, 22 bp, synthetic construct
  misc_feature 1..22: note = Description of Artificial Sequence: Syntheticoligonucleotide
  source 1..22: mol_type = other DNA
cggtgactcgcgcgagtcaccg

SEQ ID NO: 10566 - DNA, 22 bp, synthetic construct
  misc_feature 1..22: note = Description of Artificial Sequence: Syntheticoligonucleotide
  source 1..22: mol_type = other DNA
cacggactcgcgcgagtccgtg

SEQ ID NO: 10567 - DNA, 22 bp, synthetic construct
  misc_feature 1..22: note = Description of Artificial Sequence: Syntheticoligonucleotide
  source 1..22: mol_type = other DNA
cccagactcgcgcgagtctggg

SEQ ID NO: 10568 - DNA, 22 bp, synthetic construct
  misc_feature 1..22: note = Description of Artificial Sequence: Syntheticoligonucleotide
  source 1..22: mol_type = other DNA
ctcggactcgcgcgagtccgag

SEQ ID NO: 10569 - DNA, 22 bp, synthetic construct
  misc_feature 1..22: note = Description of Artificial Sequence: Syntheticoligonucleotide
  source 1..22: mol_type = other DNA
ccctgactcgcgcgagtcaggg

SEQ ID NO: 10570 - DNA, 22 bp, synthetic construct
  misc_feature 1..22: note = Description of Artificial Sequence: Syntheticoligonucleotide
  source 1..22: mol_type = other DNA
ccacgactcgcgcgagtcgtgg

SEQ ID NO: 10571 - DNA, 22 bp, synthetic construct
  misc_feature 1..22: note = Description of Artificial Sequence: Syntheticoligonucleotide
  source 1..22: mol_type = other DNA
agccgactcgcgcgagtcggct

SEQ ID NO: 10572 - DNA, 22 bp, synthetic construct
  misc_feature 1..22: note = Description of Artificial Sequence: Syntheticoligonucleotide
  source 1..22: mol_type = other DNA
tgccgactcgcgcgagtcggca

SEQ ID NO: 10573 - DNA, 22 bp, synthetic construct
  misc_feature 1..22: note = Description of Artificial Sequence: Syntheticoligonucleotide
  source 1..22: mol_type = other DNA
gcgagactcgcgcgagtctcgc

SEQ ID NO: 10574 - DNA, 22 bp, synthetic construct
  misc_feature 1..22: note = Description of Artificial Sequence: Syntheticoligonucleotide
  source 1..22: mol_type = other DNA
gcgtgactcgcgcgagtcacgc

SEQ ID NO: 10575 - DNA, 22 bp, synthetic construct
  misc_feature 1..22: note = Description of Artificial Sequence: Syntheticoligonucleotide
  source 1..22: mol_type = other DNA
gcaggactcgcgcgagtcctgc

SEQ ID NO: 10576 - DNA, 22 bp, synthetic construct
  misc_feature 1..22: note = Description of Artificial Sequence: Syntheticoligonucleotide
  source 1..22: mol_type = other DNA
gctggactcgcgcgagtccagc

SEQ ID NO: 10577 - DNA, 22 bp, synthetic construct
  misc_feature 1..22: note = Description of Artificial Sequence: Syntheticoligonucleotide
  source 1..22: mol_type = other DNA
cgaggactcgcgcgagtcctcg

SEQ ID NO: 10578 - DNA, 22 bp, synthetic construct
  misc_feature 1..22: note = Description of Artificial Sequence: Syntheticoligonucleotide
  source 1..22: mol_type = other DNA
cgtggactcgcgcgagtccacg

SEQ ID NO: 10579 - DNA, 22 bp, synthetic construct
  misc_feature 1..22: note = Description of Artificial Sequence: Syntheticoligonucleotide
  source 1..22: mol_type = other DNA
caccgactcgcgcgagtcggtg

SEQ ID NO: 10580 - DNA, 22 bp, synthetic construct
  misc_feature 1..22: note = Description of Artificial Sequence: Syntheticoligonucleotide
  source 1..22: mol_type = other DNA
ctccgactcgcgcgagtcggag

SEQ ID NO: 10581 - DNA, 22 bp, synthetic construct
  misc_feature 1..22: note = Description of Artificial Sequence: Syntheticoligonucleotide
  source 1..22: mol_type = other DNA
gcgggactcgcgcgagtcccgc

SEQ ID NO: 10582 - DNA, 22 bp, synthetic construct
  misc_feature 1..22: note = Description of Artificial Sequence: Syntheticoligonucleotide
  source 1..22: mol_type = other DNA
gagggactcgcgcgagtccctc

SEQ ID NO: 10583 - DNA, 22 bp, synthetic construct
  misc_feature 1..22: note = Description of Artificial Sequence: Syntheticoligonucleotide
  source 1..22: mol_type = other DNA
gtgggactcgcgcgagtcccac

SEQ ID NO: 10584 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactcacgtgagtcnnnn

SEQ ID NO: 10585 - DNA, 22 bp, synthetic construct
  misc_feature 1..22: note = Description of Artificial Sequence: Syntheticoligonucleotide
  source 1..22: mol_type = other DNA
ggcggactcacgtgagtccgcc

SEQ ID NO: 10586 - DNA, 22 bp, synthetic construct
  misc_feature 1..22: note = Description of Artificial Sequence: Syntheticoligonucleotide
  source 1..22: mol_type = other DNA
agcggactcacgtgagtccgct

SEQ ID NO: 10587 - DNA, 22 bp, synthetic construct
  misc_feature 1..22: note = Description of Artificial Sequence: Syntheticoligonucleotide
  source 1..22: mol_type = other DNA
gacggactcacgtgagtccgtc

SEQ ID NO: 10588 - DNA, 22 bp, synthetic construct
  misc_feature 1..22: note = Description of Artificial Sequence: Syntheticoligonucleotide
  source 1..22: mol_type = other DNA
ggaggactcacgtgagtcctcc

SEQ ID NO: 10589 - DNA, 22 bp, synthetic construct
  misc_feature 1..22: note = Description of Artificial Sequence: Syntheticoligonucleotide
  source 1..22: mol_type = other DNA
ggcagactcacgtgagtctgcc

SEQ ID NO: 10590 - DNA, 22 bp, synthetic construct
  misc_feature 1..22: note = Description of Artificial Sequence: Syntheticoligonucleotide
  source 1..22: mol_type = other DNA
tgcggactcacgtgagtccgca

SEQ ID NO: 10591 - DNA, 22 bp, synthetic construct
  misc_feature 1..22: note = Description of Artificial Sequence: Syntheticoligonucleotide
  source 1..22: mol_type = other DNA
gtcggactcacgtgagtccgac

SEQ ID NO: 10592 - DNA, 22 bp, synthetic construct
  misc_feature 1..22: note = Description of Artificial Sequence: Syntheticoligonucleotide
  source 1..22: mol_type = other DNA
ggtggactcacgtgagtccacc

SEQ ID NO: 10593 - DNA, 22 bp, synthetic construct
  misc_feature 1..22: note = Description of Artificial Sequence: Syntheticoligonucleotide
  source 1..22: mol_type = other DNA
ggctgactcacgtgagtcagcc

SEQ ID NO: 10594 - DNA, 22 bp, synthetic construct
  misc_feature 1..22: note = Description of Artificial Sequence: Syntheticoligonucleotide
  source 1..22: mol_type = other DNA
gcccgactcacgtgagtcgggc

SEQ ID NO: 10595 - DNA, 22 bp, synthetic construct
  misc_feature 1..22: note = Description of Artificial Sequence: Syntheticoligonucleotide
  source 1..22: mol_type = other DNA
acccgactcacgtgagtcgggt

SEQ ID NO: 10596 - DNA, 22 bp, synthetic construct
  misc_feature 1..22: note = Description of Artificial Sequence: Syntheticoligonucleotide
  source 1..22: mol_type = other DNA
gaccgactcacgtgagtcggtc

SEQ ID NO: 10597 - DNA, 22 bp, synthetic construct
  misc_feature 1..22: note = Description of Artificial Sequence: Syntheticoligonucleotide
  source 1..22: mol_type = other DNA
gcacgactcacgtgagtcgtgc

SEQ ID NO: 10598 - DNA, 22 bp, synthetic construct
  misc_feature 1..22: note = Description of Artificial Sequence: Syntheticoligonucleotide
  source 1..22: mol_type = other DNA
gccagactcacgtgagtctggc

SEQ ID NO: 10599 - DNA, 22 bp, synthetic construct
  misc_feature 1..22: note = Description of Artificial Sequence: Syntheticoligonucleotide
  source 1..22: mol_type = other DNA
tcccgactcacgtgagtcggga

SEQ ID NO: 10600 - DNA, 22 bp, synthetic construct
  misc_feature 1..22: note = Description of Artificial Sequence: Syntheticoligonucleotide
  source 1..22: mol_type = other DNA
gtccgactcacgtgagtcggac

SEQ ID NO: 10601 - DNA, 22 bp, synthetic construct
  misc_feature 1..22: note = Description of Artificial Sequence: Syntheticoligonucleotide
  source 1..22: mol_type = other DNA
gcctgactcacgtgagtcaggc

SEQ ID NO: 10602 - DNA, 22 bp, synthetic construct
  misc_feature 1..22: note = Description of Artificial Sequence: Syntheticoligonucleotide
  source 1..22: mol_type = other DNA
gggcgactcacgtgagtcgccc

SEQ ID NO: 10603 - DNA, 22 bp, synthetic construct
  misc_feature 1..22: note = Description of Artificial Sequence: Syntheticoligonucleotide
  source 1..22: mol_type = other DNA
aggcgactcacgtgagtcgcct

SEQ ID NO: 10604 - DNA, 22 bp, synthetic construct
  misc_feature 1..22: note = Description of Artificial Sequence: Syntheticoligonucleotide
  source 1..22: mol_type = other DNA
gagcgactcacgtgagtcgctc

SEQ ID NO: 10605 - DNA, 22 bp, synthetic construct
  misc_feature 1..22: note = Description of Artificial Sequence: Syntheticoligonucleotide
  source 1..22: mol_type = other DNA
ggacgactcacgtgagtcgtcc

SEQ ID NO: 10606 - DNA, 22 bp, synthetic construct
  misc_feature 1..22: note = Description of Artificial Sequence: Syntheticoligonucleotide
  source 1..22: mol_type = other DNA
gggagactcacgtgagtctccc

SEQ ID NO: 10607 - DNA, 22 bp, synthetic construct
  misc_feature 1..22: note = Description of Artificial Sequence: Syntheticoligonucleotide
  source 1..22: mol_type = other DNA
tggcgactcacgtgagtcgcca

SEQ ID NO: 10608 - DNA, 22 bp, synthetic construct
  misc_feature 1..22: note = Description of Artificial Sequence: Syntheticoligonucleotide
  source 1..22: mol_type = other DNA
gtgcgactcacgtgagtcgcac

SEQ ID NO: 10609 - DNA, 22 bp, synthetic construct
  misc_feature 1..22: note = Description of Artificial Sequence: Syntheticoligonucleotide
  source 1..22: mol_type = other DNA
gggtgactcacgtgagtcaccc

SEQ ID NO: 10610 - DNA, 22 bp, synthetic construct
  misc_feature 1..22: note = Description of Artificial Sequence: Syntheticoligonucleotide
  source 1..22: mol_type = other DNA
acgggactcacgtgagtcccgt

SEQ ID NO: 10611 - DNA, 22 bp, synthetic construct
  misc_feature 1..22: note = Description of Artificial Sequence: Syntheticoligonucleotide
  source 1..22: mol_type = other DNA
cagggactcacgtgagtccctg

SEQ ID NO: 10612 - DNA, 22 bp, synthetic construct
  misc_feature 1..22: note = Description of Artificial Sequence: Syntheticoligonucleotide
  source 1..22: mol_type = other DNA
ccaggactcacgtgagtcctgg

SEQ ID NO: 10613 - DNA, 22 bp, synthetic construct
  misc_feature 1..22: note = Description of Artificial Sequence: Syntheticoligonucleotide
  source 1..22: mol_type = other DNA
ccgagactcacgtgagtctcgg

SEQ ID NO: 10614 - DNA, 22 bp, synthetic construct
  misc_feature 1..22: note = Description of Artificial Sequence: Syntheticoligonucleotide
  source 1..22: mol_type = other DNA
tcgggactcacgtgagtcccga

SEQ ID NO: 10615 - DNA, 22 bp, synthetic construct
  misc_feature 1..22: note = Description of Artificial Sequence: Syntheticoligonucleotide
  source 1..22: mol_type = other DNA
ctgggactcacgtgagtcccag

SEQ ID NO: 10616 - DNA, 22 bp, synthetic construct
  misc_feature 1..22: note = Description of Artificial Sequence: Syntheticoligonucleotide
  source 1..22: mol_type = other DNA
cctggactcacgtgagtccagg

SEQ ID NO: 10617 - DNA, 22 bp, synthetic construct
  misc_feature 1..22: note = Description of Artificial Sequence: Syntheticoligonucleotide
  source 1..22: mol_type = other DNA
ccgtgactcacgtgagtcacgg

SEQ ID NO: 10618 - DNA, 22 bp, synthetic construct
  misc_feature 1..22: note = Description of Artificial Sequence: Syntheticoligonucleotide
  source 1..22: mol_type = other DNA
cggcgactcacgtgagtcgccg

SEQ ID NO: 10619 - DNA, 22 bp, synthetic construct
  misc_feature 1..22: note = Description of Artificial Sequence: Syntheticoligonucleotide
  source 1..22: mol_type = other DNA
cagcgactcacgtgagtcgctg

SEQ ID NO: 10620 - DNA, 22 bp, synthetic construct
  misc_feature 1..22: note = Description of Artificial Sequence: Syntheticoligonucleotide
  source 1..22: mol_type = other DNA
cgacgactcacgtgagtcgtcg

SEQ ID NO: 10621 - DNA, 22 bp, synthetic construct
  misc_feature 1..22: note = Description of Artificial Sequence: Syntheticoligonucleotide
  source 1..22: mol_type = other DNA
cggagactcacgtgagtctccg

SEQ ID NO: 10622 - DNA, 22 bp, synthetic construct
  misc_feature 1..22: note = Description of Artificial Sequence: Syntheticoligonucleotide
  source 1..22: mol_type = other DNA
ctgcgactcacgtgagtcgcag

SEQ ID NO: 10623 - DNA, 22 bp, synthetic construct
  misc_feature 1..22: note = Description of Artificial Sequence: Syntheticoligonucleotide
  source 1..22: mol_type = other DNA
cggtgactcacgtgagtcaccg

SEQ ID NO: 10624 - DNA, 22 bp, synthetic construct
  misc_feature 1..22: note = Description of Artificial Sequence: Syntheticoligonucleotide
  source 1..22: mol_type = other DNA
cacggactcacgtgagtccgtg

SEQ ID NO: 10625 - DNA, 22 bp, synthetic construct
  misc_feature 1..22: note = Description of Artificial Sequence: Syntheticoligonucleotide
  source 1..22: mol_type = other DNA
cccagactcacgtgagtctggg

SEQ ID NO: 10626 - DNA, 22 bp, synthetic construct
  misc_feature 1..22: note = Description of Artificial Sequence: Syntheticoligonucleotide
  source 1..22: mol_type = other DNA
ctcggactcacgtgagtccgag

SEQ ID NO: 10627 - DNA, 22 bp, synthetic construct
  misc_feature 1..22: note = Description of Artificial Sequence: Syntheticoligonucleotide
  source 1..22: mol_type = other DNA
ccctgactcacgtgagtcaggg

SEQ ID NO: 10628 - DNA, 22 bp, synthetic construct
  misc_feature 1..22: note = Description of Artificial Sequence: Syntheticoligonucleotide
  source 1..22: mol_type = other DNA
ccacgactcacgtgagtcgtgg

SEQ ID NO: 10629 - DNA, 22 bp, synthetic construct
  misc_feature 1..22: note = Description of Artificial Sequence: Syntheticoligonucleotide
  source 1..22: mol_type = other DNA
agccgactcacgtgagtcggct

SEQ ID NO: 10630 - DNA, 22 bp, synthetic construct
  misc_feature 1..22: note = Description of Artificial Sequence: Syntheticoligonucleotide
  source 1..22: mol_type = other DNA
tgccgactcacgtgagtcggca

SEQ ID NO: 10631 - DNA, 22 bp, synthetic construct
  misc_feature 1..22: note = Description of Artificial Sequence: Syntheticoligonucleotide
  source 1..22: mol_type = other DNA
gcgagactcacgtgagtctcgc

SEQ ID NO: 10632 - DNA, 22 bp, synthetic construct
  misc_feature 1..22: note = Description of Artificial Sequence: Syntheticoligonucleotide
  source 1..22: mol_type = other DNA
gcgtgactcacgtgagtcacgc

SEQ ID NO: 10633 - DNA, 22 bp, synthetic construct
  misc_feature 1..22: note = Description of Artificial Sequence: Syntheticoligonucleotide
  source 1..22: mol_type = other DNA
gcaggactcacgtgagtcctgc

SEQ ID NO: 10634 - DNA, 22 bp, synthetic construct
  misc_feature 1..22: note = Description of Artificial Sequence: Syntheticoligonucleotide
  source 1..22: mol_type = other DNA
gctggactcacgtgagtccagc

SEQ ID NO: 10635 - DNA, 22 bp, synthetic construct
  misc_feature 1..22: note = Description of Artificial Sequence: Syntheticoligonucleotide
  source 1..22: mol_type = other DNA
cgaggactcacgtgagtcctcg

SEQ ID NO: 10636 - DNA, 22 bp, synthetic construct
  misc_feature 1..22: note = Description of Artificial Sequence: Syntheticoligonucleotide
  source 1..22: mol_type = other DNA
cgtggactcacgtgagtccacg

SEQ ID NO: 10637 - DNA, 22 bp, synthetic construct
  misc_feature 1..22: note = Description of Artificial Sequence: Syntheticoligonucleotide
  source 1..22: mol_type = other DNA
caccgactcacgtgagtcggtg

SEQ ID NO: 10638 - DNA, 22 bp, synthetic construct
  misc_feature 1..22: note = Description of Artificial Sequence: Syntheticoligonucleotide
  source 1..22: mol_type = other DNA
ctccgactcacgtgagtcggag

SEQ ID NO: 10639 - DNA, 22 bp, synthetic construct
  misc_feature 1..22: note = Description of Artificial Sequence: Syntheticoligonucleotide
  source 1..22: mol_type = other DNA
gcgggactcacgtgagtcccgc

SEQ ID NO: 10640 - DNA, 22 bp, synthetic construct
  misc_feature 1..22: note = Description of Artificial Sequence: Syntheticoligonucleotide
  source 1..22: mol_type = other DNA
gagggactcacgtgagtccctc

SEQ ID NO: 10641 - DNA, 22 bp, synthetic construct
  misc_feature 1..22: note = Description of Artificial Sequence: Syntheticoligonucleotide
  source 1..22: mol_type = other DNA
gtgggactcacgtgagtcccac

SEQ ID NO: 10642 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactcggccgagtcnnnn

SEQ ID NO: 10643 - DNA, 22 bp, synthetic construct
  misc_feature 1..22: note = Description of Artificial Sequence: Syntheticoligonucleotide
  source 1..22: mol_type = other DNA
ggcggactcggccgagtccgcc

SEQ ID NO: 10644 - DNA, 22 bp, synthetic construct
  misc_feature 1..22: note = Description of Artificial Sequence: Syntheticoligonucleotide
  source 1..22: mol_type = other DNA
agcggactcggccgagtccgct

SEQ ID NO: 10645 - DNA, 22 bp, synthetic construct
  misc_feature 1..22: note = Description of Artificial Sequence: Syntheticoligonucleotide
  source 1..22: mol_type = other DNA
gacggactcggccgagtccgtc

SEQ ID NO: 10646 - DNA, 22 bp, synthetic construct
  misc_feature 1..22: note = Description of Artificial Sequence: Syntheticoligonucleotide
  source 1..22: mol_type = other DNA
ggaggactcggccgagtcctcc

SEQ ID NO: 10647 - DNA, 22 bp, synthetic construct
  misc_feature 1..22: note = Description of Artificial Sequence: Syntheticoligonucleotide
  source 1..22: mol_type = other DNA
ggcagactcggccgagtctgcc

SEQ ID NO: 10648 - DNA, 22 bp, synthetic construct
  misc_feature 1..22: note = Description of Artificial Sequence: Syntheticoligonucleotide
  source 1..22: mol_type = other DNA
tgcggactcggccgagtccgca

SEQ ID NO: 10649 - DNA, 22 bp, synthetic construct
  misc_feature 1..22: note = Description of Artificial Sequence: Syntheticoligonucleotide
  source 1..22: mol_type = other DNA
gtcggactcggccgagtccgac

SEQ ID NO: 10650 - DNA, 22 bp, synthetic construct
  misc_feature 1..22: note = Description of Artificial Sequence: Syntheticoligonucleotide
  source 1..22: mol_type = other DNA
ggtggactcggccgagtccacc

SEQ ID NO: 10651 - DNA, 22 bp, synthetic construct
  misc_feature 1..22: note = Description of Artificial Sequence: Syntheticoligonucleotide
  source 1..22: mol_type = other DNA
ggctgactcggccgagtcagcc

SEQ ID NO: 10652 - DNA, 22 bp, synthetic construct
  misc_feature 1..22: note = Description of Artificial Sequence: Syntheticoligonucleotide
  source 1..22: mol_type = other DNA
gcccgactcggccgagtcgggc

SEQ ID NO: 10653 - DNA, 22 bp, synthetic construct
  misc_feature 1..22: note = Description of Artificial Sequence: Syntheticoligonucleotide
  source 1..22: mol_type = other DNA
acccgactcggccgagtcgggt

SEQ ID NO: 10654 - DNA, 22 bp, synthetic construct
  misc_feature 1..22: note = Description of Artificial Sequence: Syntheticoligonucleotide
  source 1..22: mol_type = other DNA
gaccgactcggccgagtcggtc

SEQ ID NO: 10655 - DNA, 22 bp, synthetic construct
  misc_feature 1..22: note = Description of Artificial Sequence: Syntheticoligonucleotide
  source 1..22: mol_type = other DNA
gcacgactcggccgagtcgtgc

SEQ ID NO: 10656 - DNA, 22 bp, synthetic construct
  misc_feature 1..22: note = Description of Artificial Sequence: Syntheticoligonucleotide
  source 1..22: mol_type = other DNA
gccagactcggccgagtctggc

SEQ ID NO: 10657 - DNA, 22 bp, synthetic construct
  misc_feature 1..22: note = Description of Artificial Sequence: Syntheticoligonucleotide
  source 1..22: mol_type = other DNA
tcccgactcggccgagtcggga

SEQ ID NO: 10658 - DNA, 22 bp, synthetic construct
  misc_feature 1..22: note = Description of Artificial Sequence: Syntheticoligonucleotide
  source 1..22: mol_type = other DNA
gtccgactcggccgagtcggac

SEQ ID NO: 10659 - DNA, 22 bp, synthetic construct
  misc_feature 1..22: note = Description of Artificial Sequence: Syntheticoligonucleotide
  source 1..22: mol_type = other DNA
gcctgactcggccgagtcaggc

SEQ ID NO: 10660 - DNA, 22 bp, synthetic construct
  misc_feature 1..22: note = Description of Artificial Sequence: Syntheticoligonucleotide
  source 1..22: mol_type = other DNA
gggcgactcggccgagtcgccc

SEQ ID NO: 10661 - DNA, 22 bp, synthetic construct
  misc_feature 1..22: note = Description of Artificial Sequence: Syntheticoligonucleotide
  source 1..22: mol_type = other DNA
aggcgactcggccgagtcgcct

SEQ ID NO: 10662 - DNA, 22 bp, synthetic construct
  misc_feature 1..22: note = Description of Artificial Sequence: Syntheticoligonucleotide
  source 1..22: mol_type = other DNA
gagcgactcggccgagtcgctc

SEQ ID NO: 10663 - DNA, 22 bp, synthetic construct
  misc_feature 1..22: note = Description of Artificial Sequence: Syntheticoligonucleotide
  source 1..22: mol_type = other DNA
ggacgactcggccgagtcgtcc

SEQ ID NO: 10664 - DNA, 22 bp, synthetic construct
  misc_feature 1..22: note = Description of Artificial Sequence: Syntheticoligonucleotide
  source 1..22: mol_type = other DNA
gggagactcggccgagtctccc

SEQ ID NO: 10665 - DNA, 22 bp, synthetic construct
  misc_feature 1..22: note = Description of Artificial Sequence: Syntheticoligonucleotide
  source 1..22: mol_type = other DNA
tggcgactcggccgagtcgcca

SEQ ID NO: 10666 - DNA, 22 bp, synthetic construct
  misc_feature 1..22: note = Description of Artificial Sequence: Syntheticoligonucleotide
  source 1..22: mol_type = other DNA
gtgcgactcggccgagtcgcac

SEQ ID NO: 10667 - DNA, 22 bp, synthetic construct
  misc_feature 1..22: note = Description of Artificial Sequence: Syntheticoligonucleotide
  source 1..22: mol_type = other DNA
gggtgactcggccgagtcaccc

SEQ ID NO: 10668 - DNA, 22 bp, synthetic construct
  misc_feature 1..22: note = Description of Artificial Sequence: Syntheticoligonucleotide
  source 1..22: mol_type = other DNA
acgggactcggccgagtcccgt

SEQ ID NO: 10669 - DNA, 22 bp, synthetic construct
  misc_feature 1..22: note = Description of Artificial Sequence: Syntheticoligonucleotide
  source 1..22: mol_type = other DNA
cagggactcggccgagtccctg

SEQ ID NO: 10670 - DNA, 22 bp, synthetic construct
  misc_feature 1..22: note = Description of Artificial Sequence: Syntheticoligonucleotide
  source 1..22: mol_type = other DNA
ccaggactcggccgagtcctgg

SEQ ID NO: 10671 - DNA, 22 bp, synthetic construct
  misc_feature 1..22: note = Description of Artificial Sequence: Syntheticoligonucleotide
  source 1..22: mol_type = other DNA
ccgagactcggccgagtctcgg

SEQ ID NO: 10672 - DNA, 22 bp, synthetic construct
  misc_feature 1..22: note = Description of Artificial Sequence: Syntheticoligonucleotide
  source 1..22: mol_type = other DNA
tcgggactcggccgagtcccga

SEQ ID NO: 10673 - DNA, 22 bp, synthetic construct
  misc_feature 1..22: note = Description of Artificial Sequence: Syntheticoligonucleotide
  source 1..22: mol_type = other DNA
ctgggactcggccgagtcccag

SEQ ID NO: 10674 - DNA, 22 bp, synthetic construct
  misc_feature 1..22: note = Description of Artificial Sequence: Syntheticoligonucleotide
  source 1..22: mol_type = other DNA
cctggactcggccgagtccagg

SEQ ID NO: 10675 - DNA, 22 bp, synthetic construct
  misc_feature 1..22: note = Description of Artificial Sequence: Syntheticoligonucleotide
  source 1..22: mol_type = other DNA
ccgtgactcggccgagtcacgg

SEQ ID NO: 10676 - DNA, 22 bp, synthetic construct
  misc_feature 1..22: note = Description of Artificial Sequence: Syntheticoligonucleotide
  source 1..22: mol_type = other DNA
cggcgactcggccgagtcgccg

SEQ ID NO: 10677 - DNA, 22 bp, synthetic construct
  misc_feature 1..22: note = Description of Artificial Sequence: Syntheticoligonucleotide
  source 1..22: mol_type = other DNA
cagcgactcggccgagtcgctg

SEQ ID NO: 10678 - DNA, 22 bp, synthetic construct
  misc_feature 1..22: note = Description of Artificial Sequence: Syntheticoligonucleotide
  source 1..22: mol_type = other DNA
cgacgactcggccgagtcgtcg

SEQ ID NO: 10679 - DNA, 22 bp, synthetic construct
  misc_feature 1..22: note = Description of Artificial Sequence: Syntheticoligonucleotide
  source 1..22: mol_type = other DNA
cggagactcggccgagtctccg

SEQ ID NO: 10680 - DNA, 22 bp, synthetic construct
  misc_feature 1..22: note = Description of Artificial Sequence: Syntheticoligonucleotide
  source 1..22: mol_type = other DNA
ctgcgactcggccgagtcgcag

SEQ ID NO: 10681 - DNA, 22 bp, synthetic construct
  misc_feature 1..22: note = Description of Artificial Sequence: Syntheticoligonucleotide
  source 1..22: mol_type = other DNA
cggtgactcggccgagtcaccg

SEQ ID NO: 10682 - DNA, 22 bp, synthetic construct
  misc_feature 1..22: note = Description of Artificial Sequence: Syntheticoligonucleotide
  source 1..22: mol_type = other DNA
cacggactcggccgagtccgtg

SEQ ID NO: 10683 - DNA, 22 bp, synthetic construct
  misc_feature 1..22: note = Description of Artificial Sequence: Syntheticoligonucleotide
  source 1..22: mol_type = other DNA
cccagactcggccgagtctggg

SEQ ID NO: 10684 - DNA, 22 bp, synthetic construct
  misc_feature 1..22: note = Description of Artificial Sequence: Syntheticoligonucleotide
  source 1..22: mol_type = other DNA
ctcggactcggccgagtccgag

SEQ ID NO: 10685 - DNA, 22 bp, synthetic construct
  misc_feature 1..22: note = Description of Artificial Sequence: Syntheticoligonucleotide
  source 1..22: mol_type = other DNA
ccctgactcggccgagtcaggg

SEQ ID NO: 10686 - DNA, 22 bp, synthetic construct
  misc_feature 1..22: note = Description of Artificial Sequence: Syntheticoligonucleotide
  source 1..22: mol_type = other DNA
ccacgactcggccgagtcgtgg

SEQ ID NO: 10687 - DNA, 22 bp, synthetic construct
  misc_feature 1..22: note = Description of Artificial Sequence: Syntheticoligonucleotide
  source 1..22: mol_type = other DNA
agccgactcggccgagtcggct

SEQ ID NO: 10688 - DNA, 22 bp, synthetic construct
  misc_feature 1..22: note = Description of Artificial Sequence: Syntheticoligonucleotide
  source 1..22: mol_type = other DNA
tgccgactcggccgagtcggca

SEQ ID NO: 10689 - DNA, 22 bp, synthetic construct
  misc_feature 1..22: note = Description of Artificial Sequence: Syntheticoligonucleotide
  source 1..22: mol_type = other DNA
gcgagactcggccgagtctcgc

SEQ ID NO: 10690 - DNA, 22 bp, synthetic construct
  misc_feature 1..22: note = Description of Artificial Sequence: Syntheticoligonucleotide
  source 1..22: mol_type = other DNA
gcgtgactcggccgagtcacgc

SEQ ID NO: 10691 - DNA, 22 bp, synthetic construct
  misc_feature 1..22: note = Description of Artificial Sequence: Syntheticoligonucleotide
  source 1..22: mol_type = other DNA
gcaggactcggccgagtcctgc

SEQ ID NO: 10692 - DNA, 22 bp, synthetic construct
  misc_feature 1..22: note = Description of Artificial Sequence: Syntheticoligonucleotide
  source 1..22: mol_type = other DNA
gctggactcggccgagtccagc

SEQ ID NO: 10693 - DNA, 22 bp, synthetic construct
  misc_feature 1..22: note = Description of Artificial Sequence: Syntheticoligonucleotide
  source 1..22: mol_type = other DNA
cgaggactcggccgagtcctcg

SEQ ID NO: 10694 - DNA, 22 bp, synthetic construct
  misc_feature 1..22: note = Description of Artificial Sequence: Syntheticoligonucleotide
  source 1..22: mol_type = other DNA
cgtggactcggccgagtccacg

SEQ ID NO: 10695 - DNA, 22 bp, synthetic construct
  misc_feature 1..22: note = Description of Artificial Sequence: Syntheticoligonucleotide
  source 1..22: mol_type = other DNA
caccgactcggccgagtcggtg

SEQ ID NO: 10696 - DNA, 22 bp, synthetic construct
  misc_feature 1..22: note = Description of Artificial Sequence: Syntheticoligonucleotide
  source 1..22: mol_type = other DNA
ctccgactcggccgagtcggag

SEQ ID NO: 10697 - DNA, 22 bp, synthetic construct
  misc_feature 1..22: note = Description of Artificial Sequence: Syntheticoligonucleotide
  source 1..22: mol_type = other DNA
gcgggactcggccgagtcccgc

SEQ ID NO: 10698 - DNA, 22 bp, synthetic construct
  misc_feature 1..22: note = Description of Artificial Sequence: Syntheticoligonucleotide
  source 1..22: mol_type = other DNA
gagggactcggccgagtccctc

SEQ ID NO: 10699 - DNA, 22 bp, synthetic construct
  misc_feature 1..22: note = Description of Artificial Sequence: Syntheticoligonucleotide
  source 1..22: mol_type = other DNA
gtgggactcggccgagtcccac

SEQ ID NO: 10700 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactcccgggagtcnnnn

SEQ ID NO: 10701 - DNA, 22 bp, synthetic construct
  misc_feature 1..22: note = Description of Artificial Sequence: Syntheticoligonucleotide
  source 1..22: mol_type = other DNA
ggcggactcccgggagtccgcc

SEQ ID NO: 10702 - DNA, 22 bp, synthetic construct
  misc_feature 1..22: note = Description of Artificial Sequence: Syntheticoligonucleotide
  source 1..22: mol_type = other DNA
agcggactcccgggagtccgct

SEQ ID NO: 10703 - DNA, 22 bp, synthetic construct
  misc_feature 1..22: note = Description of Artificial Sequence: Syntheticoligonucleotide
  source 1..22: mol_type = other DNA
gacggactcccgggagtccgtc

SEQ ID NO: 10704 - DNA, 22 bp, synthetic construct
  misc_feature 1..22: note = Description of Artificial Sequence: Syntheticoligonucleotide
  source 1..22: mol_type = other DNA
ggaggactcccgggagtcctcc

SEQ ID NO: 10705 - DNA, 22 bp, synthetic construct
  misc_feature 1..22: note = Description of Artificial Sequence: Syntheticoligonucleotide
  source 1..22: mol_type = other DNA
ggcagactcccgggagtctgcc

SEQ ID NO: 10706 - DNA, 22 bp, synthetic construct
  misc_feature 1..22: note = Description of Artificial Sequence: Syntheticoligonucleotide
  source 1..22: mol_type = other DNA
tgcggactcccgggagtccgca

SEQ ID NO: 10707 - DNA, 22 bp, synthetic construct
  misc_feature 1..22: note = Description of Artificial Sequence: Syntheticoligonucleotide
  source 1..22: mol_type = other DNA
gtcggactcccgggagtccgac

SEQ ID NO: 10708 - DNA, 22 bp, synthetic construct
  misc_feature 1..22: note = Description of Artificial Sequence: Syntheticoligonucleotide
  source 1..22: mol_type = other DNA
ggtggactcccgggagtccacc

SEQ ID NO: 10709 - DNA, 22 bp, synthetic construct
  misc_feature 1..22: note = Description of Artificial Sequence: Syntheticoligonucleotide
  source 1..22: mol_type = other DNA
ggctgactcccgggagtcagcc

SEQ ID NO: 10710 - DNA, 22 bp, synthetic construct
  misc_feature 1..22: note = Description of Artificial Sequence: Syntheticoligonucleotide
  source 1..22: mol_type = other DNA
gcccgactcccgggagtcgggc

SEQ ID NO: 10711 - DNA, 22 bp, synthetic construct
  misc_feature 1..22: note = Description of Artificial Sequence: Syntheticoligonucleotide
  source 1..22: mol_type = other DNA
acccgactcccgggagtcgggt

SEQ ID NO: 10712 - DNA, 22 bp, synthetic construct
  misc_feature 1..22: note = Description of Artificial Sequence: Syntheticoligonucleotide
  source 1..22: mol_type = other DNA
gaccgactcccgggagtcggtc

SEQ ID NO: 10713 - DNA, 22 bp, synthetic construct
  misc_feature 1..22: note = Description of Artificial Sequence: Syntheticoligonucleotide
  source 1..22: mol_type = other DNA
gcacgactcccgggagtcgtgc

SEQ ID NO: 10714 - DNA, 22 bp, synthetic construct
  misc_feature 1..22: note = Description of Artificial Sequence: Syntheticoligonucleotide
  source 1..22: mol_type = other DNA
gccagactcccgggagtctggc

SEQ ID NO: 10715 - DNA, 22 bp, synthetic construct
  misc_feature 1..22: note = Description of Artificial Sequence: Syntheticoligonucleotide
  source 1..22: mol_type = other DNA
tcccgactcccgggagtcggga

SEQ ID NO: 10716 - DNA, 22 bp, synthetic construct
  misc_feature 1..22: note = Description of Artificial Sequence: Syntheticoligonucleotide
  source 1..22: mol_type = other DNA
gtccgactcccgggagtcggac

SEQ ID NO: 10717 - DNA, 22 bp, synthetic construct
  misc_feature 1..22: note = Description of Artificial Sequence: Syntheticoligonucleotide
  source 1..22: mol_type = other DNA
gcctgactcccgggagtcaggc

SEQ ID NO: 10718 - DNA, 22 bp, synthetic construct
  misc_feature 1..22: note = Description of Artificial Sequence: Syntheticoligonucleotide
  source 1..22: mol_type = other DNA
gggcgactcccgggagtcgccc

SEQ ID NO: 10719 - DNA, 22 bp, synthetic construct
  misc_feature 1..22: note = Description of Artificial Sequence: Syntheticoligonucleotide
  source 1..22: mol_type = other DNA
aggcgactcccgggagtcgcct

SEQ ID NO: 10720 - DNA, 22 bp, synthetic construct
  misc_feature 1..22: note = Description of Artificial Sequence: Syntheticoligonucleotide
  source 1..22: mol_type = other DNA
gagcgactcccgggagtcgctc

SEQ ID NO: 10721 - DNA, 22 bp, synthetic construct
  misc_feature 1..22: note = Description of Artificial Sequence: Syntheticoligonucleotide
  source 1..22: mol_type = other DNA
ggacgactcccgggagtcgtcc

SEQ ID NO: 10722 - DNA, 22 bp, synthetic construct
  misc_feature 1..22: note = Description of Artificial Sequence: Syntheticoligonucleotide
  source 1..22: mol_type = other DNA
gggagactcccgggagtctccc

SEQ ID NO: 10723 - DNA, 22 bp, synthetic construct
  misc_feature 1..22: note = Description of Artificial Sequence: Syntheticoligonucleotide
  source 1..22: mol_type = other DNA
tggcgactcccgggagtcgcca

SEQ ID NO: 10724 - DNA, 22 bp, synthetic construct
  misc_feature 1..22: note = Description of Artificial Sequence: Syntheticoligonucleotide
  source 1..22: mol_type = other DNA
gtgcgactcccgggagtcgcac

SEQ ID NO: 10725 - DNA, 22 bp, synthetic construct
  misc_feature 1..22: note = Description of Artificial Sequence: Syntheticoligonucleotide
  source 1..22: mol_type = other DNA
gggtgactcccgggagtcaccc

SEQ ID NO: 10726 - DNA, 22 bp, synthetic construct
  misc_feature 1..22: note = Description of Artificial Sequence: Syntheticoligonucleotide
  source 1..22: mol_type = other DNA
acgggactcccgggagtcccgt

SEQ ID NO: 10727 - DNA, 22 bp, synthetic construct
  misc_feature 1..22: note = Description of Artificial Sequence: Syntheticoligonucleotide
  source 1..22: mol_type = other DNA
cagggactcccgggagtccctg

SEQ ID NO: 10728 - DNA, 22 bp, synthetic construct
  misc_feature 1..22: note = Description of Artificial Sequence: Syntheticoligonucleotide
  source 1..22: mol_type = other DNA
ccaggactcccgggagtcctgg

SEQ ID NO: 10729 - DNA, 22 bp, synthetic construct
  misc_feature 1..22: note = Description of Artificial Sequence: Syntheticoligonucleotide
  source 1..22: mol_type = other DNA
ccgagactcccgggagtctcgg

SEQ ID NO: 10730 - DNA, 22 bp, synthetic construct
  misc_feature 1..22: note = Description of Artificial Sequence: Syntheticoligonucleotide
  source 1..22: mol_type = other DNA
tcgggactcccgggagtcccga

SEQ ID NO: 10731 - DNA, 22 bp, synthetic construct
  misc_feature 1..22: note = Description of Artificial Sequence: Syntheticoligonucleotide
  source 1..22: mol_type = other DNA
ctgggactcccgggagtcccag

SEQ ID NO: 10732 - DNA, 22 bp, synthetic construct
  misc_feature 1..22: note = Description of Artificial Sequence: Syntheticoligonucleotide
  source 1..22: mol_type = other DNA
cctggactcccgggagtccagg

SEQ ID NO: 10733 - DNA, 22 bp, synthetic construct
  misc_feature 1..22: note = Description of Artificial Sequence: Syntheticoligonucleotide
  source 1..22: mol_type = other DNA
ccgtgactcccgggagtcacgg

SEQ ID NO: 10734 - DNA, 22 bp, synthetic construct
  misc_feature 1..22: note = Description of Artificial Sequence: Syntheticoligonucleotide
  source 1..22: mol_type = other DNA
cggcgactcccgggagtcgccg

SEQ ID NO: 10735 - DNA, 22 bp, synthetic construct
  misc_feature 1..22: note = Description of Artificial Sequence: Syntheticoligonucleotide
  source 1..22: mol_type = other DNA
cagcgactcccgggagtcgctg

SEQ ID NO: 10736 - DNA, 22 bp, synthetic construct
  misc_feature 1..22: note = Description of Artificial Sequence: Syntheticoligonucleotide
  source 1..22: mol_type = other DNA
cgacgactcccgggagtcgtcg

SEQ ID NO: 10737 - DNA, 22 bp, synthetic construct
  misc_feature 1..22: note = Description of Artificial Sequence: Syntheticoligonucleotide
  source 1..22: mol_type = other DNA
cggagactcccgggagtctccg

SEQ ID NO: 10738 - DNA, 22 bp, synthetic construct
  misc_feature 1..22: note = Description of Artificial Sequence: Syntheticoligonucleotide
  source 1..22: mol_type = other DNA
ctgcgactcccgggagtcgcag

SEQ ID NO: 10739 - DNA, 22 bp, synthetic construct
  misc_feature 1..22: note = Description of Artificial Sequence: Syntheticoligonucleotide
  source 1..22: mol_type = other DNA
cggtgactcccgggagtcaccg

SEQ ID NO: 10740 - DNA, 22 bp, synthetic construct
  misc_feature 1..22: note = Description of Artificial Sequence: Syntheticoligonucleotide
  source 1..22: mol_type = other DNA
cacggactcccgggagtccgtg

SEQ ID NO: 10741 - DNA, 22 bp, synthetic construct
  misc_feature 1..22: note = Description of Artificial Sequence: Syntheticoligonucleotide
  source 1..22: mol_type = other DNA
cccagactcccgggagtctggg

SEQ ID NO: 10742 - DNA, 22 bp, synthetic construct
  misc_feature 1..22: note = Description of Artificial Sequence: Syntheticoligonucleotide
  source 1..22: mol_type = other DNA
ctcggactcccgggagtccgag

SEQ ID NO: 10743 - DNA, 22 bp, synthetic construct
  misc_feature 1..22: note = Description of Artificial Sequence: Syntheticoligonucleotide
  source 1..22: mol_type = other DNA
ccctgactcccgggagtcaggg

SEQ ID NO: 10744 - DNA, 22 bp, synthetic construct
  misc_feature 1..22: note = Description of Artificial Sequence: Syntheticoligonucleotide
  source 1..22: mol_type = other DNA
ccacgactcccgggagtcgtgg

SEQ ID NO: 10745 - DNA, 22 bp, synthetic construct
  misc_feature 1..22: note = Description of Artificial Sequence: Syntheticoligonucleotide
  source 1..22: mol_type = other DNA
agccgactcccgggagtcggct

SEQ ID NO: 10746 - DNA, 22 bp, synthetic construct
  misc_feature 1..22: note = Description of Artificial Sequence: Syntheticoligonucleotide
  source 1..22: mol_type = other DNA
tgccgactcccgggagtcggca

SEQ ID NO: 10747 - DNA, 22 bp, synthetic construct
  misc_feature 1..22: note = Description of Artificial Sequence: Syntheticoligonucleotide
  source 1..22: mol_type = other DNA
gcgagactcccgggagtctcgc

SEQ ID NO: 10748 - DNA, 22 bp, synthetic construct
  misc_feature 1..22: note = Description of Artificial Sequence: Syntheticoligonucleotide
  source 1..22: mol_type = other DNA
gcgtgactcccgggagtcacgc

SEQ ID NO: 10749 - DNA, 22 bp, synthetic construct
  misc_feature 1..22: note = Description of Artificial Sequence: Syntheticoligonucleotide
  source 1..22: mol_type = other DNA
gcaggactcccgggagtcctgc

SEQ ID NO: 10750 - DNA, 22 bp, synthetic construct
  misc_feature 1..22: note = Description of Artificial Sequence: Syntheticoligonucleotide
  source 1..22: mol_type = other DNA
gctggactcccgggagtccagc

SEQ ID NO: 10751 - DNA, 22 bp, synthetic construct
  misc_feature 1..22: note = Description of Artificial Sequence: Syntheticoligonucleotide
  source 1..22: mol_type = other DNA
cgaggactcccgggagtcctcg

SEQ ID NO: 10752 - DNA, 22 bp, synthetic construct
  misc_feature 1..22: note = Description of Artificial Sequence: Syntheticoligonucleotide
  source 1..22: mol_type = other DNA
cgtggactcccgggagtccacg

SEQ ID NO: 10753 - DNA, 22 bp, synthetic construct
  misc_feature 1..22: note = Description of Artificial Sequence: Syntheticoligonucleotide
  source 1..22: mol_type = other DNA
caccgactcccgggagtcggtg

SEQ ID NO: 10754 - DNA, 22 bp, synthetic construct
  misc_feature 1..22: note = Description of Artificial Sequence: Syntheticoligonucleotide
  source 1..22: mol_type = other DNA
ctccgactcccgggagtcggag

SEQ ID NO: 10755 - DNA, 22 bp, synthetic construct
  misc_feature 1..22: note = Description of Artificial Sequence: Syntheticoligonucleotide
  source 1..22: mol_type = other DNA
gcgggactcccgggagtcccgc

SEQ ID NO: 10756 - DNA, 22 bp, synthetic construct
  misc_feature 1..22: note = Description of Artificial Sequence: Syntheticoligonucleotide
  source 1..22: mol_type = other DNA
gagggactcccgggagtccctc

SEQ ID NO: 10757 - DNA, 22 bp, synthetic construct
  misc_feature 1..22: note = Description of Artificial Sequence: Syntheticoligonucleotide
  source 1..22: mol_type = other DNA
gtgggactcccgggagtcccac

SEQ ID NO: 10758 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactcgtacgagtcnnnn

SEQ ID NO: 10759 - DNA, 22 bp, synthetic construct
  misc_feature 1..22: note = Description of Artificial Sequence: Syntheticoligonucleotide
  source 1..22: mol_type = other DNA
ggcggactcgtacgagtccgcc

SEQ ID NO: 10760 - DNA, 22 bp, synthetic construct
  misc_feature 1..22: note = Description of Artificial Sequence: Syntheticoligonucleotide
  source 1..22: mol_type = other DNA
agcggactcgtacgagtccgct

SEQ ID NO: 10761 - DNA, 22 bp, synthetic construct
  misc_feature 1..22: note = Description of Artificial Sequence: Syntheticoligonucleotide
  source 1..22: mol_type = other DNA
gacggactcgtacgagtccgtc

SEQ ID NO: 10762 - DNA, 22 bp, synthetic construct
  misc_feature 1..22: note = Description of Artificial Sequence: Syntheticoligonucleotide
  source 1..22: mol_type = other DNA
ggaggactcgtacgagtcctcc

SEQ ID NO: 10763 - DNA, 22 bp, synthetic construct
  misc_feature 1..22: note = Description of Artificial Sequence: Syntheticoligonucleotide
  source 1..22: mol_type = other DNA
ggcagactcgtacgagtctgcc

SEQ ID NO: 10764 - DNA, 22 bp, synthetic construct
  misc_feature 1..22: note = Description of Artificial Sequence: Syntheticoligonucleotide
  source 1..22: mol_type = other DNA
tgcggactcgtacgagtccgca

SEQ ID NO: 10765 - DNA, 22 bp, synthetic construct
  misc_feature 1..22: note = Description of Artificial Sequence: Syntheticoligonucleotide
  source 1..22: mol_type = other DNA
gtcggactcgtacgagtccgac

SEQ ID NO: 10766 - DNA, 22 bp, synthetic construct
  misc_feature 1..22: note = Description of Artificial Sequence: Syntheticoligonucleotide
  source 1..22: mol_type = other DNA
ggtggactcgtacgagtccacc

SEQ ID NO: 10767 - DNA, 22 bp, synthetic construct
  misc_feature 1..22: note = Description of Artificial Sequence: Syntheticoligonucleotide
  source 1..22: mol_type = other DNA
ggctgactcgtacgagtcagcc

SEQ ID NO: 10768 - DNA, 22 bp, synthetic construct
  misc_feature 1..22: note = Description of Artificial Sequence: Syntheticoligonucleotide
  source 1..22: mol_type = other DNA
gcccgactcgtacgagtcgggc

SEQ ID NO: 10769 - DNA, 22 bp, synthetic construct
  misc_feature 1..22: note = Description of Artificial Sequence: Syntheticoligonucleotide
  source 1..22: mol_type = other DNA
acccgactcgtacgagtcgggt

SEQ ID NO: 10770 - DNA, 22 bp, synthetic construct
  misc_feature 1..22: note = Description of Artificial Sequence: Syntheticoligonucleotide
  source 1..22: mol_type = other DNA
gaccgactcgtacgagtcggtc

SEQ ID NO: 10771 - DNA, 22 bp, synthetic construct
  misc_feature 1..22: note = Description of Artificial Sequence: Syntheticoligonucleotide
  source 1..22: mol_type = other DNA
gcacgactcgtacgagtcgtgc

SEQ ID NO: 10772 - DNA, 22 bp, synthetic construct
  misc_feature 1..22: note = Description of Artificial Sequence: Syntheticoligonucleotide
  source 1..22: mol_type = other DNA
gccagactcgtacgagtctggc

SEQ ID NO: 10773 - DNA, 22 bp, synthetic construct
  misc_feature 1..22: note = Description of Artificial Sequence: Syntheticoligonucleotide
  source 1..22: mol_type = other DNA
tcccgactcgtacgagtcggga

SEQ ID NO: 10774 - DNA, 22 bp, synthetic construct
  misc_feature 1..22: note = Description of Artificial Sequence: Syntheticoligonucleotide
  source 1..22: mol_type = other DNA
gtccgactcgtacgagtcggac

SEQ ID NO: 10775 - DNA, 22 bp, synthetic construct
  misc_feature 1..22: note = Description of Artificial Sequence: Syntheticoligonucleotide
  source 1..22: mol_type = other DNA
gcctgactcgtacgagtcaggc

SEQ ID NO: 10776 - DNA, 22 bp, synthetic construct
  misc_feature 1..22: note = Description of Artificial Sequence: Syntheticoligonucleotide
  source 1..22: mol_type = other DNA
gggcgactcgtacgagtcgccc

SEQ ID NO: 10777 - DNA, 22 bp, synthetic construct
  misc_feature 1..22: note = Description of Artificial Sequence: Syntheticoligonucleotide
  source 1..22: mol_type = other DNA
aggcgactcgtacgagtcgcct

SEQ ID NO: 10778 - DNA, 22 bp, synthetic construct
  misc_feature 1..22: note = Description of Artificial Sequence: Syntheticoligonucleotide
  source 1..22: mol_type = other DNA
gagcgactcgtacgagtcgctc

SEQ ID NO: 10779 - DNA, 22 bp, synthetic construct
  misc_feature 1..22: note = Description of Artificial Sequence: Syntheticoligonucleotide
  source 1..22: mol_type = other DNA
ggacgactcgtacgagtcgtcc

SEQ ID NO: 10780 - DNA, 22 bp, synthetic construct
  misc_feature 1..22: note = Description of Artificial Sequence: Syntheticoligonucleotide
  source 1..22: mol_type = other DNA
gggagactcgtacgagtctccc

SEQ ID NO: 10781 - DNA, 22 bp, synthetic construct
  misc_feature 1..22: note = Description of Artificial Sequence: Syntheticoligonucleotide
  source 1..22: mol_type = other DNA
tggcgactcgtacgagtcgcca

SEQ ID NO: 10782 - DNA, 22 bp, synthetic construct
  misc_feature 1..22: note = Description of Artificial Sequence: Syntheticoligonucleotide
  source 1..22: mol_type = other DNA
gtgcgactcgtacgagtcgcac

SEQ ID NO: 10783 - DNA, 22 bp, synthetic construct
  misc_feature 1..22: note = Description of Artificial Sequence: Syntheticoligonucleotide
  source 1..22: mol_type = other DNA
gggtgactcgtacgagtcaccc

SEQ ID NO: 10784 - DNA, 22 bp, synthetic construct
  misc_feature 1..22: note = Description of Artificial Sequence: Syntheticoligonucleotide
  source 1..22: mol_type = other DNA
acgggactcgtacgagtcccgt

SEQ ID NO: 10785 - DNA, 22 bp, synthetic construct
  misc_feature 1..22: note = Description of Artificial Sequence: Syntheticoligonucleotide
  source 1..22: mol_type = other DNA
cagggactcgtacgagtccctg

SEQ ID NO: 10786 - DNA, 22 bp, synthetic construct
  misc_feature 1..22: note = Description of Artificial Sequence: Syntheticoligonucleotide
  source 1..22: mol_type = other DNA
ccaggactcgtacgagtcctgg

SEQ ID NO: 10787 - DNA, 22 bp, synthetic construct
  misc_feature 1..22: note = Description of Artificial Sequence: Syntheticoligonucleotide
  source 1..22: mol_type = other DNA
ccgagactcgtacgagtctcgg

SEQ ID NO: 10788 - DNA, 22 bp, synthetic construct
  misc_feature 1..22: note = Description of Artificial Sequence: Syntheticoligonucleotide
  source 1..22: mol_type = other DNA
tcgggactcgtacgagtcccga

SEQ ID NO: 10789 - DNA, 22 bp, synthetic construct
  misc_feature 1..22: note = Description of Artificial Sequence: Syntheticoligonucleotide
  source 1..22: mol_type = other DNA
ctgggactcgtacgagtcccag

SEQ ID NO: 10790 - DNA, 22 bp, synthetic construct
  misc_feature 1..22: note = Description of Artificial Sequence: Syntheticoligonucleotide
  source 1..22: mol_type = other DNA
cctggactcgtacgagtccagg

SEQ ID NO: 10791 - DNA, 22 bp, synthetic construct
  misc_feature 1..22: note = Description of Artificial Sequence: Syntheticoligonucleotide
  source 1..22: mol_type = other DNA
ccgtgactcgtacgagtcacgg

SEQ ID NO: 10792 - DNA, 22 bp, synthetic construct
  misc_feature 1..22: note = Description of Artificial Sequence: Syntheticoligonucleotide
  source 1..22: mol_type = other DNA
cggcgactcgtacgagtcgccg

SEQ ID NO: 10793 - DNA, 22 bp, synthetic construct
  misc_feature 1..22: note = Description of Artificial Sequence: Syntheticoligonucleotide
  source 1..22: mol_type = other DNA
cagcgactcgtacgagtcgctg

SEQ ID NO: 10794 - DNA, 22 bp, synthetic construct
  misc_feature 1..22: note = Description of Artificial Sequence: Syntheticoligonucleotide
  source 1..22: mol_type = other DNA
cgacgactcgtacgagtcgtcg

SEQ ID NO: 10795 - DNA, 22 bp, synthetic construct
  misc_feature 1..22: note = Description of Artificial Sequence: Syntheticoligonucleotide
  source 1..22: mol_type = other DNA
cggagactcgtacgagtctccg

SEQ ID NO: 10796 - DNA, 22 bp, synthetic construct
  misc_feature 1..22: note = Description of Artificial Sequence: Syntheticoligonucleotide
  source 1..22: mol_type = other DNA
ctgcgactcgtacgagtcgcag

SEQ ID NO: 10797 - DNA, 22 bp, synthetic construct
  misc_feature 1..22: note = Description of Artificial Sequence: Syntheticoligonucleotide
  source 1..22: mol_type = other DNA
cggtgactcgtacgagtcaccg

SEQ ID NO: 10798 - DNA, 22 bp, synthetic construct
  misc_feature 1..22: note = Description of Artificial Sequence: Syntheticoligonucleotide
  source 1..22: mol_type = other DNA
cacggactcgtacgagtccgtg

SEQ ID NO: 10799 - DNA, 22 bp, synthetic construct
  misc_feature 1..22: note = Description of Artificial Sequence: Syntheticoligonucleotide
  source 1..22: mol_type = other DNA
cccagactcgtacgagtctggg

SEQ ID NO: 10800 - DNA, 22 bp, synthetic construct
  misc_feature 1..22: note = Description of Artificial Sequence: Syntheticoligonucleotide
  source 1..22: mol_type = other DNA
ctcggactcgtacgagtccgag

SEQ ID NO: 10801 - DNA, 22 bp, synthetic construct
  misc_feature 1..22: note = Description of Artificial Sequence: Syntheticoligonucleotide
  source 1..22: mol_type = other DNA
ccctgactcgtacgagtcaggg

SEQ ID NO: 10802 - DNA, 22 bp, synthetic construct
  misc_feature 1..22: note = Description of Artificial Sequence: Syntheticoligonucleotide
  source 1..22: mol_type = other DNA
ccacgactcgtacgagtcgtgg

SEQ ID NO: 10803 - DNA, 22 bp, synthetic construct
  misc_feature 1..22: note = Description of Artificial Sequence: Syntheticoligonucleotide
  source 1..22: mol_type = other DNA
agccgactcgtacgagtcggct

SEQ ID NO: 10804 - DNA, 22 bp, synthetic construct
  misc_feature 1..22: note = Description of Artificial Sequence: Syntheticoligonucleotide
  source 1..22: mol_type = other DNA
tgccgactcgtacgagtcggca

SEQ ID NO: 10805 - DNA, 22 bp, synthetic construct
  misc_feature 1..22: note = Description of Artificial Sequence: Syntheticoligonucleotide
  source 1..22: mol_type = other DNA
gcgagactcgtacgagtctcgc

SEQ ID NO: 10806 - DNA, 22 bp, synthetic construct
  misc_feature 1..22: note = Description of Artificial Sequence: Syntheticoligonucleotide
  source 1..22: mol_type = other DNA
gcgtgactcgtacgagtcacgc

SEQ ID NO: 10807 - DNA, 22 bp, synthetic construct
  misc_feature 1..22: note = Description of Artificial Sequence: Syntheticoligonucleotide
  source 1..22: mol_type = other DNA
gcaggactcgtacgagtcctgc

SEQ ID NO: 10808 - DNA, 22 bp, synthetic construct
  misc_feature 1..22: note = Description of Artificial Sequence: Syntheticoligonucleotide
  source 1..22: mol_type = other DNA
gctggactcgtacgagtccagc

SEQ ID NO: 10809 - DNA, 22 bp, synthetic construct
  misc_feature 1..22: note = Description of Artificial Sequence: Syntheticoligonucleotide
  source 1..22: mol_type = other DNA
cgaggactcgtacgagtcctcg

SEQ ID NO: 10810 - DNA, 22 bp, synthetic construct
  misc_feature 1..22: note = Description of Artificial Sequence: Syntheticoligonucleotide
  source 1..22: mol_type = other DNA
cgtggactcgtacgagtccacg

SEQ ID NO: 10811 - DNA, 22 bp, synthetic construct
  misc_feature 1..22: note = Description of Artificial Sequence: Syntheticoligonucleotide
  source 1..22: mol_type = other DNA
caccgactcgtacgagtcggtg

SEQ ID NO: 10812 - DNA, 22 bp, synthetic construct
  misc_feature 1..22: note = Description of Artificial Sequence: Syntheticoligonucleotide
  source 1..22: mol_type = other DNA
ctccgactcgtacgagtcggag

SEQ ID NO: 10813 - DNA, 22 bp, synthetic construct
  misc_feature 1..22: note = Description of Artificial Sequence: Syntheticoligonucleotide
  source 1..22: mol_type = other DNA
gcgggactcgtacgagtcccgc

SEQ ID NO: 10814 - DNA, 22 bp, synthetic construct
  misc_feature 1..22: note = Description of Artificial Sequence: Syntheticoligonucleotide
  source 1..22: mol_type = other DNA
gagggactcgtacgagtccctc

SEQ ID NO: 10815 - DNA, 22 bp, synthetic construct
  misc_feature 1..22: note = Description of Artificial Sequence: Syntheticoligonucleotide
  source 1..22: mol_type = other DNA
gtgggactcgtacgagtcccac

SEQ ID NO: 10816 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactcctaggagtcnnnn

SEQ ID NO: 10817 - DNA, 22 bp, synthetic construct
  misc_feature 1..22: note = Description of Artificial Sequence: Syntheticoligonucleotide
  source 1..22: mol_type = other DNA
ggcggactcctaggagtccgcc

SEQ ID NO: 10818 - DNA, 22 bp, synthetic construct
  misc_feature 1..22: note = Description of Artificial Sequence: Syntheticoligonucleotide
  source 1..22: mol_type = other DNA
agcggactcctaggagtccgct

SEQ ID NO: 10819 - DNA, 22 bp, synthetic construct
  misc_feature 1..22: note = Description of Artificial Sequence: Syntheticoligonucleotide
  source 1..22: mol_type = other DNA
gacggactcctaggagtccgtc

SEQ ID NO: 10820 - DNA, 22 bp, synthetic construct
  misc_feature 1..22: note = Description of Artificial Sequence: Syntheticoligonucleotide
  source 1..22: mol_type = other DNA
ggaggactcctaggagtcctcc

SEQ ID NO: 10821 - DNA, 22 bp, synthetic construct
  misc_feature 1..22: note = Description of Artificial Sequence: Syntheticoligonucleotide
  source 1..22: mol_type = other DNA
ggcagactcctaggagtctgcc

SEQ ID NO: 10822 - DNA, 22 bp, synthetic construct
  misc_feature 1..22: note = Description of Artificial Sequence: Syntheticoligonucleotide
  source 1..22: mol_type = other DNA
tgcggactcctaggagtccgca

SEQ ID NO: 10823 - DNA, 22 bp, synthetic construct
  misc_feature 1..22: note = Description of Artificial Sequence: Syntheticoligonucleotide
  source 1..22: mol_type = other DNA
gtcggactcctaggagtccgac

SEQ ID NO: 10824 - DNA, 22 bp, synthetic construct
  misc_feature 1..22: note = Description of Artificial Sequence: Syntheticoligonucleotide
  source 1..22: mol_type = other DNA
ggtggactcctaggagtccacc

SEQ ID NO: 10825 - DNA, 22 bp, synthetic construct
  misc_feature 1..22: note = Description of Artificial Sequence: Syntheticoligonucleotide
  source 1..22: mol_type = other DNA
ggctgactcctaggagtcagcc

SEQ ID NO: 10826 - DNA, 22 bp, synthetic construct
  misc_feature 1..22: note = Description of Artificial Sequence: Syntheticoligonucleotide
  source 1..22: mol_type = other DNA
gcccgactcctaggagtcgggc

SEQ ID NO: 10827 - DNA, 22 bp, synthetic construct
  misc_feature 1..22: note = Description of Artificial Sequence: Syntheticoligonucleotide
  source 1..22: mol_type = other DNA
acccgactcctaggagtcgggt

SEQ ID NO: 10828 - DNA, 22 bp, synthetic construct
  misc_feature 1..22: note = Description of Artificial Sequence: Syntheticoligonucleotide
  source 1..22: mol_type = other DNA
gaccgactcctaggagtcggtc

SEQ ID NO: 10829 - DNA, 22 bp, synthetic construct
  misc_feature 1..22: note = Description of Artificial Sequence: Syntheticoligonucleotide
  source 1..22: mol_type = other DNA
gcacgactcctaggagtcgtgc

SEQ ID NO: 10830 - DNA, 22 bp, synthetic construct
  misc_feature 1..22: note = Description of Artificial Sequence: Syntheticoligonucleotide
  source 1..22: mol_type = other DNA
gccagactcctaggagtctggc

SEQ ID NO: 10831 - DNA, 22 bp, synthetic construct
  misc_feature 1..22: note = Description of Artificial Sequence: Syntheticoligonucleotide
  source 1..22: mol_type = other DNA
tcccgactcctaggagtcggga

SEQ ID NO: 10832 - DNA, 22 bp, synthetic construct
  misc_feature 1..22: note = Description of Artificial Sequence: Syntheticoligonucleotide
  source 1..22: mol_type = other DNA
gtccgactcctaggagtcggac

SEQ ID NO: 10833 - DNA, 22 bp, synthetic construct
  misc_feature 1..22: note = Description of Artificial Sequence: Syntheticoligonucleotide
  source 1..22: mol_type = other DNA
gcctgactcctaggagtcaggc

SEQ ID NO: 10834 - DNA, 22 bp, synthetic construct
  misc_feature 1..22: note = Description of Artificial Sequence: Syntheticoligonucleotide
  source 1..22: mol_type = other DNA
gggcgactcctaggagtcgccc

SEQ ID NO: 10835 - DNA, 22 bp, synthetic construct
  misc_feature 1..22: note = Description of Artificial Sequence: Syntheticoligonucleotide
  source 1..22: mol_type = other DNA
aggcgactcctaggagtcgcct

SEQ ID NO: 10836 - DNA, 22 bp, synthetic construct
  misc_feature 1..22: note = Description of Artificial Sequence: Syntheticoligonucleotide
  source 1..22: mol_type = other DNA
gagcgactcctaggagtcgctc

SEQ ID NO: 10837 - DNA, 22 bp, synthetic construct
  misc_feature 1..22: note = Description of Artificial Sequence: Syntheticoligonucleotide
  source 1..22: mol_type = other DNA
ggacgactcctaggagtcgtcc

SEQ ID NO: 10838 - DNA, 22 bp, synthetic construct
  misc_feature 1..22: note = Description of Artificial Sequence: Syntheticoligonucleotide
  source 1..22: mol_type = other DNA
gggagactcctaggagtctccc

SEQ ID NO: 10839 - DNA, 22 bp, synthetic construct
  misc_feature 1..22: note = Description of Artificial Sequence: Syntheticoligonucleotide
  source 1..22: mol_type = other DNA
tggcgactcctaggagtcgcca

SEQ ID NO: 10840 - DNA, 22 bp, synthetic construct
  misc_feature 1..22: note = Description of Artificial Sequence: Syntheticoligonucleotide
  source 1..22: mol_type = other DNA
gtgcgactcctaggagtcgcac

SEQ ID NO: 10841 - DNA, 22 bp, synthetic construct
  misc_feature 1..22: note = Description of Artificial Sequence: Syntheticoligonucleotide
  source 1..22: mol_type = other DNA
gggtgactcctaggagtcaccc

SEQ ID NO: 10842 - DNA, 22 bp, synthetic construct
  misc_feature 1..22: note = Description of Artificial Sequence: Syntheticoligonucleotide
  source 1..22: mol_type = other DNA
acgggactcctaggagtcccgt

SEQ ID NO: 10843 - DNA, 22 bp, synthetic construct
  misc_feature 1..22: note = Description of Artificial Sequence: Syntheticoligonucleotide
  source 1..22: mol_type = other DNA
cagggactcctaggagtccctg

SEQ ID NO: 10844 - DNA, 22 bp, synthetic construct
  misc_feature 1..22: note = Description of Artificial Sequence: Syntheticoligonucleotide
  source 1..22: mol_type = other DNA
ccaggactcctaggagtcctgg

SEQ ID NO: 10845 - DNA, 22 bp, synthetic construct
  misc_feature 1..22: note = Description of Artificial Sequence: Syntheticoligonucleotide
  source 1..22: mol_type = other DNA
ccgagactcctaggagtctcgg

SEQ ID NO: 10846 - DNA, 22 bp, synthetic construct
  misc_feature 1..22: note = Description of Artificial Sequence: Syntheticoligonucleotide
  source 1..22: mol_type = other DNA
tcgggactcctaggagtcccga

SEQ ID NO: 10847 - DNA, 22 bp, synthetic construct
  misc_feature 1..22: note = Description of Artificial Sequence: Syntheticoligonucleotide
  source 1..22: mol_type = other DNA
ctgggactcctaggagtcccag

SEQ ID NO: 10848 - DNA, 22 bp, synthetic construct
  misc_feature 1..22: note = Description of Artificial Sequence: Syntheticoligonucleotide
  source 1..22: mol_type = other DNA
cctggactcctaggagtccagg

SEQ ID NO: 10849 - DNA, 22 bp, synthetic construct
  misc_feature 1..22: note = Description of Artificial Sequence: Syntheticoligonucleotide
  source 1..22: mol_type = other DNA
ccgtgactcctaggagtcacgg

SEQ ID NO: 10850 - DNA, 22 bp, synthetic construct
  misc_feature 1..22: note = Description of Artificial Sequence: Syntheticoligonucleotide
  source 1..22: mol_type = other DNA
cggcgactcctaggagtcgccg

SEQ ID NO: 10851 - DNA, 22 bp, synthetic construct
  misc_feature 1..22: note = Description of Artificial Sequence: Syntheticoligonucleotide
  source 1..22: mol_type = other DNA
cagcgactcctaggagtcgctg

SEQ ID NO: 10852 - DNA, 22 bp, synthetic construct
  misc_feature 1..22: note = Description of Artificial Sequence: Syntheticoligonucleotide
  source 1..22: mol_type = other DNA
cgacgactcctaggagtcgtcg

SEQ ID NO: 10853 - DNA, 22 bp, synthetic construct
  misc_feature 1..22: note = Description of Artificial Sequence: Syntheticoligonucleotide
  source 1..22: mol_type = other DNA
cggagactcctaggagtctccg

SEQ ID NO: 10854 - DNA, 22 bp, synthetic construct
  misc_feature 1..22: note = Description of Artificial Sequence: Syntheticoligonucleotide
  source 1..22: mol_type = other DNA
ctgcgactcctaggagtcgcag

SEQ ID NO: 10855 - DNA, 22 bp, synthetic construct
  misc_feature 1..22: note = Description of Artificial Sequence: Syntheticoligonucleotide
  source 1..22: mol_type = other DNA
cggtgactcctaggagtcaccg

SEQ ID NO: 10856 - DNA, 22 bp, synthetic construct
  misc_feature 1..22: note = Description of Artificial Sequence: Syntheticoligonucleotide
  source 1..22: mol_type = other DNA
cacggactcctaggagtccgtg

SEQ ID NO: 10857 - DNA, 22 bp, synthetic construct
  misc_feature 1..22: note = Description of Artificial Sequence: Syntheticoligonucleotide
  source 1..22: mol_type = other DNA
cccagactcctaggagtctggg

SEQ ID NO: 10858 - DNA, 22 bp, synthetic construct
  misc_feature 1..22: note = Description of Artificial Sequence: Syntheticoligonucleotide
  source 1..22: mol_type = other DNA
ctcggactcctaggagtccgag

SEQ ID NO: 10859 - DNA, 22 bp, synthetic construct
  misc_feature 1..22: note = Description of Artificial Sequence: Syntheticoligonucleotide
  source 1..22: mol_type = other DNA
ccctgactcctaggagtcaggg

SEQ ID NO: 10860 - DNA, 22 bp, synthetic construct
  misc_feature 1..22: note = Description of Artificial Sequence: Syntheticoligonucleotide
  source 1..22: mol_type = other DNA
ccacgactcctaggagtcgtgg

SEQ ID NO: 10861 - DNA, 22 bp, synthetic construct
  misc_feature 1..22: note = Description of Artificial Sequence: Syntheticoligonucleotide
  source 1..22: mol_type = other DNA
agccgactcctaggagtcggct

SEQ ID NO: 10862 - DNA, 22 bp, synthetic construct
  misc_feature 1..22: note = Description of Artificial Sequence: Syntheticoligonucleotide
  source 1..22: mol_type = other DNA
tgccgactcctaggagtcggca

SEQ ID NO: 10863 - DNA, 22 bp, synthetic construct
  misc_feature 1..22: note = Description of Artificial Sequence: Syntheticoligonucleotide
  source 1..22: mol_type = other DNA
gcgagactcctaggagtctcgc

SEQ ID NO: 10864 - DNA, 22 bp, synthetic construct
  misc_feature 1..22: note = Description of Artificial Sequence: Syntheticoligonucleotide
  source 1..22: mol_type = other DNA
gcgtgactcctaggagtcacgc

SEQ ID NO: 10865 - DNA, 22 bp, synthetic construct
  misc_feature 1..22: note = Description of Artificial Sequence: Syntheticoligonucleotide
  source 1..22: mol_type = other DNA
gcaggactcctaggagtcctgc

SEQ ID NO: 10866 - DNA, 22 bp, synthetic construct
  misc_feature 1..22: note = Description of Artificial Sequence: Syntheticoligonucleotide
  source 1..22: mol_type = other DNA
gctggactcctaggagtccagc

SEQ ID NO: 10867 - DNA, 22 bp, synthetic construct
  misc_feature 1..22: note = Description of Artificial Sequence: Syntheticoligonucleotide
  source 1..22: mol_type = other DNA
cgaggactcctaggagtcctcg

SEQ ID NO: 10868 - DNA, 22 bp, synthetic construct
  misc_feature 1..22: note = Description of Artificial Sequence: Syntheticoligonucleotide
  source 1..22: mol_type = other DNA
cgtggactcctaggagtccacg

SEQ ID NO: 10869 - DNA, 22 bp, synthetic construct
  misc_feature 1..22: note = Description of Artificial Sequence: Syntheticoligonucleotide
  source 1..22: mol_type = other DNA
caccgactcctaggagtcggtg

SEQ ID NO: 10870 - DNA, 22 bp, synthetic construct
  misc_feature 1..22: note = Description of Artificial Sequence: Syntheticoligonucleotide
  source 1..22: mol_type = other DNA
ctccgactcctaggagtcggag

SEQ ID NO: 10871 - DNA, 22 bp, synthetic construct
  misc_feature 1..22: note = Description of Artificial Sequence: Syntheticoligonucleotide
  source 1..22: mol_type = other DNA
gcgggactcctaggagtcccgc

SEQ ID NO: 10872 - DNA, 22 bp, synthetic construct
  misc_feature 1..22: note = Description of Artificial Sequence: Syntheticoligonucleotide
  source 1..22: mol_type = other DNA
gagggactcctaggagtccctc

SEQ ID NO: 10873 - DNA, 22 bp, synthetic construct
  misc_feature 1..22: note = Description of Artificial Sequence: Syntheticoligonucleotide
  source 1..22: mol_type = other DNA
gtgggactcctaggagtcccac

SEQ ID NO: 10874 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactccatggagtcnnnn

SEQ ID NO: 10875 - DNA, 22 bp, synthetic construct
  misc_feature 1..22: note = Description of Artificial Sequence: Syntheticoligonucleotide
  source 1..22: mol_type = other DNA
ggcggactccatggagtccgcc

SEQ ID NO: 10876 - DNA, 22 bp, synthetic construct
  misc_feature 1..22: note = Description of Artificial Sequence: Syntheticoligonucleotide
  source 1..22: mol_type = other DNA
agcggactccatggagtccgct

SEQ ID NO: 10877 - DNA, 22 bp, synthetic construct
  misc_feature 1..22: note = Description of Artificial Sequence: Syntheticoligonucleotide
  source 1..22: mol_type = other DNA
gacggactccatggagtccgtc

SEQ ID NO: 10878 - DNA, 22 bp, synthetic construct
  misc_feature 1..22: note = Description of Artificial Sequence: Syntheticoligonucleotide
  source 1..22: mol_type = other DNA
ggaggactccatggagtcctcc

SEQ ID NO: 10879 - DNA, 22 bp, synthetic construct
  misc_feature 1..22: note = Description of Artificial Sequence: Syntheticoligonucleotide
  source 1..22: mol_type = other DNA
ggcagactccatggagtctgcc

SEQ ID NO: 10880 - DNA, 22 bp, synthetic construct
  misc_feature 1..22: note = Description of Artificial Sequence: Syntheticoligonucleotide
  source 1..22: mol_type = other DNA
tgcggactccatggagtccgca

SEQ ID NO: 10881 - DNA, 22 bp, synthetic construct
  misc_feature 1..22: note = Description of Artificial Sequence: Syntheticoligonucleotide
  source 1..22: mol_type = other DNA
gtcggactccatggagtccgac

SEQ ID NO: 10882 - DNA, 22 bp, synthetic construct
  misc_feature 1..22: note = Description of Artificial Sequence: Syntheticoligonucleotide
  source 1..22: mol_type = other DNA
ggtggactccatggagtccacc

SEQ ID NO: 10883 - DNA, 22 bp, synthetic construct
  misc_feature 1..22: note = Description of Artificial Sequence: Syntheticoligonucleotide
  source 1..22: mol_type = other DNA
ggctgactccatggagtcagcc

SEQ ID NO: 10884 - DNA, 22 bp, synthetic construct
  misc_feature 1..22: note = Description of Artificial Sequence: Syntheticoligonucleotide
  source 1..22: mol_type = other DNA
gcccgactccatggagtcgggc

SEQ ID NO: 10885 - DNA, 22 bp, synthetic construct
  misc_feature 1..22: note = Description of Artificial Sequence: Syntheticoligonucleotide
  source 1..22: mol_type = other DNA
acccgactccatggagtcgggt

SEQ ID NO: 10886 - DNA, 22 bp, synthetic construct
  misc_feature 1..22: note = Description of Artificial Sequence: Syntheticoligonucleotide
  source 1..22: mol_type = other DNA
gaccgactccatggagtcggtc

SEQ ID NO: 10887 - DNA, 22 bp, synthetic construct
  misc_feature 1..22: note = Description of Artificial Sequence: Syntheticoligonucleotide
  source 1..22: mol_type = other DNA
gcacgactccatggagtcgtgc

SEQ ID NO: 10888 - DNA, 22 bp, synthetic construct
  misc_feature 1..22: note = Description of Artificial Sequence: Syntheticoligonucleotide
  source 1..22: mol_type = other DNA
gccagactccatggagtctggc

SEQ ID NO: 10889 - DNA, 22 bp, synthetic construct
  misc_feature 1..22: note = Description of Artificial Sequence: Syntheticoligonucleotide
  source 1..22: mol_type = other DNA
tcccgactccatggagtcggga

SEQ ID NO: 10890 - DNA, 22 bp, synthetic construct
  misc_feature 1..22: note = Description of Artificial Sequence: Syntheticoligonucleotide
  source 1..22: mol_type = other DNA
gtccgactccatggagtcggac

SEQ ID NO: 10891 - DNA, 22 bp, synthetic construct
  misc_feature 1..22: note = Description of Artificial Sequence: Syntheticoligonucleotide
  source 1..22: mol_type = other DNA
gcctgactccatggagtcaggc

SEQ ID NO: 10892 - DNA, 22 bp, synthetic construct
  misc_feature 1..22: note = Description of Artificial Sequence: Syntheticoligonucleotide
  source 1..22: mol_type = other DNA
gggcgactccatggagtcgccc

SEQ ID NO: 10893 - DNA, 22 bp, synthetic construct
  misc_feature 1..22: note = Description of Artificial Sequence: Syntheticoligonucleotide
  source 1..22: mol_type = other DNA
aggcgactccatggagtcgcct

SEQ ID NO: 10894 - DNA, 22 bp, synthetic construct
  misc_feature 1..22: note = Description of Artificial Sequence: Syntheticoligonucleotide
  source 1..22: mol_type = other DNA
gagcgactccatggagtcgctc

SEQ ID NO: 10895 - DNA, 22 bp, synthetic construct
  misc_feature 1..22: note = Description of Artificial Sequence: Syntheticoligonucleotide
  source 1..22: mol_type = other DNA
ggacgactccatggagtcgtcc

SEQ ID NO: 10896 - DNA, 22 bp, synthetic construct
  misc_feature 1..22: note = Description of Artificial Sequence: Syntheticoligonucleotide
  source 1..22: mol_type = other DNA
gggagactccatggagtctccc

SEQ ID NO: 10897 - DNA, 22 bp, synthetic construct
  misc_feature 1..22: note = Description of Artificial Sequence: Syntheticoligonucleotide
  source 1..22: mol_type = other DNA
tggcgactccatggagtcgcca

SEQ ID NO: 10898 - DNA, 22 bp, synthetic construct
  misc_feature 1..22: note = Description of Artificial Sequence: Syntheticoligonucleotide
  source 1..22: mol_type = other DNA
gtgcgactccatggagtcgcac

SEQ ID NO: 10899 - DNA, 22 bp, synthetic construct
  misc_feature 1..22: note = Description of Artificial Sequence: Syntheticoligonucleotide
  source 1..22: mol_type = other DNA
gggtgactccatggagtcaccc

SEQ ID NO: 10900 - DNA, 22 bp, synthetic construct
  misc_feature 1..22: note = Description of Artificial Sequence: Syntheticoligonucleotide
  source 1..22: mol_type = other DNA
acgggactccatggagtcccgt

SEQ ID NO: 10901 - DNA, 22 bp, synthetic construct
  misc_feature 1..22: note = Description of Artificial Sequence: Syntheticoligonucleotide
  source 1..22: mol_type = other DNA
cagggactccatggagtccctg

SEQ ID NO: 10902 - DNA, 22 bp, synthetic construct
  misc_feature 1..22: note = Description of Artificial Sequence: Syntheticoligonucleotide
  source 1..22: mol_type = other DNA
ccaggactccatggagtcctgg

SEQ ID NO: 10903 - DNA, 22 bp, synthetic construct
  misc_feature 1..22: note = Description of Artificial Sequence: Syntheticoligonucleotide
  source 1..22: mol_type = other DNA
ccgagactccatggagtctcgg

SEQ ID NO: 10904 - DNA, 22 bp, synthetic construct
  misc_feature 1..22: note = Description of Artificial Sequence: Syntheticoligonucleotide
  source 1..22: mol_type = other DNA
tcgggactccatggagtcccga

SEQ ID NO: 10905 - DNA, 22 bp, synthetic construct
  misc_feature 1..22: note = Description of Artificial Sequence: Syntheticoligonucleotide
  source 1..22: mol_type = other DNA
ctgggactccatggagtcccag

SEQ ID NO: 10906 - DNA, 22 bp, synthetic construct
  misc_feature 1..22: note = Description of Artificial Sequence: Syntheticoligonucleotide
  source 1..22: mol_type = other DNA
cctggactccatggagtccagg

SEQ ID NO: 10907 - DNA, 22 bp, synthetic construct
  misc_feature 1..22: note = Description of Artificial Sequence: Syntheticoligonucleotide
  source 1..22: mol_type = other DNA
ccgtgactccatggagtcacgg

SEQ ID NO: 10908 - DNA, 22 bp, synthetic construct
  misc_feature 1..22: note = Description of Artificial Sequence: Syntheticoligonucleotide
  source 1..22: mol_type = other DNA
cggcgactccatggagtcgccg

SEQ ID NO: 10909 - DNA, 22 bp, synthetic construct
  misc_feature 1..22: note = Description of Artificial Sequence: Syntheticoligonucleotide
  source 1..22: mol_type = other DNA
cagcgactccatggagtcgctg

SEQ ID NO: 10910 - DNA, 22 bp, synthetic construct
  misc_feature 1..22: note = Description of Artificial Sequence: Syntheticoligonucleotide
  source 1..22: mol_type = other DNA
cgacgactccatggagtcgtcg

SEQ ID NO: 10911 - DNA, 22 bp, synthetic construct
  misc_feature 1..22: note = Description of Artificial Sequence: Syntheticoligonucleotide
  source 1..22: mol_type = other DNA
cggagactccatggagtctccg

SEQ ID NO: 10912 - DNA, 22 bp, synthetic construct
  misc_feature 1..22: note = Description of Artificial Sequence: Syntheticoligonucleotide
  source 1..22: mol_type = other DNA
ctgcgactccatggagtcgcag

SEQ ID NO: 10913 - DNA, 22 bp, synthetic construct
  misc_feature 1..22: note = Description of Artificial Sequence: Syntheticoligonucleotide
  source 1..22: mol_type = other DNA
cggtgactccatggagtcaccg

SEQ ID NO: 10914 - DNA, 22 bp, synthetic construct
  misc_feature 1..22: note = Description of Artificial Sequence: Syntheticoligonucleotide
  source 1..22: mol_type = other DNA
cacggactccatggagtccgtg

SEQ ID NO: 10915 - DNA, 22 bp, synthetic construct
  misc_feature 1..22: note = Description of Artificial Sequence: Syntheticoligonucleotide
  source 1..22: mol_type = other DNA
cccagactccatggagtctggg

SEQ ID NO: 10916 - DNA, 22 bp, synthetic construct
  misc_feature 1..22: note = Description of Artificial Sequence: Syntheticoligonucleotide
  source 1..22: mol_type = other DNA
ctcggactccatggagtccgag

SEQ ID NO: 10917 - DNA, 22 bp, synthetic construct
  misc_feature 1..22: note = Description of Artificial Sequence: Syntheticoligonucleotide
  source 1..22: mol_type = other DNA
ccctgactccatggagtcaggg

SEQ ID NO: 10918 - DNA, 22 bp, synthetic construct
  misc_feature 1..22: note = Description of Artificial Sequence: Syntheticoligonucleotide
  source 1..22: mol_type = other DNA
ccacgactccatggagtcgtgg

SEQ ID NO: 10919 - DNA, 22 bp, synthetic construct
  misc_feature 1..22: note = Description of Artificial Sequence: Syntheticoligonucleotide
  source 1..22: mol_type = other DNA
agccgactccatggagtcggct

SEQ ID NO: 10920 - DNA, 22 bp, synthetic construct
  misc_feature 1..22: note = Description of Artificial Sequence: Syntheticoligonucleotide
  source 1..22: mol_type = other DNA
tgccgactccatggagtcggca

SEQ ID NO: 10921 - DNA, 22 bp, synthetic construct
  misc_feature 1..22: note = Description of Artificial Sequence: Syntheticoligonucleotide
  source 1..22: mol_type = other DNA
gcgagactccatggagtctcgc

SEQ ID NO: 10922 - DNA, 22 bp, synthetic construct
  misc_feature 1..22: note = Description of Artificial Sequence: Syntheticoligonucleotide
  source 1..22: mol_type = other DNA
gcgtgactccatggagtcacgc

SEQ ID NO: 10923 - DNA, 22 bp, synthetic construct
  misc_feature 1..22: note = Description of Artificial Sequence: Syntheticoligonucleotide
  source 1..22: mol_type = other DNA
gcaggactccatggagtcctgc

SEQ ID NO: 10924 - DNA, 22 bp, synthetic construct
  misc_feature 1..22: note = Description of Artificial Sequence: Syntheticoligonucleotide
  source 1..22: mol_type = other DNA
gctggactccatggagtccagc

SEQ ID NO: 10925 - DNA, 22 bp, synthetic construct
  misc_feature 1..22: note = Description of Artificial Sequence: Syntheticoligonucleotide
  source 1..22: mol_type = other DNA
cgaggactccatggagtcctcg

SEQ ID NO: 10926 - DNA, 22 bp, synthetic construct
  misc_feature 1..22: note = Description of Artificial Sequence: Syntheticoligonucleotide
  source 1..22: mol_type = other DNA
cgtggactccatggagtccacg

SEQ ID NO: 10927 - DNA, 22 bp, synthetic construct
  misc_feature 1..22: note = Description of Artificial Sequence: Syntheticoligonucleotide
  source 1..22: mol_type = other DNA
caccgactccatggagtcggtg

SEQ ID NO: 10928 - DNA, 22 bp, synthetic construct
  misc_feature 1..22: note = Description of Artificial Sequence: Syntheticoligonucleotide
  source 1..22: mol_type = other DNA
ctccgactccatggagtcggag

SEQ ID NO: 10929 - DNA, 22 bp, synthetic construct
  misc_feature 1..22: note = Description of Artificial Sequence: Syntheticoligonucleotide
  source 1..22: mol_type = other DNA
gcgggactccatggagtcccgc

SEQ ID NO: 10930 - DNA, 22 bp, synthetic construct
  misc_feature 1..22: note = Description of Artificial Sequence: Syntheticoligonucleotide
  source 1..22: mol_type = other DNA
gagggactccatggagtccctc

SEQ ID NO: 10931 - DNA, 22 bp, synthetic construct
  misc_feature 1..22: note = Description of Artificial Sequence: Syntheticoligonucleotide
  source 1..22: mol_type = other DNA
gtgggactccatggagtcccac

SEQ ID NO: 10932 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactctcgagagtcnnnn

SEQ ID NO: 10933 - DNA, 22 bp, synthetic construct
  misc_feature 1..22: note = Description of Artificial Sequence: Syntheticoligonucleotide
  source 1..22: mol_type = other DNA
ggcggactctcgagagtccgcc

SEQ ID NO: 10934 - DNA, 22 bp, synthetic construct
  misc_feature 1..22: note = Description of Artificial Sequence: Syntheticoligonucleotide
  source 1..22: mol_type = other DNA
agcggactctcgagagtccgct

SEQ ID NO: 10935 - DNA, 22 bp, synthetic construct
  misc_feature 1..22: note = Description of Artificial Sequence: Syntheticoligonucleotide
  source 1..22: mol_type = other DNA
gacggactctcgagagtccgtc

SEQ ID NO: 10936 - DNA, 22 bp, synthetic construct
  misc_feature 1..22: note = Description of Artificial Sequence: Syntheticoligonucleotide
  source 1..22: mol_type = other DNA
ggaggactctcgagagtcctcc

SEQ ID NO: 10937 - DNA, 22 bp, synthetic construct
  misc_feature 1..22: note = Description of Artificial Sequence: Syntheticoligonucleotide
  source 1..22: mol_type = other DNA
ggcagactctcgagagtctgcc

SEQ ID NO: 10938 - DNA, 22 bp, synthetic construct
  misc_feature 1..22: note = Description of Artificial Sequence: Syntheticoligonucleotide
  source 1..22: mol_type = other DNA
tgcggactctcgagagtccgca

SEQ ID NO: 10939 - DNA, 22 bp, synthetic construct
  misc_feature 1..22: note = Description of Artificial Sequence: Syntheticoligonucleotide
  source 1..22: mol_type = other DNA
gtcggactctcgagagtccgac

SEQ ID NO: 10940 - DNA, 22 bp, synthetic construct
  misc_feature 1..22: note = Description of Artificial Sequence: Syntheticoligonucleotide
  source 1..22: mol_type = other DNA
ggtggactctcgagagtccacc

SEQ ID NO: 10941 - DNA, 22 bp, synthetic construct
  misc_feature 1..22: note = Description of Artificial Sequence: Syntheticoligonucleotide
  source 1..22: mol_type = other DNA
ggctgactctcgagagtcagcc

SEQ ID NO: 10942 - DNA, 22 bp, synthetic construct
  misc_feature 1..22: note = Description of Artificial Sequence: Syntheticoligonucleotide
  source 1..22: mol_type = other DNA
gcccgactctcgagagtcgggc

SEQ ID NO: 10943 - DNA, 22 bp, synthetic construct
  misc_feature 1..22: note = Description of Artificial Sequence: Syntheticoligonucleotide
  source 1..22: mol_type = other DNA
acccgactctcgagagtcgggt

SEQ ID NO: 10944 - DNA, 22 bp, synthetic construct
  misc_feature 1..22: note = Description of Artificial Sequence: Syntheticoligonucleotide
  source 1..22: mol_type = other DNA
gaccgactctcgagagtcggtc

SEQ ID NO: 10945 - DNA, 22 bp, synthetic construct
  misc_feature 1..22: note = Description of Artificial Sequence: Syntheticoligonucleotide
  source 1..22: mol_type = other DNA
gcacgactctcgagagtcgtgc

SEQ ID NO: 10946 - DNA, 22 bp, synthetic construct
  misc_feature 1..22: note = Description of Artificial Sequence: Syntheticoligonucleotide
  source 1..22: mol_type = other DNA
gccagactctcgagagtctggc

SEQ ID NO: 10947 - DNA, 22 bp, synthetic construct
  misc_feature 1..22: note = Description of Artificial Sequence: Syntheticoligonucleotide
  source 1..22: mol_type = other DNA
tcccgactctcgagagtcggga

SEQ ID NO: 10948 - DNA, 22 bp, synthetic construct
  misc_feature 1..22: note = Description of Artificial Sequence: Syntheticoligonucleotide
  source 1..22: mol_type = other DNA
gtccgactctcgagagtcggac

SEQ ID NO: 10949 - DNA, 22 bp, synthetic construct
  misc_feature 1..22: note = Description of Artificial Sequence: Syntheticoligonucleotide
  source 1..22: mol_type = other DNA
gcctgactctcgagagtcaggc

SEQ ID NO: 10950 - DNA, 22 bp, synthetic construct
  misc_feature 1..22: note = Description of Artificial Sequence: Syntheticoligonucleotide
  source 1..22: mol_type = other DNA
gggcgactctcgagagtcgccc

SEQ ID NO: 10951 - DNA, 22 bp, synthetic construct
  misc_feature 1..22: note = Description of Artificial Sequence: Syntheticoligonucleotide
  source 1..22: mol_type = other DNA
aggcgactctcgagagtcgcct

SEQ ID NO: 10952 - DNA, 22 bp, synthetic construct
  misc_feature 1..22: note = Description of Artificial Sequence: Syntheticoligonucleotide
  source 1..22: mol_type = other DNA
gagcgactctcgagagtcgctc

SEQ ID NO: 10953 - DNA, 22 bp, synthetic construct
  misc_feature 1..22: note = Description of Artificial Sequence: Syntheticoligonucleotide
  source 1..22: mol_type = other DNA
ggacgactctcgagagtcgtcc

SEQ ID NO: 10954 - DNA, 22 bp, synthetic construct
  misc_feature 1..22: note = Description of Artificial Sequence: Syntheticoligonucleotide
  source 1..22: mol_type = other DNA
gggagactctcgagagtctccc

SEQ ID NO: 10955 - DNA, 22 bp, synthetic construct
  misc_feature 1..22: note = Description of Artificial Sequence: Syntheticoligonucleotide
  source 1..22: mol_type = other DNA
tggcgactctcgagagtcgcca

SEQ ID NO: 10956 - DNA, 22 bp, synthetic construct
  misc_feature 1..22: note = Description of Artificial Sequence: Syntheticoligonucleotide
  source 1..22: mol_type = other DNA
gtgcgactctcgagagtcgcac

SEQ ID NO: 10957 - DNA, 22 bp, synthetic construct
  misc_feature 1..22: note = Description of Artificial Sequence: Syntheticoligonucleotide
  source 1..22: mol_type = other DNA
gggtgactctcgagagtcaccc

SEQ ID NO: 10958 - DNA, 22 bp, synthetic construct
  misc_feature 1..22: note = Description of Artificial Sequence: Syntheticoligonucleotide
  source 1..22: mol_type = other DNA
acgggactctcgagagtcccgt

SEQ ID NO: 10959 - DNA, 22 bp, synthetic construct
  misc_feature 1..22: note = Description of Artificial Sequence: Syntheticoligonucleotide
  source 1..22: mol_type = other DNA
cagggactctcgagagtccctg

SEQ ID NO: 10960 - DNA, 22 bp, synthetic construct
  misc_feature 1..22: note = Description of Artificial Sequence: Syntheticoligonucleotide
  source 1..22: mol_type = other DNA
ccaggactctcgagagtcctgg

SEQ ID NO: 10961 - DNA, 22 bp, synthetic construct
  misc_feature 1..22: note = Description of Artificial Sequence: Syntheticoligonucleotide
  source 1..22: mol_type = other DNA
ccgagactctcgagagtctcgg

SEQ ID NO: 10962 - DNA, 22 bp, synthetic construct
  misc_feature 1..22: note = Description of Artificial Sequence: Syntheticoligonucleotide
  source 1..22: mol_type = other DNA
tcgggactctcgagagtcccga

SEQ ID NO: 10963 - DNA, 22 bp, synthetic construct
  misc_feature 1..22: note = Description of Artificial Sequence: Syntheticoligonucleotide
  source 1..22: mol_type = other DNA
ctgggactctcgagagtcccag

SEQ ID NO: 10964 - DNA, 22 bp, synthetic construct
  misc_feature 1..22: note = Description of Artificial Sequence: Syntheticoligonucleotide
  source 1..22: mol_type = other DNA
cctggactctcgagagtccagg

SEQ ID NO: 10965 - DNA, 22 bp, synthetic construct
  misc_feature 1..22: note = Description of Artificial Sequence: Syntheticoligonucleotide
  source 1..22: mol_type = other DNA
ccgtgactctcgagagtcacgg

SEQ ID NO: 10966 - DNA, 22 bp, synthetic construct
  misc_feature 1..22: note = Description of Artificial Sequence: Syntheticoligonucleotide
  source 1..22: mol_type = other DNA
cggcgactctcgagagtcgccg

SEQ ID NO: 10967 - DNA, 22 bp, synthetic construct
  misc_feature 1..22: note = Description of Artificial Sequence: Syntheticoligonucleotide
  source 1..22: mol_type = other DNA
cagcgactctcgagagtcgctg

SEQ ID NO: 10968 - DNA, 22 bp, synthetic construct
  misc_feature 1..22: note = Description of Artificial Sequence: Syntheticoligonucleotide
  source 1..22: mol_type = other DNA
cgacgactctcgagagtcgtcg

SEQ ID NO: 10969 - DNA, 22 bp, synthetic construct
  misc_feature 1..22: note = Description of Artificial Sequence: Syntheticoligonucleotide
  source 1..22: mol_type = other DNA
cggagactctcgagagtctccg

SEQ ID NO: 10970 - DNA, 22 bp, synthetic construct
  misc_feature 1..22: note = Description of Artificial Sequence: Syntheticoligonucleotide
  source 1..22: mol_type = other DNA
ctgcgactctcgagagtcgcag

SEQ ID NO: 10971 - DNA, 22 bp, synthetic construct
  misc_feature 1..22: note = Description of Artificial Sequence: Syntheticoligonucleotide
  source 1..22: mol_type = other DNA
cggtgactctcgagagtcaccg

SEQ ID NO: 10972 - DNA, 22 bp, synthetic construct
  misc_feature 1..22: note = Description of Artificial Sequence: Syntheticoligonucleotide
  source 1..22: mol_type = other DNA
cacggactctcgagagtccgtg

SEQ ID NO: 10973 - DNA, 22 bp, synthetic construct
  misc_feature 1..22: note = Description of Artificial Sequence: Syntheticoligonucleotide
  source 1..22: mol_type = other DNA
cccagactctcgagagtctggg

SEQ ID NO: 10974 - DNA, 22 bp, synthetic construct
  misc_feature 1..22: note = Description of Artificial Sequence: Syntheticoligonucleotide
  source 1..22: mol_type = other DNA
ctcggactctcgagagtccgag

SEQ ID NO: 10975 - DNA, 22 bp, synthetic construct
  misc_feature 1..22: note = Description of Artificial Sequence: Syntheticoligonucleotide
  source 1..22: mol_type = other DNA
ccctgactctcgagagtcaggg

SEQ ID NO: 10976 - DNA, 22 bp, synthetic construct
  misc_feature 1..22: note = Description of Artificial Sequence: Syntheticoligonucleotide
  source 1..22: mol_type = other DNA
ccacgactctcgagagtcgtgg

SEQ ID NO: 10977 - DNA, 22 bp, synthetic construct
  misc_feature 1..22: note = Description of Artificial Sequence: Syntheticoligonucleotide
  source 1..22: mol_type = other DNA
agccgactctcgagagtcggct

SEQ ID NO: 10978 - DNA, 22 bp, synthetic construct
  misc_feature 1..22: note = Description of Artificial Sequence: Syntheticoligonucleotide
  source 1..22: mol_type = other DNA
tgccgactctcgagagtcggca

SEQ ID NO: 10979 - DNA, 22 bp, synthetic construct
  misc_feature 1..22: note = Description of Artificial Sequence: Syntheticoligonucleotide
  source 1..22: mol_type = other DNA
gcgagactctcgagagtctcgc

SEQ ID NO: 10980 - DNA, 22 bp, synthetic construct
  misc_feature 1..22: note = Description of Artificial Sequence: Syntheticoligonucleotide
  source 1..22: mol_type = other DNA
gcgtgactctcgagagtcacgc

SEQ ID NO: 10981 - DNA, 22 bp, synthetic construct
  misc_feature 1..22: note = Description of Artificial Sequence: Syntheticoligonucleotide
  source 1..22: mol_type = other DNA
gcaggactctcgagagtcctgc

SEQ ID NO: 10982 - DNA, 22 bp, synthetic construct
  misc_feature 1..22: note = Description of Artificial Sequence: Syntheticoligonucleotide
  source 1..22: mol_type = other DNA
gctggactctcgagagtccagc

SEQ ID NO: 10983 - DNA, 22 bp, synthetic construct
  misc_feature 1..22: note = Description of Artificial Sequence: Syntheticoligonucleotide
  source 1..22: mol_type = other DNA
cgaggactctcgagagtcctcg

SEQ ID NO: 10984 - DNA, 22 bp, synthetic construct
  misc_feature 1..22: note = Description of Artificial Sequence: Syntheticoligonucleotide
  source 1..22: mol_type = other DNA
cgtggactctcgagagtccacg

SEQ ID NO: 10985 - DNA, 22 bp, synthetic construct
  misc_feature 1..22: note = Description of Artificial Sequence: Syntheticoligonucleotide
  source 1..22: mol_type = other DNA
caccgactctcgagagtcggtg

SEQ ID NO: 10986 - DNA, 22 bp, synthetic construct
  misc_feature 1..22: note = Description of Artificial Sequence: Syntheticoligonucleotide
  source 1..22: mol_type = other DNA
ctccgactctcgagagtcggag

SEQ ID NO: 10987 - DNA, 22 bp, synthetic construct
  misc_feature 1..22: note = Description of Artificial Sequence: Syntheticoligonucleotide
  source 1..22: mol_type = other DNA
gcgggactctcgagagtcccgc

SEQ ID NO: 10988 - DNA, 22 bp, synthetic construct
  misc_feature 1..22: note = Description of Artificial Sequence: Syntheticoligonucleotide
  source 1..22: mol_type = other DNA
gagggactctcgagagtccctc

SEQ ID NO: 10989 - DNA, 22 bp, synthetic construct
  misc_feature 1..22: note = Description of Artificial Sequence: Syntheticoligonucleotide
  source 1..22: mol_type = other DNA
gtgggactctcgagagtcccac

SEQ ID NO: 10990 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactcagctgagtcnnnn

SEQ ID NO: 10991 - DNA, 22 bp, synthetic construct
  misc_feature 1..22: note = Description of Artificial Sequence: Syntheticoligonucleotide
  source 1..22: mol_type = other DNA
ggcggactcagctgagtccgcc

SEQ ID NO: 10992 - DNA, 22 bp, synthetic construct
  misc_feature 1..22: note = Description of Artificial Sequence: Syntheticoligonucleotide
  source 1..22: mol_type = other DNA
agcggactcagctgagtccgct

SEQ ID NO: 10993 - DNA, 22 bp, synthetic construct
  misc_feature 1..22: note = Description of Artificial Sequence: Syntheticoligonucleotide
  source 1..22: mol_type = other DNA
gacggactcagctgagtccgtc

SEQ ID NO: 10994 - DNA, 22 bp, synthetic construct
  misc_feature 1..22: note = Description of Artificial Sequence: Syntheticoligonucleotide
  source 1..22: mol_type = other DNA
ggaggactcagctgagtcctcc

SEQ ID NO: 10995 - DNA, 22 bp, synthetic construct
  misc_feature 1..22: note = Description of Artificial Sequence: Syntheticoligonucleotide
  source 1..22: mol_type = other DNA
ggcagactcagctgagtctgcc

SEQ ID NO: 10996 - DNA, 22 bp, synthetic construct
  misc_feature 1..22: note = Description of Artificial Sequence: Syntheticoligonucleotide
  source 1..22: mol_type = other DNA
tgcggactcagctgagtccgca

SEQ ID NO: 10997 - DNA, 22 bp, synthetic construct
  misc_feature 1..22: note = Description of Artificial Sequence: Syntheticoligonucleotide
  source 1..22: mol_type = other DNA
gtcggactcagctgagtccgac

SEQ ID NO: 10998 - DNA, 22 bp, synthetic construct
  misc_feature 1..22: note = Description of Artificial Sequence: Syntheticoligonucleotide
  source 1..22: mol_type = other DNA
ggtggactcagctgagtccacc

SEQ ID NO: 10999 - DNA, 22 bp, synthetic construct
  misc_feature 1..22: note = Description of Artificial Sequence: Syntheticoligonucleotide
  source 1..22: mol_type = other DNA
ggctgactcagctgagtcagcc

SEQ ID NO: 11000 - DNA, 22 bp, synthetic construct
  misc_feature 1..22: note = Description of Artificial Sequence: Syntheticoligonucleotide
  source 1..22: mol_type = other DNA
gcccgactcagctgagtcgggc

SEQ ID NO: 11001 - DNA, 22 bp, synthetic construct
  misc_feature 1..22: note = Description of Artificial Sequence: Syntheticoligonucleotide
  source 1..22: mol_type = other DNA
acccgactcagctgagtcgggt

SEQ ID NO: 11002 - DNA, 22 bp, synthetic construct
  misc_feature 1..22: note = Description of Artificial Sequence: Syntheticoligonucleotide
  source 1..22: mol_type = other DNA
gaccgactcagctgagtcggtc

SEQ ID NO: 11003 - DNA, 22 bp, synthetic construct
  misc_feature 1..22: note = Description of Artificial Sequence: Syntheticoligonucleotide
  source 1..22: mol_type = other DNA
gcacgactcagctgagtcgtgc

SEQ ID NO: 11004 - DNA, 22 bp, synthetic construct
  misc_feature 1..22: note = Description of Artificial Sequence: Syntheticoligonucleotide
  source 1..22: mol_type = other DNA
gccagactcagctgagtctggc

SEQ ID NO: 11005 - DNA, 22 bp, synthetic construct
  misc_feature 1..22: note = Description of Artificial Sequence: Syntheticoligonucleotide
  source 1..22: mol_type = other DNA
tcccgactcagctgagtcggga

SEQ ID NO: 11006 - DNA, 22 bp, synthetic construct
  misc_feature 1..22: note = Description of Artificial Sequence: Syntheticoligonucleotide
  source 1..22: mol_type = other DNA
gtccgactcagctgagtcggac

SEQ ID NO: 11007 - DNA, 22 bp, synthetic construct
  misc_feature 1..22: note = Description of Artificial Sequence: Syntheticoligonucleotide
  source 1..22: mol_type = other DNA
gcctgactcagctgagtcaggc

SEQ ID NO: 11008 - DNA, 22 bp, synthetic construct
  misc_feature 1..22: note = Description of Artificial Sequence: Syntheticoligonucleotide
  source 1..22: mol_type = other DNA
gggcgactcagctgagtcgccc

SEQ ID NO: 11009 - DNA, 22 bp, synthetic construct
  misc_feature 1..22: note = Description of Artificial Sequence: Syntheticoligonucleotide
  source 1..22: mol_type = other DNA
aggcgactcagctgagtcgcct

SEQ ID NO: 11010 - DNA, 22 bp, synthetic construct
  misc_feature 1..22: note = Description of Artificial Sequence: Syntheticoligonucleotide
  source 1..22: mol_type = other DNA
gagcgactcagctgagtcgctc

SEQ ID NO: 11011 - DNA, 22 bp, synthetic construct
  misc_feature 1..22: note = Description of Artificial Sequence: Syntheticoligonucleotide
  source 1..22: mol_type = other DNA
ggacgactcagctgagtcgtcc

SEQ ID NO: 11012 - DNA, 22 bp, synthetic construct
  misc_feature 1..22: note = Description of Artificial Sequence: Syntheticoligonucleotide
  source 1..22: mol_type = other DNA
gggagactcagctgagtctccc

SEQ ID NO: 11013 - DNA, 22 bp, synthetic construct
  misc_feature 1..22: note = Description of Artificial Sequence: Syntheticoligonucleotide
  source 1..22: mol_type = other DNA
tggcgactcagctgagtcgcca

SEQ ID NO: 11014 - DNA, 22 bp, synthetic construct
  misc_feature 1..22: note = Description of Artificial Sequence: Syntheticoligonucleotide
  source 1..22: mol_type = other DNA
gtgcgactcagctgagtcgcac

SEQ ID NO: 11015 - DNA, 22 bp, synthetic construct
  misc_feature 1..22: note = Description of Artificial Sequence: Syntheticoligonucleotide
  source 1..22: mol_type = other DNA
gggtgactcagctgagtcaccc

SEQ ID NO: 11016 - DNA, 22 bp, synthetic construct
  misc_feature 1..22: note = Description of Artificial Sequence: Syntheticoligonucleotide
  source 1..22: mol_type = other DNA
acgggactcagctgagtcccgt

SEQ ID NO: 11017 - DNA, 22 bp, synthetic construct
  misc_feature 1..22: note = Description of Artificial Sequence: Syntheticoligonucleotide
  source 1..22: mol_type = other DNA
cagggactcagctgagtccctg

SEQ ID NO: 11018 - DNA, 22 bp, synthetic construct
  misc_feature 1..22: note = Description of Artificial Sequence: Syntheticoligonucleotide
  source 1..22: mol_type = other DNA
ccaggactcagctgagtcctgg

SEQ ID NO: 11019 - DNA, 22 bp, synthetic construct
  misc_feature 1..22: note = Description of Artificial Sequence: Syntheticoligonucleotide
  source 1..22: mol_type = other DNA
ccgagactcagctgagtctcgg

SEQ ID NO: 11020 - DNA, 22 bp, synthetic construct
  misc_feature 1..22: note = Description of Artificial Sequence: Syntheticoligonucleotide
  source 1..22: mol_type = other DNA
tcgggactcagctgagtcccga

SEQ ID NO: 11021 - DNA, 22 bp, synthetic construct
  misc_feature 1..22: note = Description of Artificial Sequence: Syntheticoligonucleotide
  source 1..22: mol_type = other DNA
ctgggactcagctgagtcccag

SEQ ID NO: 11022 - DNA, 22 bp, synthetic construct
  misc_feature 1..22: note = Description of Artificial Sequence: Syntheticoligonucleotide
  source 1..22: mol_type = other DNA
cctggactcagctgagtccagg

SEQ ID NO: 11023 - DNA, 22 bp, synthetic construct
  misc_feature 1..22: note = Description of Artificial Sequence: Syntheticoligonucleotide
  source 1..22: mol_type = other DNA
ccgtgactcagctgagtcacgg

SEQ ID NO: 11024 - DNA, 22 bp, synthetic construct
  misc_feature 1..22: note = Description of Artificial Sequence: Syntheticoligonucleotide
  source 1..22: mol_type = other DNA
cggcgactcagctgagtcgccg

SEQ ID NO: 11025 - DNA, 22 bp, synthetic construct
  misc_feature 1..22: note = Description of Artificial Sequence: Syntheticoligonucleotide
  source 1..22: mol_type = other DNA
cagcgactcagctgagtcgctg

SEQ ID NO: 11026 - DNA, 22 bp, synthetic construct
  misc_feature 1..22: note = Description of Artificial Sequence: Syntheticoligonucleotide
  source 1..22: mol_type = other DNA
cgacgactcagctgagtcgtcg

SEQ ID NO: 11027 - DNA, 22 bp, synthetic construct
  misc_feature 1..22: note = Description of Artificial Sequence: Syntheticoligonucleotide
  source 1..22: mol_type = other DNA
cggagactcagctgagtctccg

SEQ ID NO: 11028 - DNA, 22 bp, synthetic construct
  misc_feature 1..22: note = Description of Artificial Sequence: Syntheticoligonucleotide
  source 1..22: mol_type = other DNA
ctgcgactcagctgagtcgcag

SEQ ID NO: 11029 - DNA, 22 bp, synthetic construct
  misc_feature 1..22: note = Description of Artificial Sequence: Syntheticoligonucleotide
  source 1..22: mol_type = other DNA
cggtgactcagctgagtcaccg

SEQ ID NO: 11030 - DNA, 22 bp, synthetic construct
  misc_feature 1..22: note = Description of Artificial Sequence: Syntheticoligonucleotide
  source 1..22: mol_type = other DNA
cacggactcagctgagtccgtg

SEQ ID NO: 11031 - DNA, 22 bp, synthetic construct
  misc_feature 1..22: note = Description of Artificial Sequence: Syntheticoligonucleotide
  source 1..22: mol_type = other DNA
cccagactcagctgagtctggg

SEQ ID NO: 11032 - DNA, 22 bp, synthetic construct
  misc_feature 1..22: note = Description of Artificial Sequence: Syntheticoligonucleotide
  source 1..22: mol_type = other DNA
ctcggactcagctgagtccgag

SEQ ID NO: 11033 - DNA, 22 bp, synthetic construct
  misc_feature 1..22: note = Description of Artificial Sequence: Syntheticoligonucleotide
  source 1..22: mol_type = other DNA
ccctgactcagctgagtcaggg

SEQ ID NO: 11034 - DNA, 22 bp, synthetic construct
  misc_feature 1..22: note = Description of Artificial Sequence: Syntheticoligonucleotide
  source 1..22: mol_type = other DNA
ccacgactcagctgagtcgtgg

SEQ ID NO: 11035 - DNA, 22 bp, synthetic construct
  misc_feature 1..22: note = Description of Artificial Sequence: Syntheticoligonucleotide
  source 1..22: mol_type = other DNA
agccgactcagctgagtcggct

SEQ ID NO: 11036 - DNA, 22 bp, synthetic construct
  misc_feature 1..22: note = Description of Artificial Sequence: Syntheticoligonucleotide
  source 1..22: mol_type = other DNA
tgccgactcagctgagtcggca

SEQ ID NO: 11037 - DNA, 22 bp, synthetic construct
  misc_feature 1..22: note = Description of Artificial Sequence: Syntheticoligonucleotide
  source 1..22: mol_type = other DNA
gcgagactcagctgagtctcgc

SEQ ID NO: 11038 - DNA, 22 bp, synthetic construct
  misc_feature 1..22: note = Description of Artificial Sequence: Syntheticoligonucleotide
  source 1..22: mol_type = other DNA
gcgtgactcagctgagtcacgc

SEQ ID NO: 11039 - DNA, 22 bp, synthetic construct
  misc_feature 1..22: note = Description of Artificial Sequence: Syntheticoligonucleotide
  source 1..22: mol_type = other DNA
gcaggactcagctgagtcctgc

SEQ ID NO: 11040 - DNA, 22 bp, synthetic construct
  misc_feature 1..22: note = Description of Artificial Sequence: Syntheticoligonucleotide
  source 1..22: mol_type = other DNA
gctggactcagctgagtccagc

SEQ ID NO: 11041 - DNA, 22 bp, synthetic construct
  misc_feature 1..22: note = Description of Artificial Sequence: Syntheticoligonucleotide
  source 1..22: mol_type = other DNA
cgaggactcagctgagtcctcg

SEQ ID NO: 11042 - DNA, 22 bp, synthetic construct
  misc_feature 1..22: note = Description of Artificial Sequence: Syntheticoligonucleotide
  source 1..22: mol_type = other DNA
cgtggactcagctgagtccacg

SEQ ID NO: 11043 - DNA, 22 bp, synthetic construct
  misc_feature 1..22: note = Description of Artificial Sequence: Syntheticoligonucleotide
  source 1..22: mol_type = other DNA
caccgactcagctgagtcggtg

SEQ ID NO: 11044 - DNA, 22 bp, synthetic construct
  misc_feature 1..22: note = Description of Artificial Sequence: Syntheticoligonucleotide
  source 1..22: mol_type = other DNA
ctccgactcagctgagtcggag

SEQ ID NO: 11045 - DNA, 22 bp, synthetic construct
  misc_feature 1..22: note = Description of Artificial Sequence: Syntheticoligonucleotide
  source 1..22: mol_type = other DNA
gcgggactcagctgagtcccgc

SEQ ID NO: 11046 - DNA, 22 bp, synthetic construct
  misc_feature 1..22: note = Description of Artificial Sequence: Syntheticoligonucleotide
  source 1..22: mol_type = other DNA
gagggactcagctgagtccctc

SEQ ID NO: 11047 - DNA, 22 bp, synthetic construct
  misc_feature 1..22: note = Description of Artificial Sequence: Syntheticoligonucleotide
  source 1..22: mol_type = other DNA
gtgggactcagctgagtcccac

SEQ ID NO: 11048 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactcaattgagtcnnnn

SEQ ID NO: 11049 - DNA, 22 bp, synthetic construct
  misc_feature 1..22: note = Description of Artificial Sequence: Syntheticoligonucleotide
  source 1..22: mol_type = other DNA
ggcggactcaattgagtccgcc

SEQ ID NO: 11050 - DNA, 22 bp, synthetic construct
  misc_feature 1..22: note = Description of Artificial Sequence: Syntheticoligonucleotide
  source 1..22: mol_type = other DNA
agcggactcaattgagtccgct

SEQ ID NO: 11051 - DNA, 22 bp, synthetic construct
  misc_feature 1..22: note = Description of Artificial Sequence: Syntheticoligonucleotide
  source 1..22: mol_type = other DNA
gacggactcaattgagtccgtc

SEQ ID NO: 11052 - DNA, 22 bp, synthetic construct
  misc_feature 1..22: note = Description of Artificial Sequence: Syntheticoligonucleotide
  source 1..22: mol_type = other DNA
ggaggactcaattgagtcctcc

SEQ ID NO: 11053 - DNA, 22 bp, synthetic construct
  misc_feature 1..22: note = Description of Artificial Sequence: Syntheticoligonucleotide
  source 1..22: mol_type = other DNA
ggcagactcaattgagtctgcc

SEQ ID NO: 11054 - DNA, 22 bp, synthetic construct
  misc_feature 1..22: note = Description of Artificial Sequence: Syntheticoligonucleotide
  source 1..22: mol_type = other DNA
tgcggactcaattgagtccgca

SEQ ID NO: 11055 - DNA, 22 bp, synthetic construct
  misc_feature 1..22: note = Description of Artificial Sequence: Syntheticoligonucleotide
  source 1..22: mol_type = other DNA
gtcggactcaattgagtccgac

SEQ ID NO: 11056 - DNA, 22 bp, synthetic construct
  misc_feature 1..22: note = Description of Artificial Sequence: Syntheticoligonucleotide
  source 1..22: mol_type = other DNA
ggtggactcaattgagtccacc

SEQ ID NO: 11057 - DNA, 22 bp, synthetic construct
  misc_feature 1..22: note = Description of Artificial Sequence: Syntheticoligonucleotide
  source 1..22: mol_type = other DNA
ggctgactcaattgagtcagcc

SEQ ID NO: 11058 - DNA, 22 bp, synthetic construct
  misc_feature 1..22: note = Description of Artificial Sequence: Syntheticoligonucleotide
  source 1..22: mol_type = other DNA
gcccgactcaattgagtcgggc

SEQ ID NO: 11059 - DNA, 22 bp, synthetic construct
  misc_feature 1..22: note = Description of Artificial Sequence: Syntheticoligonucleotide
  source 1..22: mol_type = other DNA
acccgactcaattgagtcgggt

SEQ ID NO: 11060 - DNA, 22 bp, synthetic construct
  misc_feature 1..22: note = Description of Artificial Sequence: Syntheticoligonucleotide
  source 1..22: mol_type = other DNA
gaccgactcaattgagtcggtc

SEQ ID NO: 11061 - DNA, 22 bp, synthetic construct
  misc_feature 1..22: note = Description of Artificial Sequence: Syntheticoligonucleotide
  source 1..22: mol_type = other DNA
gcacgactcaattgagtcgtgc

SEQ ID NO: 11062 - DNA, 22 bp, synthetic construct
  misc_feature 1..22: note = Description of Artificial Sequence: Syntheticoligonucleotide
  source 1..22: mol_type = other DNA
gccagactcaattgagtctggc

SEQ ID NO: 11063 - DNA, 22 bp, synthetic construct
  misc_feature 1..22: note = Description of Artificial Sequence: Syntheticoligonucleotide
  source 1..22: mol_type = other DNA
tcccgactcaattgagtcggga

SEQ ID NO: 11064 - DNA, 22 bp, synthetic construct
  misc_feature 1..22: note = Description of Artificial Sequence: Syntheticoligonucleotide
  source 1..22: mol_type = other DNA
gtccgactcaattgagtcggac

SEQ ID NO: 11065 - DNA, 22 bp, synthetic construct
  misc_feature 1..22: note = Description of Artificial Sequence: Syntheticoligonucleotide
  source 1..22: mol_type = other DNA
gcctgactcaattgagtcaggc

SEQ ID NO: 11066 - DNA, 22 bp, synthetic construct
  misc_feature 1..22: note = Description of Artificial Sequence: Syntheticoligonucleotide
  source 1..22: mol_type = other DNA
gggcgactcaattgagtcgccc

SEQ ID NO: 11067 - DNA, 22 bp, synthetic construct
  misc_feature 1..22: note = Description of Artificial Sequence: Syntheticoligonucleotide
  source 1..22: mol_type = other DNA
aggcgactcaattgagtcgcct

SEQ ID NO: 11068 - DNA, 22 bp, synthetic construct
  misc_feature 1..22: note = Description of Artificial Sequence: Syntheticoligonucleotide
  source 1..22: mol_type = other DNA
gagcgactcaattgagtcgctc

SEQ ID NO: 11069 - DNA, 22 bp, synthetic construct
  misc_feature 1..22: note = Description of Artificial Sequence: Syntheticoligonucleotide
  source 1..22: mol_type = other DNA
ggacgactcaattgagtcgtcc

SEQ ID NO: 11070 - DNA, 22 bp, synthetic construct
  misc_feature 1..22: note = Description of Artificial Sequence: Syntheticoligonucleotide
  source 1..22: mol_type = other DNA
gggagactcaattgagtctccc

SEQ ID NO: 11071 - DNA, 22 bp, synthetic construct
  misc_feature 1..22: note = Description of Artificial Sequence: Syntheticoligonucleotide
  source 1..22: mol_type = other DNA
tggcgactcaattgagtcgcca

SEQ ID NO: 11072 - DNA, 22 bp, synthetic construct
  misc_feature 1..22: note = Description of Artificial Sequence: Syntheticoligonucleotide
  source 1..22: mol_type = other DNA
gtgcgactcaattgagtcgcac

SEQ ID NO: 11073 - DNA, 22 bp, synthetic construct
  misc_feature 1..22: note = Description of Artificial Sequence: Syntheticoligonucleotide
  source 1..22: mol_type = other DNA
gggtgactcaattgagtcaccc

SEQ ID NO: 11074 - DNA, 22 bp, synthetic construct
  misc_feature 1..22: note = Description of Artificial Sequence: Syntheticoligonucleotide
  source 1..22: mol_type = other DNA
acgggactcaattgagtcccgt

SEQ ID NO: 11075 - DNA, 22 bp, synthetic construct
  misc_feature 1..22: note = Description of Artificial Sequence: Syntheticoligonucleotide
  source 1..22: mol_type = other DNA
cagggactcaattgagtccctg

SEQ ID NO: 11076 - DNA, 22 bp, synthetic construct
  misc_feature 1..22: note = Description of Artificial Sequence: Syntheticoligonucleotide
  source 1..22: mol_type = other DNA
ccaggactcaattgagtcctgg

SEQ ID NO: 11077 - DNA, 22 bp, synthetic construct
  misc_feature 1..22: note = Description of Artificial Sequence: Syntheticoligonucleotide
  source 1..22: mol_type = other DNA
ccgagactcaattgagtctcgg

SEQ ID NO: 11078 - DNA, 22 bp, synthetic construct
  misc_feature 1..22: note = Description of Artificial Sequence: Syntheticoligonucleotide
  source 1..22: mol_type = other DNA
tcgggactcaattgagtcccga

SEQ ID NO: 11079 - DNA, 22 bp, synthetic construct
  misc_feature 1..22: note = Description of Artificial Sequence: Syntheticoligonucleotide
  source 1..22: mol_type = other DNA
ctgggactcaattgagtcccag

SEQ ID NO: 11080 - DNA, 22 bp, synthetic construct
  misc_feature 1..22: note = Description of Artificial Sequence: Syntheticoligonucleotide
  source 1..22: mol_type = other DNA
cctggactcaattgagtccagg

SEQ ID NO: 11081 - DNA, 22 bp, synthetic construct
  misc_feature 1..22: note = Description of Artificial Sequence: Syntheticoligonucleotide
  source 1..22: mol_type = other DNA
ccgtgactcaattgagtcacgg

SEQ ID NO: 11082 - DNA, 22 bp, synthetic construct
  misc_feature 1..22: note = Description of Artificial Sequence: Syntheticoligonucleotide
  source 1..22: mol_type = other DNA
cggcgactcaattgagtcgccg

SEQ ID NO: 11083 - DNA, 22 bp, synthetic construct
  misc_feature 1..22: note = Description of Artificial Sequence: Syntheticoligonucleotide
  source 1..22: mol_type = other DNA
cagcgactcaattgagtcgctg

SEQ ID NO: 11084 - DNA, 22 bp, synthetic construct
  misc_feature 1..22: note = Description of Artificial Sequence: Syntheticoligonucleotide
  source 1..22: mol_type = other DNA
cgacgactcaattgagtcgtcg

SEQ ID NO: 11085 - DNA, 22 bp, synthetic construct
  misc_feature 1..22: note = Description of Artificial Sequence: Syntheticoligonucleotide
  source 1..22: mol_type = other DNA
cggagactcaattgagtctccg

SEQ ID NO: 11086 - DNA, 22 bp, synthetic construct
  misc_feature 1..22: note = Description of Artificial Sequence: Syntheticoligonucleotide
  source 1..22: mol_type = other DNA
ctgcgactcaattgagtcgcag

SEQ ID NO: 11087 - DNA, 22 bp, synthetic construct
  misc_feature 1..22: note = Description of Artificial Sequence: Syntheticoligonucleotide
  source 1..22: mol_type = other DNA
cggtgactcaattgagtcaccg

SEQ ID NO: 11088 - DNA, 22 bp, synthetic construct
  misc_feature 1..22: note = Description of Artificial Sequence: Syntheticoligonucleotide
  source 1..22: mol_type = other DNA
cacggactcaattgagtccgtg

SEQ ID NO: 11089 - DNA, 22 bp, synthetic construct
  misc_feature 1..22: note = Description of Artificial Sequence: Syntheticoligonucleotide
  source 1..22: mol_type = other DNA
cccagactcaattgagtctggg

SEQ ID NO: 11090 - DNA, 22 bp, synthetic construct
  misc_feature 1..22: note = Description of Artificial Sequence: Syntheticoligonucleotide
  source 1..22: mol_type = other DNA
ctcggactcaattgagtccgag

SEQ ID NO: 11091 - DNA, 22 bp, synthetic construct
  misc_feature 1..22: note = Description of Artificial Sequence: Syntheticoligonucleotide
  source 1..22: mol_type = other DNA
ccctgactcaattgagtcaggg

SEQ ID NO: 11092 - DNA, 22 bp, synthetic construct
  misc_feature 1..22: note = Description of Artificial Sequence: Syntheticoligonucleotide
  source 1..22: mol_type = other DNA
ccacgactcaattgagtcgtgg

SEQ ID NO: 11093 - DNA, 22 bp, synthetic construct
  misc_feature 1..22: note = Description of Artificial Sequence: Syntheticoligonucleotide
  source 1..22: mol_type = other DNA
agccgactcaattgagtcggct

SEQ ID NO: 11094 - DNA, 22 bp, synthetic construct
  misc_feature 1..22: note = Description of Artificial Sequence: Syntheticoligonucleotide
  source 1..22: mol_type = other DNA
tgccgactcaattgagtcggca

SEQ ID NO: 11095 - DNA, 22 bp, synthetic construct
  misc_feature 1..22: note = Description of Artificial Sequence: Syntheticoligonucleotide
  source 1..22: mol_type = other DNA
gcgagactcaattgagtctcgc

SEQ ID NO: 11096 - DNA, 22 bp, synthetic construct
  misc_feature 1..22: note = Description of Artificial Sequence: Syntheticoligonucleotide
  source 1..22: mol_type = other DNA
gcgtgactcaattgagtcacgc

SEQ ID NO: 11097 - DNA, 22 bp, synthetic construct
  misc_feature 1..22: note = Description of Artificial Sequence: Syntheticoligonucleotide
  source 1..22: mol_type = other DNA
gcaggactcaattgagtcctgc

SEQ ID NO: 11098 - DNA, 22 bp, synthetic construct
  misc_feature 1..22: note = Description of Artificial Sequence: Syntheticoligonucleotide
  source 1..22: mol_type = other DNA
gctggactcaattgagtccagc

SEQ ID NO: 11099 - DNA, 22 bp, synthetic construct
  misc_feature 1..22: note = Description of Artificial Sequence: Syntheticoligonucleotide
  source 1..22: mol_type = other DNA
cgaggactcaattgagtcctcg

SEQ ID NO: 11100 - DNA, 22 bp, synthetic construct
  misc_feature 1..22: note = Description of Artificial Sequence: Syntheticoligonucleotide
  source 1..22: mol_type = other DNA
cgtggactcaattgagtccacg

SEQ ID NO: 11101 - DNA, 22 bp, synthetic construct
  misc_feature 1..22: note = Description of Artificial Sequence: Syntheticoligonucleotide
  source 1..22: mol_type = other DNA
caccgactcaattgagtcggtg

SEQ ID NO: 11102 - DNA, 22 bp, synthetic construct
  misc_feature 1..22: note = Description of Artificial Sequence: Syntheticoligonucleotide
  source 1..22: mol_type = other DNA
ctccgactcaattgagtcggag

SEQ ID NO: 11103 - DNA, 22 bp, synthetic construct
  misc_feature 1..22: note = Description of Artificial Sequence: Syntheticoligonucleotide
  source 1..22: mol_type = other DNA
gcgggactcaattgagtcccgc

SEQ ID NO: 11104 - DNA, 22 bp, synthetic construct
  misc_feature 1..22: note = Description of Artificial Sequence: Syntheticoligonucleotide
  source 1..22: mol_type = other DNA
gagggactcaattgagtccctc

SEQ ID NO: 11105 - DNA, 22 bp, synthetic construct
  misc_feature 1..22: note = Description of Artificial Sequence: Syntheticoligonucleotide
  source 1..22: mol_type = other DNA
gtgggactcaattgagtcccac

SEQ ID NO: 11106 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactctatagagtcnnnn

SEQ ID NO: 11107 - DNA, 22 bp, synthetic construct
  misc_feature 1..22: note = Description of Artificial Sequence: Syntheticoligonucleotide
  source 1..22: mol_type = other DNA
ggcggactctatagagtccgcc

SEQ ID NO: 11108 - DNA, 22 bp, synthetic construct
  misc_feature 1..22: note = Description of Artificial Sequence: Syntheticoligonucleotide
  source 1..22: mol_type = other DNA
agcggactctatagagtccgct

SEQ ID NO: 11109 - DNA, 22 bp, synthetic construct
  misc_feature 1..22: note = Description of Artificial Sequence: Syntheticoligonucleotide
  source 1..22: mol_type = other DNA
gacggactctatagagtccgtc

SEQ ID NO: 11110 - DNA, 22 bp, synthetic construct
  misc_feature 1..22: note = Description of Artificial Sequence: Syntheticoligonucleotide
  source 1..22: mol_type = other DNA
ggaggactctatagagtcctcc

SEQ ID NO: 11111 - DNA, 22 bp, synthetic construct
  misc_feature 1..22: note = Description of Artificial Sequence: Syntheticoligonucleotide
  source 1..22: mol_type = other DNA
ggcagactctatagagtctgcc

SEQ ID NO: 11112 - DNA, 22 bp, synthetic construct
  misc_feature 1..22: note = Description of Artificial Sequence: Syntheticoligonucleotide
  source 1..22: mol_type = other DNA
tgcggactctatagagtccgca

SEQ ID NO: 11113 - DNA, 22 bp, synthetic construct
  misc_feature 1..22: note = Description of Artificial Sequence: Syntheticoligonucleotide
  source 1..22: mol_type = other DNA
gtcggactctatagagtccgac

SEQ ID NO: 11114 - DNA, 22 bp, synthetic construct
  misc_feature 1..22: note = Description of Artificial Sequence: Syntheticoligonucleotide
  source 1..22: mol_type = other DNA
ggtggactctatagagtccacc

SEQ ID NO: 11115 - DNA, 22 bp, synthetic construct
  misc_feature 1..22: note = Description of Artificial Sequence: Syntheticoligonucleotide
  source 1..22: mol_type = other DNA
ggctgactctatagagtcagcc

SEQ ID NO: 11116 - DNA, 22 bp, synthetic construct
  misc_feature 1..22: note = Description of Artificial Sequence: Syntheticoligonucleotide
  source 1..22: mol_type = other DNA
gcccgactctatagagtcgggc

SEQ ID NO: 11117 - DNA, 22 bp, synthetic construct
  misc_feature 1..22: note = Description of Artificial Sequence: Syntheticoligonucleotide
  source 1..22: mol_type = other DNA
acccgactctatagagtcgggt

SEQ ID NO: 11118 - DNA, 22 bp, synthetic construct
  misc_feature 1..22: note = Description of Artificial Sequence: Syntheticoligonucleotide
  source 1..22: mol_type = other DNA
gaccgactctatagagtcggtc

SEQ ID NO: 11119 - DNA, 22 bp, synthetic construct
  misc_feature 1..22: note = Description of Artificial Sequence: Syntheticoligonucleotide
  source 1..22: mol_type = other DNA
gcacgactctatagagtcgtgc

SEQ ID NO: 11120 - DNA, 22 bp, synthetic construct
  misc_feature 1..22: note = Description of Artificial Sequence: Syntheticoligonucleotide
  source 1..22: mol_type = other DNA
gccagactctatagagtctggc

SEQ ID NO: 11121 - DNA, 22 bp, synthetic construct
  misc_feature 1..22: note = Description of Artificial Sequence: Syntheticoligonucleotide
  source 1..22: mol_type = other DNA
tcccgactctatagagtcggga

SEQ ID NO: 11122 - DNA, 22 bp, synthetic construct
  misc_feature 1..22: note = Description of Artificial Sequence: Syntheticoligonucleotide
  source 1..22: mol_type = other DNA
gtccgactctatagagtcggac

SEQ ID NO: 11123 - DNA, 22 bp, synthetic construct
  misc_feature 1..22: note = Description of Artificial Sequence: Syntheticoligonucleotide
  source 1..22: mol_type = other DNA
gcctgactctatagagtcaggc

SEQ ID NO: 11124 - DNA, 22 bp, synthetic construct
  misc_feature 1..22: note = Description of Artificial Sequence: Syntheticoligonucleotide
  source 1..22: mol_type = other DNA
gggcgactctatagagtcgccc

SEQ ID NO: 11125 - DNA, 22 bp, synthetic construct
  misc_feature 1..22: note = Description of Artificial Sequence: Syntheticoligonucleotide
  source 1..22: mol_type = other DNA
aggcgactctatagagtcgcct

SEQ ID NO: 11126 - DNA, 22 bp, synthetic construct
  misc_feature 1..22: note = Description of Artificial Sequence: Syntheticoligonucleotide
  source 1..22: mol_type = other DNA
gagcgactctatagagtcgctc

SEQ ID NO: 11127 - DNA, 22 bp, synthetic construct
  misc_feature 1..22: note = Description of Artificial Sequence: Syntheticoligonucleotide
  source 1..22: mol_type = other DNA
ggacgactctatagagtcgtcc

SEQ ID NO: 11128 - DNA, 22 bp, synthetic construct
  misc_feature 1..22: note = Description of Artificial Sequence: Syntheticoligonucleotide
  source 1..22: mol_type = other DNA
gggagactctatagagtctccc

SEQ ID NO: 11129 - DNA, 22 bp, synthetic construct
  misc_feature 1..22: note = Description of Artificial Sequence: Syntheticoligonucleotide
  source 1..22: mol_type = other DNA
tggcgactctatagagtcgcca

SEQ ID NO: 11130 - DNA, 22 bp, synthetic construct
  misc_feature 1..22: note = Description of Artificial Sequence: Syntheticoligonucleotide
  source 1..22: mol_type = other DNA
gtgcgactctatagagtcgcac

SEQ ID NO: 11131 - DNA, 22 bp, synthetic construct
  misc_feature 1..22: note = Description of Artificial Sequence: Syntheticoligonucleotide
  source 1..22: mol_type = other DNA
gggtgactctatagagtcaccc

SEQ ID NO: 11132 - DNA, 22 bp, synthetic construct
  misc_feature 1..22: note = Description of Artificial Sequence: Syntheticoligonucleotide
  source 1..22: mol_type = other DNA
acgggactctatagagtcccgt

SEQ ID NO: 11133 - DNA, 22 bp, synthetic construct
  misc_feature 1..22: note = Description of Artificial Sequence: Syntheticoligonucleotide
  source 1..22: mol_type = other DNA
cagggactctatagagtccctg

SEQ ID NO: 11134 - DNA, 22 bp, synthetic construct
  misc_feature 1..22: note = Description of Artificial Sequence: Syntheticoligonucleotide
  source 1..22: mol_type = other DNA
ccaggactctatagagtcctgg

SEQ ID NO: 11135 - DNA, 22 bp, synthetic construct
  misc_feature 1..22: note = Description of Artificial Sequence: Syntheticoligonucleotide
  source 1..22: mol_type = other DNA
ccgagactctatagagtctcgg

SEQ ID NO: 11136 - DNA, 22 bp, synthetic construct
  misc_feature 1..22: note = Description of Artificial Sequence: Syntheticoligonucleotide
  source 1..22: mol_type = other DNA
tcgggactctatagagtcccga

SEQ ID NO: 11137 - DNA, 22 bp, synthetic construct
  misc_feature 1..22: note = Description of Artificial Sequence: Syntheticoligonucleotide
  source 1..22: mol_type = other DNA
ctgggactctatagagtcccag

SEQ ID NO: 11138 - DNA, 22 bp, synthetic construct
  misc_feature 1..22: note = Description of Artificial Sequence: Syntheticoligonucleotide
  source 1..22: mol_type = other DNA
cctggactctatagagtccagg

SEQ ID NO: 11139 - DNA, 22 bp, synthetic construct
  misc_feature 1..22: note = Description of Artificial Sequence: Syntheticoligonucleotide
  source 1..22: mol_type = other DNA
ccgtgactctatagagtcacgg

SEQ ID NO: 11140 - DNA, 22 bp, synthetic construct
  misc_feature 1..22: note = Description of Artificial Sequence: Syntheticoligonucleotide
  source 1..22: mol_type = other DNA
cggcgactctatagagtcgccg

SEQ ID NO: 11141 - DNA, 22 bp, synthetic construct
  misc_feature 1..22: note = Description of Artificial Sequence: Syntheticoligonucleotide
  source 1..22: mol_type = other DNA
cagcgactctatagagtcgctg

SEQ ID NO: 11142 - DNA, 22 bp, synthetic construct
  misc_feature 1..22: note = Description of Artificial Sequence: Syntheticoligonucleotide
  source 1..22: mol_type = other DNA
cgacgactctatagagtcgtcg

SEQ ID NO: 11143 - DNA, 22 bp, synthetic construct
  misc_feature 1..22: note = Description of Artificial Sequence: Syntheticoligonucleotide
  source 1..22: mol_type = other DNA
cggagactctatagagtctccg

SEQ ID NO: 11144 - DNA, 22 bp, synthetic construct
  misc_feature 1..22: note = Description of Artificial Sequence: Syntheticoligonucleotide
  source 1..22: mol_type = other DNA
ctgcgactctatagagtcgcag

SEQ ID NO: 11145 - DNA, 22 bp, synthetic construct
  misc_feature 1..22: note = Description of Artificial Sequence: Syntheticoligonucleotide
  source 1..22: mol_type = other DNA
cggtgactctatagagtcaccg

SEQ ID NO: 11146 - DNA, 22 bp, synthetic construct
  misc_feature 1..22: note = Description of Artificial Sequence: Syntheticoligonucleotide
  source 1..22: mol_type = other DNA
cacggactctatagagtccgtg

SEQ ID NO: 11147 - DNA, 22 bp, synthetic construct
  misc_feature 1..22: note = Description of Artificial Sequence: Syntheticoligonucleotide
  source 1..22: mol_type = other DNA
cccagactctatagagtctggg

SEQ ID NO: 11148 - DNA, 22 bp, synthetic construct
  misc_feature 1..22: note = Description of Artificial Sequence: Syntheticoligonucleotide
  source 1..22: mol_type = other DNA
ctcggactctatagagtccgag

SEQ ID NO: 11149 - DNA, 22 bp, synthetic construct
  misc_feature 1..22: note = Description of Artificial Sequence: Syntheticoligonucleotide
  source 1..22: mol_type = other DNA
ccctgactctatagagtcaggg

SEQ ID NO: 11150 - DNA, 22 bp, synthetic construct
  misc_feature 1..22: note = Description of Artificial Sequence: Syntheticoligonucleotide
  source 1..22: mol_type = other DNA
ccacgactctatagagtcgtgg

SEQ ID NO: 11151 - DNA, 22 bp, synthetic construct
  misc_feature 1..22: note = Description of Artificial Sequence: Syntheticoligonucleotide
  source 1..22: mol_type = other DNA
agccgactctatagagtcggct

SEQ ID NO: 11152 - DNA, 22 bp, synthetic construct
  misc_feature 1..22: note = Description of Artificial Sequence: Syntheticoligonucleotide
  source 1..22: mol_type = other DNA
tgccgactctatagagtcggca

SEQ ID NO: 11153 - DNA, 22 bp, synthetic construct
  misc_feature 1..22: note = Description of Artificial Sequence: Syntheticoligonucleotide
  source 1..22: mol_type = other DNA
gcgagactctatagagtctcgc

SEQ ID NO: 11154 - DNA, 22 bp, synthetic construct
  misc_feature 1..22: note = Description of Artificial Sequence: Syntheticoligonucleotide
  source 1..22: mol_type = other DNA
gcgtgactctatagagtcacgc

SEQ ID NO: 11155 - DNA, 22 bp, synthetic construct
  misc_feature 1..22: note = Description of Artificial Sequence: Syntheticoligonucleotide
  source 1..22: mol_type = other DNA
gcaggactctatagagtcctgc

SEQ ID NO: 11156 - DNA, 22 bp, synthetic construct
  misc_feature 1..22: note = Description of Artificial Sequence: Syntheticoligonucleotide
  source 1..22: mol_type = other DNA
gctggactctatagagtccagc

SEQ ID NO: 11157 - DNA, 22 bp, synthetic construct
  misc_feature 1..22: note = Description of Artificial Sequence: Syntheticoligonucleotide
  source 1..22: mol_type = other DNA
cgaggactctatagagtcctcg

SEQ ID NO: 11158 - DNA, 22 bp, synthetic construct
  misc_feature 1..22: note = Description of Artificial Sequence: Syntheticoligonucleotide
  source 1..22: mol_type = other DNA
cgtggactctatagagtccacg

SEQ ID NO: 11159 - DNA, 22 bp, synthetic construct
  misc_feature 1..22: note = Description of Artificial Sequence: Syntheticoligonucleotide
  source 1..22: mol_type = other DNA
caccgactctatagagtcggtg

SEQ ID NO: 11160 - DNA, 22 bp, synthetic construct
  misc_feature 1..22: note = Description of Artificial Sequence: Syntheticoligonucleotide
  source 1..22: mol_type = other DNA
ctccgactctatagagtcggag

SEQ ID NO: 11161 - DNA, 22 bp, synthetic construct
  misc_feature 1..22: note = Description of Artificial Sequence: Syntheticoligonucleotide
  source 1..22: mol_type = other DNA
gcgggactctatagagtcccgc

SEQ ID NO: 11162 - DNA, 22 bp, synthetic construct
  misc_feature 1..22: note = Description of Artificial Sequence: Syntheticoligonucleotide
  source 1..22: mol_type = other DNA
gagggactctatagagtccctc

SEQ ID NO: 11163 - DNA, 22 bp, synthetic construct
  misc_feature 1..22: note = Description of Artificial Sequence: Syntheticoligonucleotide
  source 1..22: mol_type = other DNA
gtgggactctatagagtcccac

SEQ ID NO: 11164 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactcatatgagtcnnnn

SEQ ID NO: 11165 - DNA, 22 bp, synthetic construct
  misc_feature 1..22: note = Description of Artificial Sequence: Syntheticoligonucleotide
  source 1..22: mol_type = other DNA
ggcggactcatatgagtccgcc

SEQ ID NO: 11166 - DNA, 22 bp, synthetic construct
  misc_feature 1..22: note = Description of Artificial Sequence: Syntheticoligonucleotide
  source 1..22: mol_type = other DNA
agcggactcatatgagtccgct

SEQ ID NO: 11167 - DNA, 22 bp, synthetic construct
  misc_feature 1..22: note = Description of Artificial Sequence: Syntheticoligonucleotide
  source 1..22: mol_type = other DNA
gacggactcatatgagtccgtc

SEQ ID NO: 11168 - DNA, 22 bp, synthetic construct
  misc_feature 1..22: note = Description of Artificial Sequence: Syntheticoligonucleotide
  source 1..22: mol_type = other DNA
ggaggactcatatgagtcctcc

SEQ ID NO: 11169 - DNA, 22 bp, synthetic construct
  misc_feature 1..22: note = Description of Artificial Sequence: Syntheticoligonucleotide
  source 1..22: mol_type = other DNA
ggcagactcatatgagtctgcc

SEQ ID NO: 11170 - DNA, 22 bp, synthetic construct
  misc_feature 1..22: note = Description of Artificial Sequence: Syntheticoligonucleotide
  source 1..22: mol_type = other DNA
tgcggactcatatgagtccgca

SEQ ID NO: 11171 - DNA, 22 bp, synthetic construct
  misc_feature 1..22: note = Description of Artificial Sequence: Syntheticoligonucleotide
  source 1..22: mol_type = other DNA
gtcggactcatatgagtccgac

SEQ ID NO: 11172 - DNA, 22 bp, synthetic construct
  misc_feature 1..22: note = Description of Artificial Sequence: Syntheticoligonucleotide
  source 1..22: mol_type = other DNA
ggtggactcatatgagtccacc

SEQ ID NO: 11173 - DNA, 22 bp, synthetic construct
  misc_feature 1..22: note = Description of Artificial Sequence: Syntheticoligonucleotide
  source 1..22: mol_type = other DNA
ggctgactcatatgagtcagcc

SEQ ID NO: 11174 - DNA, 22 bp, synthetic construct
  misc_feature 1..22: note = Description of Artificial Sequence: Syntheticoligonucleotide
  source 1..22: mol_type = other DNA
gcccgactcatatgagtcgggc

SEQ ID NO: 11175 - DNA, 22 bp, synthetic construct
  misc_feature 1..22: note = Description of Artificial Sequence: Syntheticoligonucleotide
  source 1..22: mol_type = other DNA
acccgactcatatgagtcgggt

SEQ ID NO: 11176 - DNA, 22 bp, synthetic construct
  misc_feature 1..22: note = Description of Artificial Sequence: Syntheticoligonucleotide
  source 1..22: mol_type = other DNA
gaccgactcatatgagtcggtc

SEQ ID NO: 11177 - DNA, 22 bp, synthetic construct
  misc_feature 1..22: note = Description of Artificial Sequence: Syntheticoligonucleotide
  source 1..22: mol_type = other DNA
gcacgactcatatgagtcgtgc

SEQ ID NO: 11178 - DNA, 22 bp, synthetic construct
  misc_feature 1..22: note = Description of Artificial Sequence: Syntheticoligonucleotide
  source 1..22: mol_type = other DNA
gccagactcatatgagtctggc

SEQ ID NO: 11179 - DNA, 22 bp, synthetic construct
  misc_feature 1..22: note = Description of Artificial Sequence: Syntheticoligonucleotide
  source 1..22: mol_type = other DNA
tcccgactcatatgagtcggga

SEQ ID NO: 11180 - DNA, 22 bp, synthetic construct
  misc_feature 1..22: note = Description of Artificial Sequence: Syntheticoligonucleotide
  source 1..22: mol_type = other DNA
gtccgactcatatgagtcggac

SEQ ID NO: 11181 - DNA, 22 bp, synthetic construct
  misc_feature 1..22: note = Description of Artificial Sequence: Syntheticoligonucleotide
  source 1..22: mol_type = other DNA
gcctgactcatatgagtcaggc

SEQ ID NO: 11182 - DNA, 22 bp, synthetic construct
  misc_feature 1..22: note = Description of Artificial Sequence: Syntheticoligonucleotide
  source 1..22: mol_type = other DNA
gggcgactcatatgagtcgccc

SEQ ID NO: 11183 - DNA, 22 bp, synthetic construct
  misc_feature 1..22: note = Description of Artificial Sequence: Syntheticoligonucleotide
  source 1..22: mol_type = other DNA
aggcgactcatatgagtcgcct

SEQ ID NO: 11184 - DNA, 22 bp, synthetic construct
  misc_feature 1..22: note = Description of Artificial Sequence: Syntheticoligonucleotide
  source 1..22: mol_type = other DNA
gagcgactcatatgagtcgctc

SEQ ID NO: 11185 - DNA, 22 bp, synthetic construct
  misc_feature 1..22: note = Description of Artificial Sequence: Syntheticoligonucleotide
  source 1..22: mol_type = other DNA
ggacgactcatatgagtcgtcc

SEQ ID NO: 11186 - DNA, 22 bp, synthetic construct
  misc_feature 1..22: note = Description of Artificial Sequence: Syntheticoligonucleotide
  source 1..22: mol_type = other DNA
gggagactcatatgagtctccc

SEQ ID NO: 11187 - DNA, 22 bp, synthetic construct
  misc_feature 1..22: note = Description of Artificial Sequence: Syntheticoligonucleotide
  source 1..22: mol_type = other DNA
tggcgactcatatgagtcgcca

SEQ ID NO: 11188 - DNA, 22 bp, synthetic construct
  misc_feature 1..22: note = Description of Artificial Sequence: Syntheticoligonucleotide
  source 1..22: mol_type = other DNA
gtgcgactcatatgagtcgcac

SEQ ID NO: 11189 - DNA, 22 bp, synthetic construct
  misc_feature 1..22: note = Description of Artificial Sequence: Syntheticoligonucleotide
  source 1..22: mol_type = other DNA
gggtgactcatatgagtcaccc

SEQ ID NO: 11190 - DNA, 22 bp, synthetic construct
  misc_feature 1..22: note = Description of Artificial Sequence: Syntheticoligonucleotide
  source 1..22: mol_type = other DNA
acgggactcatatgagtcccgt

SEQ ID NO: 11191 - DNA, 22 bp, synthetic construct
  misc_feature 1..22: note = Description of Artificial Sequence: Syntheticoligonucleotide
  source 1..22: mol_type = other DNA
cagggactcatatgagtccctg

SEQ ID NO: 11192 - DNA, 22 bp, synthetic construct
  misc_feature 1..22: note = Description of Artificial Sequence: Syntheticoligonucleotide
  source 1..22: mol_type = other DNA
ccaggactcatatgagtcctgg

SEQ ID NO: 11193 - DNA, 22 bp, synthetic construct
  misc_feature 1..22: note = Description of Artificial Sequence: Syntheticoligonucleotide
  source 1..22: mol_type = other DNA
ccgagactcatatgagtctcgg

SEQ ID NO: 11194 - DNA, 22 bp, synthetic construct
  misc_feature 1..22: note = Description of Artificial Sequence: Syntheticoligonucleotide
  source 1..22: mol_type = other DNA
tcgggactcatatgagtcccga

SEQ ID NO: 11195 - DNA, 22 bp, synthetic construct
  misc_feature 1..22: note = Description of Artificial Sequence: Syntheticoligonucleotide
  source 1..22: mol_type = other DNA
ctgggactcatatgagtcccag

SEQ ID NO: 11196 - DNA, 22 bp, synthetic construct
  misc_feature 1..22: note = Description of Artificial Sequence: Syntheticoligonucleotide
  source 1..22: mol_type = other DNA
cctggactcatatgagtccagg

SEQ ID NO: 11197 - DNA, 22 bp, synthetic construct
  misc_feature 1..22: note = Description of Artificial Sequence: Syntheticoligonucleotide
  source 1..22: mol_type = other DNA
ccgtgactcatatgagtcacgg

SEQ ID NO: 11198 - DNA, 22 bp, synthetic construct
  misc_feature 1..22: note = Description of Artificial Sequence: Syntheticoligonucleotide
  source 1..22: mol_type = other DNA
cggcgactcatatgagtcgccg

SEQ ID NO: 11199 - DNA, 22 bp, synthetic construct
  misc_feature 1..22: note = Description of Artificial Sequence: Syntheticoligonucleotide
  source 1..22: mol_type = other DNA
cagcgactcatatgagtcgctg

SEQ ID NO: 11200 - DNA, 22 bp, synthetic construct
  misc_feature 1..22: note = Description of Artificial Sequence: Syntheticoligonucleotide
  source 1..22: mol_type = other DNA
cgacgactcatatgagtcgtcg

SEQ ID NO: 11201 - DNA, 22 bp, synthetic construct
  misc_feature 1..22: note = Description of Artificial Sequence: Syntheticoligonucleotide
  source 1..22: mol_type = other DNA
cggagactcatatgagtctccg

SEQ ID NO: 11202 - DNA, 22 bp, synthetic construct
  misc_feature 1..22: note = Description of Artificial Sequence: Syntheticoligonucleotide
  source 1..22: mol_type = other DNA
ctgcgactcatatgagtcgcag

SEQ ID NO: 11203 - DNA, 22 bp, synthetic construct
  misc_feature 1..22: note = Description of Artificial Sequence: Syntheticoligonucleotide
  source 1..22: mol_type = other DNA
cggtgactcatatgagtcaccg

SEQ ID NO: 11204 - DNA, 22 bp, synthetic construct
  misc_feature 1..22: note = Description of Artificial Sequence: Syntheticoligonucleotide
  source 1..22: mol_type = other DNA
cacggactcatatgagtccgtg

SEQ ID NO: 11205 - DNA, 22 bp, synthetic construct
  misc_feature 1..22: note = Description of Artificial Sequence: Syntheticoligonucleotide
  source 1..22: mol_type = other DNA
cccagactcatatgagtctggg

SEQ ID NO: 11206 - DNA, 22 bp, synthetic construct
  misc_feature 1..22: note = Description of Artificial Sequence: Syntheticoligonucleotide
  source 1..22: mol_type = other DNA
ctcggactcatatgagtccgag

SEQ ID NO: 11207 - DNA, 22 bp, synthetic construct
  misc_feature 1..22: note = Description of Artificial Sequence: Syntheticoligonucleotide
  source 1..22: mol_type = other DNA
ccctgactcatatgagtcaggg

SEQ ID NO: 11208 - DNA, 22 bp, synthetic construct
  misc_feature 1..22: note = Description of Artificial Sequence: Syntheticoligonucleotide
  source 1..22: mol_type = other DNA
ccacgactcatatgagtcgtgg

SEQ ID NO: 11209 - DNA, 22 bp, synthetic construct
  misc_feature 1..22: note = Description of Artificial Sequence: Syntheticoligonucleotide
  source 1..22: mol_type = other DNA
agccgactcatatgagtcggct

SEQ ID NO: 11210 - DNA, 22 bp, synthetic construct
  misc_feature 1..22: note = Description of Artificial Sequence: Syntheticoligonucleotide
  source 1..22: mol_type = other DNA
tgccgactcatatgagtcggca

SEQ ID NO: 11211 - DNA, 22 bp, synthetic construct
  misc_feature 1..22: note = Description of Artificial Sequence: Syntheticoligonucleotide
  source 1..22: mol_type = other DNA
gcgagactcatatgagtctcgc

SEQ ID NO: 11212 - DNA, 22 bp, synthetic construct
  misc_feature 1..22: note = Description of Artificial Sequence: Syntheticoligonucleotide
  source 1..22: mol_type = other DNA
gcgtgactcatatgagtcacgc

SEQ ID NO: 11213 - DNA, 22 bp, synthetic construct
  misc_feature 1..22: note = Description of Artificial Sequence: Syntheticoligonucleotide
  source 1..22: mol_type = other DNA
gcaggactcatatgagtcctgc

SEQ ID NO: 11214 - DNA, 22 bp, synthetic construct
  misc_feature 1..22: note = Description of Artificial Sequence: Syntheticoligonucleotide
  source 1..22: mol_type = other DNA
gctggactcatatgagtccagc

SEQ ID NO: 11215 - DNA, 22 bp, synthetic construct
  misc_feature 1..22: note = Description of Artificial Sequence: Syntheticoligonucleotide
  source 1..22: mol_type = other DNA
cgaggactcatatgagtcctcg

SEQ ID NO: 11216 - DNA, 22 bp, synthetic construct
  misc_feature 1..22: note = Description of Artificial Sequence: Syntheticoligonucleotide
  source 1..22: mol_type = other DNA
cgtggactcatatgagtccacg

SEQ ID NO: 11217 - DNA, 22 bp, synthetic construct
  misc_feature 1..22: note = Description of Artificial Sequence: Syntheticoligonucleotide
  source 1..22: mol_type = other DNA
caccgactcatatgagtcggtg

SEQ ID NO: 11218 - DNA, 22 bp, synthetic construct
  misc_feature 1..22: note = Description of Artificial Sequence: Syntheticoligonucleotide
  source 1..22: mol_type = other DNA
ctccgactcatatgagtcggag

SEQ ID NO: 11219 - DNA, 22 bp, synthetic construct
  misc_feature 1..22: note = Description of Artificial Sequence: Syntheticoligonucleotide
  source 1..22: mol_type = other DNA
gcgggactcatatgagtcccgc

SEQ ID NO: 11220 - DNA, 22 bp, synthetic construct
  misc_feature 1..22: note = Description of Artificial Sequence: Syntheticoligonucleotide
  source 1..22: mol_type = other DNA
gagggactcatatgagtccctc

SEQ ID NO: 11221 - DNA, 22 bp, synthetic construct
  misc_feature 1..22: note = Description of Artificial Sequence: Syntheticoligonucleotide
  source 1..22: mol_type = other DNA
gtgggactcatatgagtcccac

SEQ ID NO: 11222 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactcttaagagtcnnnn

SEQ ID NO: 11223 - DNA, 22 bp, synthetic construct
  misc_feature 1..22: note = Description of Artificial Sequence: Syntheticoligonucleotide
  source 1..22: mol_type = other DNA
ggcggactcttaagagtccgcc

SEQ ID NO: 11224 - DNA, 22 bp, synthetic construct
  misc_feature 1..22: note = Description of Artificial Sequence: Syntheticoligonucleotide
  source 1..22: mol_type = other DNA
agcggactcttaagagtccgct

SEQ ID NO: 11225 - DNA, 22 bp, synthetic construct
  misc_feature 1..22: note = Description of Artificial Sequence: Syntheticoligonucleotide
  source 1..22: mol_type = other DNA
gacggactcttaagagtccgtc

SEQ ID NO: 11226 - DNA, 22 bp, synthetic construct
  misc_feature 1..22: note = Description of Artificial Sequence: Syntheticoligonucleotide
  source 1..22: mol_type = other DNA
ggaggactcttaagagtcctcc

SEQ ID NO: 11227 - DNA, 22 bp, synthetic construct
  misc_feature 1..22: note = Description of Artificial Sequence: Syntheticoligonucleotide
  source 1..22: mol_type = other DNA
ggcagactcttaagagtctgcc

SEQ ID NO: 11228 - DNA, 22 bp, synthetic construct
  misc_feature 1..22: note = Description of Artificial Sequence: Syntheticoligonucleotide
  source 1..22: mol_type = other DNA
tgcggactcttaagagtccgca

SEQ ID NO: 11229 - DNA, 22 bp, synthetic construct
  misc_feature 1..22: note = Description of Artificial Sequence: Syntheticoligonucleotide
  source 1..22: mol_type = other DNA
gtcggactcttaagagtccgac

SEQ ID NO: 11230 - DNA, 22 bp, synthetic construct
  misc_feature 1..22: note = Description of Artificial Sequence: Syntheticoligonucleotide
  source 1..22: mol_type = other DNA
ggtggactcttaagagtccacc

SEQ ID NO: 11231 - DNA, 22 bp, synthetic construct
  misc_feature 1..22: note = Description of Artificial Sequence: Syntheticoligonucleotide
  source 1..22: mol_type = other DNA
ggctgactcttaagagtcagcc

SEQ ID NO: 11232 - DNA, 22 bp, synthetic construct
  misc_feature 1..22: note = Description of Artificial Sequence: Syntheticoligonucleotide
  source 1..22: mol_type = other DNA
gcccgactcttaagagtcgggc

SEQ ID NO: 11233 - DNA, 22 bp, synthetic construct
  misc_feature 1..22: note = Description of Artificial Sequence: Syntheticoligonucleotide
  source 1..22: mol_type = other DNA
acccgactcttaagagtcgggt

SEQ ID NO: 11234 - DNA, 22 bp, synthetic construct
  misc_feature 1..22: note = Description of Artificial Sequence: Syntheticoligonucleotide
  source 1..22: mol_type = other DNA
gaccgactcttaagagtcggtc

SEQ ID NO: 11235 - DNA, 22 bp, synthetic construct
  misc_feature 1..22: note = Description of Artificial Sequence: Syntheticoligonucleotide
  source 1..22: mol_type = other DNA
gcacgactcttaagagtcgtgc

SEQ ID NO: 11236 - DNA, 22 bp, synthetic construct
  misc_feature 1..22: note = Description of Artificial Sequence: Syntheticoligonucleotide
  source 1..22: mol_type = other DNA
gccagactcttaagagtctggc

SEQ ID NO: 11237 - DNA, 22 bp, synthetic construct
  misc_feature 1..22: note = Description of Artificial Sequence: Syntheticoligonucleotide
  source 1..22: mol_type = other DNA
tcccgactcttaagagtcggga

SEQ ID NO: 11238 - DNA, 22 bp, synthetic construct
  misc_feature 1..22: note = Description of Artificial Sequence: Syntheticoligonucleotide
  source 1..22: mol_type = other DNA
gtccgactcttaagagtcggac

SEQ ID NO: 11239 - DNA, 22 bp, synthetic construct
  misc_feature 1..22: note = Description of Artificial Sequence: Syntheticoligonucleotide
  source 1..22: mol_type = other DNA
gcctgactcttaagagtcaggc

SEQ ID NO: 11240 - DNA, 22 bp, synthetic construct
  misc_feature 1..22: note = Description of Artificial Sequence: Syntheticoligonucleotide
  source 1..22: mol_type = other DNA
gggcgactcttaagagtcgccc

SEQ ID NO: 11241 - DNA, 22 bp, synthetic construct
  misc_feature 1..22: note = Description of Artificial Sequence: Syntheticoligonucleotide
  source 1..22: mol_type = other DNA
aggcgactcttaagagtcgcct

SEQ ID NO: 11242 - DNA, 22 bp, synthetic construct
  misc_feature 1..22: note = Description of Artificial Sequence: Syntheticoligonucleotide
  source 1..22: mol_type = other DNA
gagcgactcttaagagtcgctc

SEQ ID NO: 11243 - DNA, 22 bp, synthetic construct
  misc_feature 1..22: note = Description of Artificial Sequence: Syntheticoligonucleotide
  source 1..22: mol_type = other DNA
ggacgactcttaagagtcgtcc

SEQ ID NO: 11244 - DNA, 22 bp, synthetic construct
  misc_feature 1..22: note = Description of Artificial Sequence: Syntheticoligonucleotide
  source 1..22: mol_type = other DNA
gggagactcttaagagtctccc

SEQ ID NO: 11245 - DNA, 22 bp, synthetic construct
  misc_feature 1..22: note = Description of Artificial Sequence: Syntheticoligonucleotide
  source 1..22: mol_type = other DNA
tggcgactcttaagagtcgcca

SEQ ID NO: 11246 - DNA, 22 bp, synthetic construct
  misc_feature 1..22: note = Description of Artificial Sequence: Syntheticoligonucleotide
  source 1..22: mol_type = other DNA
gtgcgactcttaagagtcgcac

SEQ ID NO: 11247 - DNA, 22 bp, synthetic construct
  misc_feature 1..22: note = Description of Artificial Sequence: Syntheticoligonucleotide
  source 1..22: mol_type = other DNA
gggtgactcttaagagtcaccc

SEQ ID NO: 11248 - DNA, 22 bp, synthetic construct
  misc_feature 1..22: note = Description of Artificial Sequence: Syntheticoligonucleotide
  source 1..22: mol_type = other DNA
acgggactcttaagagtcccgt

SEQ ID NO: 11249 - DNA, 22 bp, synthetic construct
  misc_feature 1..22: note = Description of Artificial Sequence: Syntheticoligonucleotide
  source 1..22: mol_type = other DNA
cagggactcttaagagtccctg

SEQ ID NO: 11250 - DNA, 22 bp, synthetic construct
  misc_feature 1..22: note = Description of Artificial Sequence: Syntheticoligonucleotide
  source 1..22: mol_type = other DNA
ccaggactcttaagagtcctgg

SEQ ID NO: 11251 - DNA, 22 bp, synthetic construct
  misc_feature 1..22: note = Description of Artificial Sequence: Syntheticoligonucleotide
  source 1..22: mol_type = other DNA
ccgagactcttaagagtctcgg

SEQ ID NO: 11252 - DNA, 22 bp, synthetic construct
  misc_feature 1..22: note = Description of Artificial Sequence: Syntheticoligonucleotide
  source 1..22: mol_type = other DNA
tcgggactcttaagagtcccga

SEQ ID NO: 11253 - DNA, 22 bp, synthetic construct
  misc_feature 1..22: note = Description of Artificial Sequence: Syntheticoligonucleotide
  source 1..22: mol_type = other DNA
ctgggactcttaagagtcccag

SEQ ID NO: 11254 - DNA, 22 bp, synthetic construct
  misc_feature 1..22: note = Description of Artificial Sequence: Syntheticoligonucleotide
  source 1..22: mol_type = other DNA
cctggactcttaagagtccagg

SEQ ID NO: 11255 - DNA, 22 bp, synthetic construct
  misc_feature 1..22: note = Description of Artificial Sequence: Syntheticoligonucleotide
  source 1..22: mol_type = other DNA
ccgtgactcttaagagtcacgg

SEQ ID NO: 11256 - DNA, 22 bp, synthetic construct
  misc_feature 1..22: note = Description of Artificial Sequence: Syntheticoligonucleotide
  source 1..22: mol_type = other DNA
cggcgactcttaagagtcgccg

SEQ ID NO: 11257 - DNA, 22 bp, synthetic construct
  misc_feature 1..22: note = Description of Artificial Sequence: Syntheticoligonucleotide
  source 1..22: mol_type = other DNA
cagcgactcttaagagtcgctg

SEQ ID NO: 11258 - DNA, 22 bp, synthetic construct
  misc_feature 1..22: note = Description of Artificial Sequence: Syntheticoligonucleotide
  source 1..22: mol_type = other DNA
cgacgactcttaagagtcgtcg

SEQ ID NO: 11259 - DNA, 22 bp, synthetic construct
  misc_feature 1..22: note = Description of Artificial Sequence: Syntheticoligonucleotide
  source 1..22: mol_type = other DNA
cggagactcttaagagtctccg

SEQ ID NO: 11260 - DNA, 22 bp, synthetic construct
  misc_feature 1..22: note = Description of Artificial Sequence: Syntheticoligonucleotide
  source 1..22: mol_type = other DNA
ctgcgactcttaagagtcgcag

SEQ ID NO: 11261 - DNA, 22 bp, synthetic construct
  misc_feature 1..22: note = Description of Artificial Sequence: Syntheticoligonucleotide
  source 1..22: mol_type = other DNA
cggtgactcttaagagtcaccg

SEQ ID NO: 11262 - DNA, 22 bp, synthetic construct
  misc_feature 1..22: note = Description of Artificial Sequence: Syntheticoligonucleotide
  source 1..22: mol_type = other DNA
cacggactcttaagagtccgtg

SEQ ID NO: 11263 - DNA, 22 bp, synthetic construct
  misc_feature 1..22: note = Description of Artificial Sequence: Syntheticoligonucleotide
  source 1..22: mol_type = other DNA
cccagactcttaagagtctggg

SEQ ID NO: 11264 - DNA, 22 bp, synthetic construct
  misc_feature 1..22: note = Description of Artificial Sequence: Syntheticoligonucleotide
  source 1..22: mol_type = other DNA
ctcggactcttaagagtccgag

SEQ ID NO: 11265 - DNA, 22 bp, synthetic construct
  misc_feature 1..22: note = Description of Artificial Sequence: Syntheticoligonucleotide
  source 1..22: mol_type = other DNA
ccctgactcttaagagtcaggg

SEQ ID NO: 11266 - DNA, 22 bp, synthetic construct
  misc_feature 1..22: note = Description of Artificial Sequence: Syntheticoligonucleotide
  source 1..22: mol_type = other DNA
ccacgactcttaagagtcgtgg

SEQ ID NO: 11267 - DNA, 22 bp, synthetic construct
  misc_feature 1..22: note = Description of Artificial Sequence: Syntheticoligonucleotide
  source 1..22: mol_type = other DNA
agccgactcttaagagtcggct

SEQ ID NO: 11268 - DNA, 22 bp, synthetic construct
  misc_feature 1..22: note = Description of Artificial Sequence: Syntheticoligonucleotide
  source 1..22: mol_type = other DNA
tgccgactcttaagagtcggca

SEQ ID NO: 11269 - DNA, 22 bp, synthetic construct
  misc_feature 1..22: note = Description of Artificial Sequence: Syntheticoligonucleotide
  source 1..22: mol_type = other DNA
gcgagactcttaagagtctcgc

SEQ ID NO: 11270 - DNA, 22 bp, synthetic construct
  misc_feature 1..22: note = Description of Artificial Sequence: Syntheticoligonucleotide
  source 1..22: mol_type = other DNA
gcgtgactcttaagagtcacgc

SEQ ID NO: 11271 - DNA, 22 bp, synthetic construct
  misc_feature 1..22: note = Description of Artificial Sequence: Syntheticoligonucleotide
  source 1..22: mol_type = other DNA
gcaggactcttaagagtcctgc

SEQ ID NO: 11272 - DNA, 22 bp, synthetic construct
  misc_feature 1..22: note = Description of Artificial Sequence: Syntheticoligonucleotide
  source 1..22: mol_type = other DNA
gctggactcttaagagtccagc

SEQ ID NO: 11273 - DNA, 22 bp, synthetic construct
  misc_feature 1..22: note = Description of Artificial Sequence: Syntheticoligonucleotide
  source 1..22: mol_type = other DNA
cgaggactcttaagagtcctcg

SEQ ID NO: 11274 - DNA, 22 bp, synthetic construct
  misc_feature 1..22: note = Description of Artificial Sequence: Syntheticoligonucleotide
  source 1..22: mol_type = other DNA
cgtggactcttaagagtccacg

SEQ ID NO: 11275 - DNA, 22 bp, synthetic construct
  misc_feature 1..22: note = Description of Artificial Sequence: Syntheticoligonucleotide
  source 1..22: mol_type = other DNA
caccgactcttaagagtcggtg

SEQ ID NO: 11276 - DNA, 22 bp, synthetic construct
  misc_feature 1..22: note = Description of Artificial Sequence: Syntheticoligonucleotide
  source 1..22: mol_type = other DNA
ctccgactcttaagagtcggag

SEQ ID NO: 11277 - DNA, 22 bp, synthetic construct
  misc_feature 1..22: note = Description of Artificial Sequence: Syntheticoligonucleotide
  source 1..22: mol_type = other DNA
gcgggactcttaagagtcccgc

SEQ ID NO: 11278 - DNA, 22 bp, synthetic construct
  misc_feature 1..22: note = Description of Artificial Sequence: Syntheticoligonucleotide
  source 1..22: mol_type = other DNA
gagggactcttaagagtccctc

SEQ ID NO: 11279 - DNA, 22 bp, synthetic construct
  misc_feature 1..22: note = Description of Artificial Sequence: Syntheticoligonucleotide
  source 1..22: mol_type = other DNA
gtgggactcttaagagtcccac

SEQ ID NO: 11280 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactccgcggagtcnnnn

SEQ ID NO: 11281 - DNA, 21 bp, synthetic construct
  misc_feature 1..21: note = Description of Artificial Sequence: Syntheticoligonucleotide
  source 1..21: mol_type = other DNA
gcggactccgcggagtccgcc

SEQ ID NO: 11282 - DNA, 21 bp, synthetic construct
  misc_feature 1..21: note = Description of Artificial Sequence: Syntheticoligonucleotide
  source 1..21: mol_type = other DNA
gcggactccgcggagtccgct

SEQ ID NO: 11283 - DNA, 21 bp, synthetic construct
  misc_feature 1..21: note = Description of Artificial Sequence: Syntheticoligonucleotide
  source 1..21: mol_type = other DNA
acggactccgcggagtccgtc

SEQ ID NO: 11284 - DNA, 21 bp, synthetic construct
  misc_feature 1..21: note = Description of Artificial Sequence: Syntheticoligonucleotide
  source 1..21: mol_type = other DNA
gaggactccgcggagtcctcc

SEQ ID NO: 11285 - DNA, 21 bp, synthetic construct
  misc_feature 1..21: note = Description of Artificial Sequence: Syntheticoligonucleotide
  source 1..21: mol_type = other DNA
gcagactccgcggagtctgcc

SEQ ID NO: 11286 - DNA, 21 bp, synthetic construct
  misc_feature 1..21: note = Description of Artificial Sequence: Syntheticoligonucleotide
  source 1..21: mol_type = other DNA
gcggactccgcggagtccgca

SEQ ID NO: 11287 - DNA, 21 bp, synthetic construct
  misc_feature 1..21: note = Description of Artificial Sequence: Syntheticoligonucleotide
  source 1..21: mol_type = other DNA
tcggactccgcggagtccgac

SEQ ID NO: 11288 - DNA, 21 bp, synthetic construct
  misc_feature 1..21: note = Description of Artificial Sequence: Syntheticoligonucleotide
  source 1..21: mol_type = other DNA
gtggactccgcggagtccacc

SEQ ID NO: 11289 - DNA, 21 bp, synthetic construct
  misc_feature 1..21: note = Description of Artificial Sequence: Syntheticoligonucleotide
  source 1..21: mol_type = other DNA
gctgactccgcggagtcagcc

SEQ ID NO: 11290 - DNA, 21 bp, synthetic construct
  misc_feature 1..21: note = Description of Artificial Sequence: Syntheticoligonucleotide
  source 1..21: mol_type = other DNA
cccgactccgcggagtcgggc

SEQ ID NO: 11291 - DNA, 21 bp, synthetic construct
  misc_feature 1..21: note = Description of Artificial Sequence: Syntheticoligonucleotide
  source 1..21: mol_type = other DNA
cccgactccgcggagtcgggt

SEQ ID NO: 11292 - DNA, 21 bp, synthetic construct
  misc_feature 1..21: note = Description of Artificial Sequence: Syntheticoligonucleotide
  source 1..21: mol_type = other DNA
accgactccgcggagtcggtc

SEQ ID NO: 11293 - DNA, 21 bp, synthetic construct
  misc_feature 1..21: note = Description of Artificial Sequence: Syntheticoligonucleotide
  source 1..21: mol_type = other DNA
cacgactccgcggagtcgtgc

SEQ ID NO: 11294 - DNA, 21 bp, synthetic construct
  misc_feature 1..21: note = Description of Artificial Sequence: Syntheticoligonucleotide
  source 1..21: mol_type = other DNA
ccagactccgcggagtctggc

SEQ ID NO: 11295 - DNA, 21 bp, synthetic construct
  misc_feature 1..21: note = Description of Artificial Sequence: Syntheticoligonucleotide
  source 1..21: mol_type = other DNA
cccgactccgcggagtcggga

SEQ ID NO: 11296 - DNA, 21 bp, synthetic construct
  misc_feature 1..21: note = Description of Artificial Sequence: Syntheticoligonucleotide
  source 1..21: mol_type = other DNA
tccgactccgcggagtcggac

SEQ ID NO: 11297 - DNA, 21 bp, synthetic construct
  misc_feature 1..21: note = Description of Artificial Sequence: Syntheticoligonucleotide
  source 1..21: mol_type = other DNA
cctgactccgcggagtcaggc

SEQ ID NO: 11298 - DNA, 21 bp, synthetic construct
  misc_feature 1..21: note = Description of Artificial Sequence: Syntheticoligonucleotide
  source 1..21: mol_type = other DNA
ggcgactccgcggagtcgccc

SEQ ID NO: 11299 - DNA, 21 bp, synthetic construct
  misc_feature 1..21: note = Description of Artificial Sequence: Syntheticoligonucleotide
  source 1..21: mol_type = other DNA
ggcgactccgcggagtcgcct

SEQ ID NO: 11300 - DNA, 21 bp, synthetic construct
  misc_feature 1..21: note = Description of Artificial Sequence: Syntheticoligonucleotide
  source 1..21: mol_type = other DNA
agcgactccgcggagtcgctc

SEQ ID NO: 11301 - DNA, 21 bp, synthetic construct
  misc_feature 1..21: note = Description of Artificial Sequence: Syntheticoligonucleotide
  source 1..21: mol_type = other DNA
gacgactccgcggagtcgtcc

SEQ ID NO: 11302 - DNA, 21 bp, synthetic construct
  misc_feature 1..21: note = Description of Artificial Sequence: Syntheticoligonucleotide
  source 1..21: mol_type = other DNA
ggagactccgcggagtctccc

SEQ ID NO: 11303 - DNA, 21 bp, synthetic construct
  misc_feature 1..21: note = Description of Artificial Sequence: Syntheticoligonucleotide
  source 1..21: mol_type = other DNA
ggcgactccgcggagtcgcca

SEQ ID NO: 11304 - DNA, 21 bp, synthetic construct
  misc_feature 1..21: note = Description of Artificial Sequence: Syntheticoligonucleotide
  source 1..21: mol_type = other DNA
tgcgactccgcggagtcgcac

SEQ ID NO: 11305 - DNA, 21 bp, synthetic construct
  misc_feature 1..21: note = Description of Artificial Sequence: Syntheticoligonucleotide
  source 1..21: mol_type = other DNA
ggtgactccgcggagtcaccc

SEQ ID NO: 11306 - DNA, 21 bp, synthetic construct
  misc_feature 1..21: note = Description of Artificial Sequence: Syntheticoligonucleotide
  source 1..21: mol_type = other DNA
cgggactccgcggagtcccgt

SEQ ID NO: 11307 - DNA, 21 bp, synthetic construct
  misc_feature 1..21: note = Description of Artificial Sequence: Syntheticoligonucleotide
  source 1..21: mol_type = other DNA
agggactccgcggagtccctg

SEQ ID NO: 11308 - DNA, 21 bp, synthetic construct
  misc_feature 1..21: note = Description of Artificial Sequence: Syntheticoligonucleotide
  source 1..21: mol_type = other DNA
caggactccgcggagtcctgg

SEQ ID NO: 11309 - DNA, 21 bp, synthetic construct
  misc_feature 1..21: note = Description of Artificial Sequence: Syntheticoligonucleotide
  source 1..21: mol_type = other DNA
cgagactccgcggagtctcgg

SEQ ID NO: 11310 - DNA, 21 bp, synthetic construct
  misc_feature 1..21: note = Description of Artificial Sequence: Syntheticoligonucleotide
  source 1..21: mol_type = other DNA
cgggactccgcggagtcccga

SEQ ID NO: 11311 - DNA, 21 bp, synthetic construct
  misc_feature 1..21: note = Description of Artificial Sequence: Syntheticoligonucleotide
  source 1..21: mol_type = other DNA
tgggactccgcggagtcccag

SEQ ID NO: 11312 - DNA, 21 bp, synthetic construct
  misc_feature 1..21: note = Description of Artificial Sequence: Syntheticoligonucleotide
  source 1..21: mol_type = other DNA
ctggactccgcggagtccagg

SEQ ID NO: 11313 - DNA, 21 bp, synthetic construct
  misc_feature 1..21: note = Description of Artificial Sequence: Syntheticoligonucleotide
  source 1..21: mol_type = other DNA
cgtgactccgcggagtcacgg

SEQ ID NO: 11314 - DNA, 21 bp, synthetic construct
  misc_feature 1..21: note = Description of Artificial Sequence: Syntheticoligonucleotide
  source 1..21: mol_type = other DNA
ggcgactccgcggagtcgccg

SEQ ID NO: 11315 - DNA, 21 bp, synthetic construct
  misc_feature 1..21: note = Description of Artificial Sequence: Syntheticoligonucleotide
  source 1..21: mol_type = other DNA
agcgactccgcggagtcgctg

SEQ ID NO: 11316 - DNA, 21 bp, synthetic construct
  misc_feature 1..21: note = Description of Artificial Sequence: Syntheticoligonucleotide
  source 1..21: mol_type = other DNA
gacgactccgcggagtcgtcg

SEQ ID NO: 11317 - DNA, 21 bp, synthetic construct
  misc_feature 1..21: note = Description of Artificial Sequence: Syntheticoligonucleotide
  source 1..21: mol_type = other DNA
ggagactccgcggagtctccg

SEQ ID NO: 11318 - DNA, 21 bp, synthetic construct
  misc_feature 1..21: note = Description of Artificial Sequence: Syntheticoligonucleotide
  source 1..21: mol_type = other DNA
tgcgactccgcggagtcgcag

SEQ ID NO: 11319 - DNA, 21 bp, synthetic construct
  misc_feature 1..21: note = Description of Artificial Sequence: Syntheticoligonucleotide
  source 1..21: mol_type = other DNA
ggtgactccgcggagtcaccg

SEQ ID NO: 11320 - DNA, 21 bp, synthetic construct
  misc_feature 1..21: note = Description of Artificial Sequence: Syntheticoligonucleotide
  source 1..21: mol_type = other DNA
acggactccgcggagtccgtg

SEQ ID NO: 11321 - DNA, 21 bp, synthetic construct
  misc_feature 1..21: note = Description of Artificial Sequence: Syntheticoligonucleotide
  source 1..21: mol_type = other DNA
ccagactccgcggagtctggg

SEQ ID NO: 11322 - DNA, 21 bp, synthetic construct
  misc_feature 1..21: note = Description of Artificial Sequence: Syntheticoligonucleotide
  source 1..21: mol_type = other DNA
tcggactccgcggagtccgag

SEQ ID NO: 11323 - DNA, 21 bp, synthetic construct
  misc_feature 1..21: note = Description of Artificial Sequence: Syntheticoligonucleotide
  source 1..21: mol_type = other DNA
cctgactccgcggagtcaggg

SEQ ID NO: 11324 - DNA, 21 bp, synthetic construct
  misc_feature 1..21: note = Description of Artificial Sequence: Syntheticoligonucleotide
  source 1..21: mol_type = other DNA
cacgactccgcggagtcgtgg

SEQ ID NO: 11325 - DNA, 21 bp, synthetic construct
  misc_feature 1..21: note = Description of Artificial Sequence: Syntheticoligonucleotide
  source 1..21: mol_type = other DNA
gccgactccgcggagtcggct

SEQ ID NO: 11326 - DNA, 21 bp, synthetic construct
  misc_feature 1..21: note = Description of Artificial Sequence: Syntheticoligonucleotide
  source 1..21: mol_type = other DNA
gccgactccgcggagtcggca

SEQ ID NO: 11327 - DNA, 21 bp, synthetic construct
  misc_feature 1..21: note = Description of Artificial Sequence: Syntheticoligonucleotide
  source 1..21: mol_type = other DNA
cgagactccgcggagtctcgc

SEQ ID NO: 11328 - DNA, 21 bp, synthetic construct
  misc_feature 1..21: note = Description of Artificial Sequence: Syntheticoligonucleotide
  source 1..21: mol_type = other DNA
cgtgactccgcggagtcacgc

SEQ ID NO: 11329 - DNA, 21 bp, synthetic construct
  misc_feature 1..21: note = Description of Artificial Sequence: Syntheticoligonucleotide
  source 1..21: mol_type = other DNA
caggactccgcggagtcctgc

SEQ ID NO: 11330 - DNA, 21 bp, synthetic construct
  misc_feature 1..21: note = Description of Artificial Sequence: Syntheticoligonucleotide
  source 1..21: mol_type = other DNA
ctggactccgcggagtccagc

SEQ ID NO: 11331 - DNA, 21 bp, synthetic construct
  misc_feature 1..21: note = Description of Artificial Sequence: Syntheticoligonucleotide
  source 1..21: mol_type = other DNA
gaggactccgcggagtcctcg

SEQ ID NO: 11332 - DNA, 21 bp, synthetic construct
  misc_feature 1..21: note = Description of Artificial Sequence: Syntheticoligonucleotide
  source 1..21: mol_type = other DNA
gtggactccgcggagtccacg

SEQ ID NO: 11333 - DNA, 21 bp, synthetic construct
  misc_feature 1..21: note = Description of Artificial Sequence: Syntheticoligonucleotide
  source 1..21: mol_type = other DNA
accgactccgcggagtcggtg

SEQ ID NO: 11334 - DNA, 21 bp, synthetic construct
  misc_feature 1..21: note = Description of Artificial Sequence: Syntheticoligonucleotide
  source 1..21: mol_type = other DNA
tccgactccgcggagtcggag

SEQ ID NO: 11335 - DNA, 21 bp, synthetic construct
  misc_feature 1..21: note = Description of Artificial Sequence: Syntheticoligonucleotide
  source 1..21: mol_type = other DNA
cgggactccgcggagtcccgc

SEQ ID NO: 11336 - DNA, 21 bp, synthetic construct
  misc_feature 1..21: note = Description of Artificial Sequence: Syntheticoligonucleotide
  source 1..21: mol_type = other DNA
agggactccgcggagtccctc

SEQ ID NO: 11337 - DNA, 21 bp, synthetic construct
  misc_feature 1..21: note = Description of Artificial Sequence: Syntheticoligonucleotide
  source 1..21: mol_type = other DNA
tgggactccgcggagtcccac

SEQ ID NO: 11338 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactctgcagagtcnnnn

SEQ ID NO: 11339 - DNA, 21 bp, synthetic construct
  misc_feature 1..21: note = Description of Artificial Sequence: Syntheticoligonucleotide
  source 1..21: mol_type = other DNA
gcggactctgcagagtccgcc

SEQ ID NO: 11340 - DNA, 21 bp, synthetic construct
  misc_feature 1..21: note = Description of Artificial Sequence: Syntheticoligonucleotide
  source 1..21: mol_type = other DNA
gcggactctgcagagtccgct

SEQ ID NO: 11341 - DNA, 21 bp, synthetic construct
  misc_feature 1..21: note = Description of Artificial Sequence: Syntheticoligonucleotide
  source 1..21: mol_type = other DNA
acggactctgcagagtccgtc

SEQ ID NO: 11342 - DNA, 21 bp, synthetic construct
  misc_feature 1..21: note = Description of Artificial Sequence: Syntheticoligonucleotide
  source 1..21: mol_type = other DNA
gaggactctgcagagtcctcc

SEQ ID NO: 11343 - DNA, 21 bp, synthetic construct
  misc_feature 1..21: note = Description of Artificial Sequence: Syntheticoligonucleotide
  source 1..21: mol_type = other DNA
gcagactctgcagagtctgcc

SEQ ID NO: 11344 - DNA, 21 bp, synthetic construct
  misc_feature 1..21: note = Description of Artificial Sequence: Syntheticoligonucleotide
  source 1..21: mol_type = other DNA
gcggactctgcagagtccgca

SEQ ID NO: 11345 - DNA, 21 bp, synthetic construct
  misc_feature 1..21: note = Description of Artificial Sequence: Syntheticoligonucleotide
  source 1..21: mol_type = other DNA
tcggactctgcagagtccgac

SEQ ID NO: 11346 - DNA, 21 bp, synthetic construct
  misc_feature 1..21: note = Description of Artificial Sequence: Syntheticoligonucleotide
  source 1..21: mol_type = other DNA
gtggactctgcagagtccacc

SEQ ID NO: 11347 - DNA, 21 bp, synthetic construct
  misc_feature 1..21: note = Description of Artificial Sequence: Syntheticoligonucleotide
  source 1..21: mol_type = other DNA
gctgactctgcagagtcagcc

SEQ ID NO: 11348 - DNA, 21 bp, synthetic construct
  misc_feature 1..21: note = Description of Artificial Sequence: Syntheticoligonucleotide
  source 1..21: mol_type = other DNA
cccgactctgcagagtcgggc

SEQ ID NO: 11349 - DNA, 21 bp, synthetic construct
  misc_feature 1..21: note = Description of Artificial Sequence: Syntheticoligonucleotide
  source 1..21: mol_type = other DNA
cccgactctgcagagtcgggt

SEQ ID NO: 11350 - DNA, 21 bp, synthetic construct
  misc_feature 1..21: note = Description of Artificial Sequence: Syntheticoligonucleotide
  source 1..21: mol_type = other DNA
accgactctgcagagtcggtc

SEQ ID NO: 11351 - DNA, 21 bp, synthetic construct
  misc_feature 1..21: note = Description of Artificial Sequence: Syntheticoligonucleotide
  source 1..21: mol_type = other DNA
cacgactctgcagagtcgtgc

SEQ ID NO: 11352 - DNA, 21 bp, synthetic construct
  misc_feature 1..21: note = Description of Artificial Sequence: Syntheticoligonucleotide
  source 1..21: mol_type = other DNA
ccagactctgcagagtctggc

SEQ ID NO: 11353 - DNA, 21 bp, synthetic construct
  misc_feature 1..21: note = Description of Artificial Sequence: Syntheticoligonucleotide
  source 1..21: mol_type = other DNA
cccgactctgcagagtcggga

SEQ ID NO: 11354 - DNA, 21 bp, synthetic construct
  misc_feature 1..21: note = Description of Artificial Sequence: Syntheticoligonucleotide
  source 1..21: mol_type = other DNA
tccgactctgcagagtcggac

SEQ ID NO: 11355 - DNA, 21 bp, synthetic construct
  misc_feature 1..21: note = Description of Artificial Sequence: Syntheticoligonucleotide
  source 1..21: mol_type = other DNA
cctgactctgcagagtcaggc

SEQ ID NO: 11356 - DNA, 21 bp, synthetic construct
  misc_feature 1..21: note = Description of Artificial Sequence: Syntheticoligonucleotide
  source 1..21: mol_type = other DNA
ggcgactctgcagagtcgccc

SEQ ID NO: 11357 - DNA, 21 bp, synthetic construct
  misc_feature 1..21: note = Description of Artificial Sequence: Syntheticoligonucleotide
  source 1..21: mol_type = other DNA
ggcgactctgcagagtcgcct

SEQ ID NO: 11358 - DNA, 21 bp, synthetic construct
  misc_feature 1..21: note = Description of Artificial Sequence: Syntheticoligonucleotide
  source 1..21: mol_type = other DNA
agcgactctgcagagtcgctc

SEQ ID NO: 11359 - DNA, 21 bp, synthetic construct
  misc_feature 1..21: note = Description of Artificial Sequence: Syntheticoligonucleotide
  source 1..21: mol_type = other DNA
gacgactctgcagagtcgtcc

SEQ ID NO: 11360 - DNA, 21 bp, synthetic construct
  misc_feature 1..21: note = Description of Artificial Sequence: Syntheticoligonucleotide
  source 1..21: mol_type = other DNA
ggagactctgcagagtctccc

SEQ ID NO: 11361 - DNA, 21 bp, synthetic construct
  misc_feature 1..21: note = Description of Artificial Sequence: Syntheticoligonucleotide
  source 1..21: mol_type = other DNA
ggcgactctgcagagtcgcca

SEQ ID NO: 11362 - DNA, 21 bp, synthetic construct
  misc_feature 1..21: note = Description of Artificial Sequence: Syntheticoligonucleotide
  source 1..21: mol_type = other DNA
tgcgactctgcagagtcgcac

SEQ ID NO: 11363 - DNA, 21 bp, synthetic construct
  misc_feature 1..21: note = Description of Artificial Sequence: Syntheticoligonucleotide
  source 1..21: mol_type = other DNA
ggtgactctgcagagtcaccc

SEQ ID NO: 11364 - DNA, 21 bp, synthetic construct
  misc_feature 1..21: note = Description of Artificial Sequence: Syntheticoligonucleotide
  source 1..21: mol_type = other DNA
cgggactctgcagagtcccgt

SEQ ID NO: 11365 - DNA, 21 bp, synthetic construct
  misc_feature 1..21: note = Description of Artificial Sequence: Syntheticoligonucleotide
  source 1..21: mol_type = other DNA
agggactctgcagagtccctg

SEQ ID NO: 11366 - DNA, 21 bp, synthetic construct
  misc_feature 1..21: note = Description of Artificial Sequence: Syntheticoligonucleotide
  source 1..21: mol_type = other DNA
caggactctgcagagtcctgg

SEQ ID NO: 11367 - DNA, 21 bp, synthetic construct
  misc_feature 1..21: note = Description of Artificial Sequence: Syntheticoligonucleotide
  source 1..21: mol_type = other DNA
cgagactctgcagagtctcgg

SEQ ID NO: 11368 - DNA, 21 bp, synthetic construct
  misc_feature 1..21: note = Description of Artificial Sequence: Syntheticoligonucleotide
  source 1..21: mol_type = other DNA
cgggactctgcagagtcccga

SEQ ID NO: 11369 - DNA, 21 bp, synthetic construct
  misc_feature 1..21: note = Description of Artificial Sequence: Syntheticoligonucleotide
  source 1..21: mol_type = other DNA
tgggactctgcagagtcccag

SEQ ID NO: 11370 - DNA, 21 bp, synthetic construct
  misc_feature 1..21: note = Description of Artificial Sequence: Syntheticoligonucleotide
  source 1..21: mol_type = other DNA
ctggactctgcagagtccagg

SEQ ID NO: 11371 - DNA, 21 bp, synthetic construct
  misc_feature 1..21: note = Description of Artificial Sequence: Syntheticoligonucleotide
  source 1..21: mol_type = other DNA
cgtgactctgcagagtcacgg

SEQ ID NO: 11372 - DNA, 21 bp, synthetic construct
  misc_feature 1..21: note = Description of Artificial Sequence: Syntheticoligonucleotide
  source 1..21: mol_type = other DNA
ggcgactctgcagagtcgccg

SEQ ID NO: 11373 - DNA, 21 bp, synthetic construct
  misc_feature 1..21: note = Description of Artificial Sequence: Syntheticoligonucleotide
  source 1..21: mol_type = other DNA
agcgactctgcagagtcgctg

SEQ ID NO: 11374 - DNA, 21 bp, synthetic construct
  misc_feature 1..21: note = Description of Artificial Sequence: Syntheticoligonucleotide
  source 1..21: mol_type = other DNA
gacgactctgcagagtcgtcg

SEQ ID NO: 11375 - DNA, 21 bp, synthetic construct
  misc_feature 1..21: note = Description of Artificial Sequence: Syntheticoligonucleotide
  source 1..21: mol_type = other DNA
ggagactctgcagagtctccg

SEQ ID NO: 11376 - DNA, 21 bp, synthetic construct
  misc_feature 1..21: note = Description of Artificial Sequence: Syntheticoligonucleotide
  source 1..21: mol_type = other DNA
tgcgactctgcagagtcgcag

SEQ ID NO: 11377 - DNA, 21 bp, synthetic construct
  misc_feature 1..21: note = Description of Artificial Sequence: Syntheticoligonucleotide
  source 1..21: mol_type = other DNA
ggtgactctgcagagtcaccg

SEQ ID NO: 11378 - DNA, 21 bp, synthetic construct
  misc_feature 1..21: note = Description of Artificial Sequence: Syntheticoligonucleotide
  source 1..21: mol_type = other DNA
acggactctgcagagtccgtg

SEQ ID NO: 11379 - DNA, 21 bp, synthetic construct
  misc_feature 1..21: note = Description of Artificial Sequence: Syntheticoligonucleotide
  source 1..21: mol_type = other DNA
ccagactctgcagagtctggg

SEQ ID NO: 11380 - DNA, 21 bp, synthetic construct
  misc_feature 1..21: note = Description of Artificial Sequence: Syntheticoligonucleotide
  source 1..21: mol_type = other DNA
tcggactctgcagagtccgag

SEQ ID NO: 11381 - DNA, 21 bp, synthetic construct
  misc_feature 1..21: note = Description of Artificial Sequence: Syntheticoligonucleotide
  source 1..21: mol_type = other DNA
cctgactctgcagagtcaggg

SEQ ID NO: 11382 - DNA, 21 bp, synthetic construct
  misc_feature 1..21: note = Description of Artificial Sequence: Syntheticoligonucleotide
  source 1..21: mol_type = other DNA
cacgactctgcagagtcgtgg

SEQ ID NO: 11383 - DNA, 21 bp, synthetic construct
  misc_feature 1..21: note = Description of Artificial Sequence: Syntheticoligonucleotide
  source 1..21: mol_type = other DNA
gccgactctgcagagtcggct

SEQ ID NO: 11384 - DNA, 21 bp, synthetic construct
  misc_feature 1..21: note = Description of Artificial Sequence: Syntheticoligonucleotide
  source 1..21: mol_type = other DNA
gccgactctgcagagtcggca

SEQ ID NO: 11385 - DNA, 21 bp, synthetic construct
  misc_feature 1..21: note = Description of Artificial Sequence: Syntheticoligonucleotide
  source 1..21: mol_type = other DNA
cgagactctgcagagtctcgc

SEQ ID NO: 11386 - DNA, 21 bp, synthetic construct
  misc_feature 1..21: note = Description of Artificial Sequence: Syntheticoligonucleotide
  source 1..21: mol_type = other DNA
cgtgactctgcagagtcacgc

SEQ ID NO: 11387 - DNA, 21 bp, synthetic construct
  misc_feature 1..21: note = Description of Artificial Sequence: Syntheticoligonucleotide
  source 1..21: mol_type = other DNA
caggactctgcagagtcctgc

SEQ ID NO: 11388 - DNA, 21 bp, synthetic construct
  misc_feature 1..21: note = Description of Artificial Sequence: Syntheticoligonucleotide
  source 1..21: mol_type = other DNA
ctggactctgcagagtccagc

SEQ ID NO: 11389 - DNA, 21 bp, synthetic construct
  misc_feature 1..21: note = Description of Artificial Sequence: Syntheticoligonucleotide
  source 1..21: mol_type = other DNA
gaggactctgcagagtcctcg

SEQ ID NO: 11390 - DNA, 21 bp, synthetic construct
  misc_feature 1..21: note = Description of Artificial Sequence: Syntheticoligonucleotide
  source 1..21: mol_type = other DNA
gtggactctgcagagtccacg

SEQ ID NO: 11391 - DNA, 21 bp, synthetic construct
  misc_feature 1..21: note = Description of Artificial Sequence: Syntheticoligonucleotide
  source 1..21: mol_type = other DNA
accgactctgcagagtcggtg

SEQ ID NO: 11392 - DNA, 21 bp, synthetic construct
  misc_feature 1..21: note = Description of Artificial Sequence: Syntheticoligonucleotide
  source 1..21: mol_type = other DNA
tccgactctgcagagtcggag

SEQ ID NO: 11393 - DNA, 21 bp, synthetic construct
  misc_feature 1..21: note = Description of Artificial Sequence: Syntheticoligonucleotide
  source 1..21: mol_type = other DNA
cgggactctgcagagtcccgc

SEQ ID NO: 11394 - DNA, 21 bp, synthetic construct
  misc_feature 1..21: note = Description of Artificial Sequence: Syntheticoligonucleotide
  source 1..21: mol_type = other DNA
agggactctgcagagtccctc

SEQ ID NO: 11395 - DNA, 21 bp, synthetic construct
  misc_feature 1..21: note = Description of Artificial Sequence: Syntheticoligonucleotide
  source 1..21: mol_type = other DNA
tgggactctgcagagtcccac

SEQ ID NO: 11396 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactcgcgcgagtcnnnn

SEQ ID NO: 11397 - DNA, 21 bp, synthetic construct
  misc_feature 1..21: note = Description of Artificial Sequence: Syntheticoligonucleotide
  source 1..21: mol_type = other DNA
gcggactcgcgcgagtccgcc

SEQ ID NO: 11398 - DNA, 21 bp, synthetic construct
  misc_feature 1..21: note = Description of Artificial Sequence: Syntheticoligonucleotide
  source 1..21: mol_type = other DNA
gcggactcgcgcgagtccgct

SEQ ID NO: 11399 - DNA, 21 bp, synthetic construct
  misc_feature 1..21: note = Description of Artificial Sequence: Syntheticoligonucleotide
  source 1..21: mol_type = other DNA
acggactcgcgcgagtccgtc

SEQ ID NO: 11400 - DNA, 21 bp, synthetic construct
  misc_feature 1..21: note = Description of Artificial Sequence: Syntheticoligonucleotide
  source 1..21: mol_type = other DNA
gaggactcgcgcgagtcctcc

SEQ ID NO: 11401 - DNA, 21 bp, synthetic construct
  misc_feature 1..21: note = Description of Artificial Sequence: Syntheticoligonucleotide
  source 1..21: mol_type = other DNA
gcagactcgcgcgagtctgcc

SEQ ID NO: 11402 - DNA, 21 bp, synthetic construct
  misc_feature 1..21: note = Description of Artificial Sequence: Syntheticoligonucleotide
  source 1..21: mol_type = other DNA
gcggactcgcgcgagtccgca

SEQ ID NO: 11403 - DNA, 21 bp, synthetic construct
  misc_feature 1..21: note = Description of Artificial Sequence: Syntheticoligonucleotide
  source 1..21: mol_type = other DNA
tcggactcgcgcgagtccgac

SEQ ID NO: 11404 - DNA, 21 bp, synthetic construct
  misc_feature 1..21: note = Description of Artificial Sequence: Syntheticoligonucleotide
  source 1..21: mol_type = other DNA
gtggactcgcgcgagtccacc

SEQ ID NO: 11405 - DNA, 21 bp, synthetic construct
  misc_feature 1..21: note = Description of Artificial Sequence: Syntheticoligonucleotide
  source 1..21: mol_type = other DNA
gctgactcgcgcgagtcagcc

SEQ ID NO: 11406 - DNA, 21 bp, synthetic construct
  misc_feature 1..21: note = Description of Artificial Sequence: Syntheticoligonucleotide
  source 1..21: mol_type = other DNA
cccgactcgcgcgagtcgggc

SEQ ID NO: 11407 - DNA, 21 bp, synthetic construct
  misc_feature 1..21: note = Description of Artificial Sequence: Syntheticoligonucleotide
  source 1..21: mol_type = other DNA
cccgactcgcgcgagtcgggt

SEQ ID NO: 11408 - DNA, 21 bp, synthetic construct
  misc_feature 1..21: note = Description of Artificial Sequence: Syntheticoligonucleotide
  source 1..21: mol_type = other DNA
accgactcgcgcgagtcggtc

SEQ ID NO: 11409 - DNA, 21 bp, synthetic construct
  misc_feature 1..21: note = Description of Artificial Sequence: Syntheticoligonucleotide
  source 1..21: mol_type = other DNA
cacgactcgcgcgagtcgtgc

SEQ ID NO: 11410 - DNA, 21 bp, synthetic construct
  misc_feature 1..21: note = Description of Artificial Sequence: Syntheticoligonucleotide
  source 1..21: mol_type = other DNA
ccagactcgcgcgagtctggc

SEQ ID NO: 11411 - DNA, 21 bp, synthetic construct
  misc_feature 1..21: note = Description of Artificial Sequence: Syntheticoligonucleotide
  source 1..21: mol_type = other DNA
cccgactcgcgcgagtcggga

SEQ ID NO: 11412 - DNA, 21 bp, synthetic construct
  misc_feature 1..21: note = Description of Artificial Sequence: Syntheticoligonucleotide
  source 1..21: mol_type = other DNA
tccgactcgcgcgagtcggac

SEQ ID NO: 11413 - DNA, 21 bp, synthetic construct
  misc_feature 1..21: note = Description of Artificial Sequence: Syntheticoligonucleotide
  source 1..21: mol_type = other DNA
cctgactcgcgcgagtcaggc

SEQ ID NO: 11414 - DNA, 21 bp, synthetic construct
  misc_feature 1..21: note = Description of Artificial Sequence: Syntheticoligonucleotide
  source 1..21: mol_type = other DNA
ggcgactcgcgcgagtcgccc

SEQ ID NO: 11415 - DNA, 21 bp, synthetic construct
  misc_feature 1..21: note = Description of Artificial Sequence: Syntheticoligonucleotide
  source 1..21: mol_type = other DNA
ggcgactcgcgcgagtcgcct

SEQ ID NO: 11416 - DNA, 21 bp, synthetic construct
  misc_feature 1..21: note = Description of Artificial Sequence: Syntheticoligonucleotide
  source 1..21: mol_type = other DNA
agcgactcgcgcgagtcgctc

SEQ ID NO: 11417 - DNA, 21 bp, synthetic construct
  misc_feature 1..21: note = Description of Artificial Sequence: Syntheticoligonucleotide
  source 1..21: mol_type = other DNA
gacgactcgcgcgagtcgtcc

SEQ ID NO: 11418 - DNA, 21 bp, synthetic construct
  misc_feature 1..21: note = Description of Artificial Sequence: Syntheticoligonucleotide
  source 1..21: mol_type = other DNA
ggagactcgcgcgagtctccc

SEQ ID NO: 11419 - DNA, 21 bp, synthetic construct
  misc_feature 1..21: note = Description of Artificial Sequence: Syntheticoligonucleotide
  source 1..21: mol_type = other DNA
ggcgactcgcgcgagtcgcca

SEQ ID NO: 11420 - DNA, 21 bp, synthetic construct
  misc_feature 1..21: note = Description of Artificial Sequence: Syntheticoligonucleotide
  source 1..21: mol_type = other DNA
tgcgactcgcgcgagtcgcac

SEQ ID NO: 11421 - DNA, 21 bp, synthetic construct
  misc_feature 1..21: note = Description of Artificial Sequence: Syntheticoligonucleotide
  source 1..21: mol_type = other DNA
ggtgactcgcgcgagtcaccc

SEQ ID NO: 11422 - DNA, 21 bp, synthetic construct
  misc_feature 1..21: note = Description of Artificial Sequence: Syntheticoligonucleotide
  source 1..21: mol_type = other DNA
cgggactcgcgcgagtcccgt

SEQ ID NO: 11423 - DNA, 21 bp, synthetic construct
  misc_feature 1..21: note = Description of Artificial Sequence: Syntheticoligonucleotide
  source 1..21: mol_type = other DNA
agggactcgcgcgagtccctg

SEQ ID NO: 11424 - DNA, 21 bp, synthetic construct
  misc_feature 1..21: note = Description of Artificial Sequence: Syntheticoligonucleotide
  source 1..21: mol_type = other DNA
caggactcgcgcgagtcctgg

SEQ ID NO: 11425 - DNA, 21 bp, synthetic construct
  misc_feature 1..21: note = Description of Artificial Sequence: Syntheticoligonucleotide
  source 1..21: mol_type = other DNA
cgagactcgcgcgagtctcgg

SEQ ID NO: 11426 - DNA, 21 bp, synthetic construct
  misc_feature 1..21: note = Description of Artificial Sequence: Syntheticoligonucleotide
  source 1..21: mol_type = other DNA
cgggactcgcgcgagtcccga

SEQ ID NO: 11427 - DNA, 21 bp, synthetic construct
  misc_feature 1..21: note = Description of Artificial Sequence: Syntheticoligonucleotide
  source 1..21: mol_type = other DNA
tgggactcgcgcgagtcccag

SEQ ID NO: 11428 - DNA, 21 bp, synthetic construct
  misc_feature 1..21: note = Description of Artificial Sequence: Syntheticoligonucleotide
  source 1..21: mol_type = other DNA
ctggactcgcgcgagtccagg

SEQ ID NO: 11429 - DNA, 21 bp, synthetic construct
  misc_feature 1..21: note = Description of Artificial Sequence: Syntheticoligonucleotide
  source 1..21: mol_type = other DNA
cgtgactcgcgcgagtcacgg

SEQ ID NO: 11430 - DNA, 21 bp, synthetic construct
  misc_feature 1..21: note = Description of Artificial Sequence: Syntheticoligonucleotide
  source 1..21: mol_type = other DNA
ggcgactcgcgcgagtcgccg

SEQ ID NO: 11431 - DNA, 21 bp, synthetic construct
  misc_feature 1..21: note = Description of Artificial Sequence: Syntheticoligonucleotide
  source 1..21: mol_type = other DNA
agcgactcgcgcgagtcgctg

SEQ ID NO: 11432 - DNA, 21 bp, synthetic construct
  misc_feature 1..21: note = Description of Artificial Sequence: Syntheticoligonucleotide
  source 1..21: mol_type = other DNA
gacgactcgcgcgagtcgtcg

SEQ ID NO: 11433 - DNA, 21 bp, synthetic construct
  misc_feature 1..21: note = Description of Artificial Sequence: Syntheticoligonucleotide
  source 1..21: mol_type = other DNA
ggagactcgcgcgagtctccg

SEQ ID NO: 11434 - DNA, 21 bp, synthetic construct
  misc_feature 1..21: note = Description of Artificial Sequence: Syntheticoligonucleotide
  source 1..21: mol_type = other DNA
tgcgactcgcgcgagtcgcag

SEQ ID NO: 11435 - DNA, 21 bp, synthetic construct
  misc_feature 1..21: note = Description of Artificial Sequence: Syntheticoligonucleotide
  source 1..21: mol_type = other DNA
ggtgactcgcgcgagtcaccg

SEQ ID NO: 11436 - DNA, 21 bp, synthetic construct
  misc_feature 1..21: note = Description of Artificial Sequence: Syntheticoligonucleotide
  source 1..21: mol_type = other DNA
acggactcgcgcgagtccgtg

SEQ ID NO: 11437 - DNA, 21 bp, synthetic construct
  misc_feature 1..21: note = Description of Artificial Sequence: Syntheticoligonucleotide
  source 1..21: mol_type = other DNA
ccagactcgcgcgagtctggg

SEQ ID NO: 11438 - DNA, 21 bp, synthetic construct
  misc_feature 1..21: note = Description of Artificial Sequence: Syntheticoligonucleotide
  source 1..21: mol_type = other DNA
tcggactcgcgcgagtccgag

SEQ ID NO: 11439 - DNA, 21 bp, synthetic construct
  misc_feature 1..21: note = Description of Artificial Sequence: Syntheticoligonucleotide
  source 1..21: mol_type = other DNA
cctgactcgcgcgagtcaggg

SEQ ID NO: 11440 - DNA, 21 bp, synthetic construct
  misc_feature 1..21: note = Description of Artificial Sequence: Syntheticoligonucleotide
  source 1..21: mol_type = other DNA
cacgactcgcgcgagtcgtgg

SEQ ID NO: 11441 - DNA, 21 bp, synthetic construct
  misc_feature 1..21: note = Description of Artificial Sequence: Syntheticoligonucleotide
  source 1..21: mol_type = other DNA
gccgactcgcgcgagtcggct

SEQ ID NO: 11442 - DNA, 21 bp, synthetic construct
  misc_feature 1..21: note = Description of Artificial Sequence: Syntheticoligonucleotide
  source 1..21: mol_type = other DNA
gccgactcgcgcgagtcggca

SEQ ID NO: 11443 - DNA, 21 bp, synthetic construct
  misc_feature 1..21: note = Description of Artificial Sequence: Syntheticoligonucleotide
  source 1..21: mol_type = other DNA
cgagactcgcgcgagtctcgc

SEQ ID NO: 11444 - DNA, 21 bp, synthetic construct
  misc_feature 1..21: note = Description of Artificial Sequence: Syntheticoligonucleotide
  source 1..21: mol_type = other DNA
cgtgactcgcgcgagtcacgc

SEQ ID NO: 11445 - DNA, 21 bp, synthetic construct
  misc_feature 1..21: note = Description of Artificial Sequence: Syntheticoligonucleotide
  source 1..21: mol_type = other DNA
caggactcgcgcgagtcctgc

SEQ ID NO: 11446 - DNA, 21 bp, synthetic construct
  misc_feature 1..21: note = Description of Artificial Sequence: Syntheticoligonucleotide
  source 1..21: mol_type = other DNA
ctggactcgcgcgagtccagc

SEQ ID NO: 11447 - DNA, 21 bp, synthetic construct
  misc_feature 1..21: note = Description of Artificial Sequence: Syntheticoligonucleotide
  source 1..21: mol_type = other DNA
gaggactcgcgcgagtcctcg

SEQ ID NO: 11448 - DNA, 21 bp, synthetic construct
  misc_feature 1..21: note = Description of Artificial Sequence: Syntheticoligonucleotide
  source 1..21: mol_type = other DNA
gtggactcgcgcgagtccacg

SEQ ID NO: 11449 - DNA, 21 bp, synthetic construct
  misc_feature 1..21: note = Description of Artificial Sequence: Syntheticoligonucleotide
  source 1..21: mol_type = other DNA
accgactcgcgcgagtcggtg

SEQ ID NO: 11450 - DNA, 21 bp, synthetic construct
  misc_feature 1..21: note = Description of Artificial Sequence: Syntheticoligonucleotide
  source 1..21: mol_type = other DNA
tccgactcgcgcgagtcggag

SEQ ID NO: 11451 - DNA, 21 bp, synthetic construct
  misc_feature 1..21: note = Description of Artificial Sequence: Syntheticoligonucleotide
  source 1..21: mol_type = other DNA
cgggactcgcgcgagtcccgc

SEQ ID NO: 11452 - DNA, 21 bp, synthetic construct
  misc_feature 1..21: note = Description of Artificial Sequence: Syntheticoligonucleotide
  source 1..21: mol_type = other DNA
agggactcgcgcgagtccctc

SEQ ID NO: 11453 - DNA, 21 bp, synthetic construct
  misc_feature 1..21: note = Description of Artificial Sequence: Syntheticoligonucleotide
  source 1..21: mol_type = other DNA
tgggactcgcgcgagtcccac

SEQ ID NO: 11454 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactcacgtgagtcnnnn

SEQ ID NO: 11455 - DNA, 21 bp, synthetic construct
  misc_feature 1..21: note = Description of Artificial Sequence: Syntheticoligonucleotide
  source 1..21: mol_type = other DNA
gcggactcacgtgagtccgcc

SEQ ID NO: 11456 - DNA, 21 bp, synthetic construct
  misc_feature 1..21: note = Description of Artificial Sequence: Syntheticoligonucleotide
  source 1..21: mol_type = other DNA
gcggactcacgtgagtccgct

SEQ ID NO: 11457 - DNA, 21 bp, synthetic construct
  misc_feature 1..21: note = Description of Artificial Sequence: Syntheticoligonucleotide
  source 1..21: mol_type = other DNA
acggactcacgtgagtccgtc

SEQ ID NO: 11458 - DNA, 21 bp, synthetic construct
  misc_feature 1..21: note = Description of Artificial Sequence: Syntheticoligonucleotide
  source 1..21: mol_type = other DNA
gaggactcacgtgagtcctcc

SEQ ID NO: 11459 - DNA, 21 bp, synthetic construct
  misc_feature 1..21: note = Description of Artificial Sequence: Syntheticoligonucleotide
  source 1..21: mol_type = other DNA
gcagactcacgtgagtctgcc

SEQ ID NO: 11460 - DNA, 21 bp, synthetic construct
  misc_feature 1..21: note = Description of Artificial Sequence: Syntheticoligonucleotide
  source 1..21: mol_type = other DNA
gcggactcacgtgagtccgca

SEQ ID NO: 11461 - DNA, 21 bp, synthetic construct
  misc_feature 1..21: note = Description of Artificial Sequence: Syntheticoligonucleotide
  source 1..21: mol_type = other DNA
tcggactcacgtgagtccgac

SEQ ID NO: 11462 - DNA, 21 bp, synthetic construct
  misc_feature 1..21: note = Description of Artificial Sequence: Syntheticoligonucleotide
  source 1..21: mol_type = other DNA
gtggactcacgtgagtccacc

SEQ ID NO: 11463 - DNA, 21 bp, synthetic construct
  misc_feature 1..21: note = Description of Artificial Sequence: Syntheticoligonucleotide
  source 1..21: mol_type = other DNA
gctgactcacgtgagtcagcc

SEQ ID NO: 11464 - DNA, 21 bp, synthetic construct
  misc_feature 1..21: note = Description of Artificial Sequence: Syntheticoligonucleotide
  source 1..21: mol_type = other DNA
cccgactcacgtgagtcgggc

SEQ ID NO: 11465 - DNA, 21 bp, synthetic construct
  misc_feature 1..21: note = Description of Artificial Sequence: Syntheticoligonucleotide
  source 1..21: mol_type = other DNA
cccgactcacgtgagtcgggt

SEQ ID NO: 11466 - DNA, 21 bp, synthetic construct
  misc_feature 1..21: note = Description of Artificial Sequence: Syntheticoligonucleotide
  source 1..21: mol_type = other DNA
accgactcacgtgagtcggtc

SEQ ID NO: 11467 - DNA, 21 bp, synthetic construct
  misc_feature 1..21: note = Description of Artificial Sequence: Syntheticoligonucleotide
  source 1..21: mol_type = other DNA
cacgactcacgtgagtcgtgc

SEQ ID NO: 11468 - DNA, 21 bp, synthetic construct
  misc_feature 1..21: note = Description of Artificial Sequence: Syntheticoligonucleotide
  source 1..21: mol_type = other DNA
ccagactcacgtgagtctggc

SEQ ID NO: 11469 - DNA, 21 bp, synthetic construct
  misc_feature 1..21: note = Description of Artificial Sequence: Syntheticoligonucleotide
  source 1..21: mol_type = other DNA
cccgactcacgtgagtcggga

SEQ ID NO: 11470 - DNA, 21 bp, synthetic construct
  misc_feature 1..21: note = Description of Artificial Sequence: Syntheticoligonucleotide
  source 1..21: mol_type = other DNA
tccgactcacgtgagtcggac

SEQ ID NO: 11471 - DNA, 21 bp, synthetic construct
  misc_feature 1..21: note = Description of Artificial Sequence: Syntheticoligonucleotide
  source 1..21: mol_type = other DNA
cctgactcacgtgagtcaggc

SEQ ID NO: 11472 - DNA, 21 bp, synthetic construct
  misc_feature 1..21: note = Description of Artificial Sequence: Syntheticoligonucleotide
  source 1..21: mol_type = other DNA
ggcgactcacgtgagtcgccc

SEQ ID NO: 11473 - DNA, 21 bp, synthetic construct
  misc_feature 1..21: note = Description of Artificial Sequence: Syntheticoligonucleotide
  source 1..21: mol_type = other DNA
ggcgactcacgtgagtcgcct

SEQ ID NO: 11474 - DNA, 21 bp, synthetic construct
  misc_feature 1..21: note = Description of Artificial Sequence: Syntheticoligonucleotide
  source 1..21: mol_type = other DNA
agcgactcacgtgagtcgctc

SEQ ID NO: 11475 - DNA, 21 bp, synthetic construct
  misc_feature 1..21: note = Description of Artificial Sequence: Syntheticoligonucleotide
  source 1..21: mol_type = other DNA
gacgactcacgtgagtcgtcc

SEQ ID NO: 11476 - DNA, 21 bp, synthetic construct
  misc_feature 1..21: note = Description of Artificial Sequence: Syntheticoligonucleotide
  source 1..21: mol_type = other DNA
ggagactcacgtgagtctccc

SEQ ID NO: 11477 - DNA, 21 bp, synthetic construct
  misc_feature 1..21: note = Description of Artificial Sequence: Syntheticoligonucleotide
  source 1..21: mol_type = other DNA
ggcgactcacgtgagtcgcca

SEQ ID NO: 11478 - DNA, 21 bp, synthetic construct
  misc_feature 1..21: note = Description of Artificial Sequence: Syntheticoligonucleotide
  source 1..21: mol_type = other DNA
tgcgactcacgtgagtcgcac

SEQ ID NO: 11479 - DNA, 21 bp, synthetic construct
  misc_feature 1..21: note = Description of Artificial Sequence: Syntheticoligonucleotide
  source 1..21: mol_type = other DNA
ggtgactcacgtgagtcaccc

SEQ ID NO: 11480 - DNA, 21 bp, synthetic construct
  misc_feature 1..21: note = Description of Artificial Sequence: Syntheticoligonucleotide
  source 1..21: mol_type = other DNA
cgggactcacgtgagtcccgt

SEQ ID NO: 11481 - DNA, 21 bp, synthetic construct
  misc_feature 1..21: note = Description of Artificial Sequence: Syntheticoligonucleotide
  source 1..21: mol_type = other DNA
agggactcacgtgagtccctg

SEQ ID NO: 11482 - DNA, 21 bp, synthetic construct
  misc_feature 1..21: note = Description of Artificial Sequence: Syntheticoligonucleotide
  source 1..21: mol_type = other DNA
caggactcacgtgagtcctgg

SEQ ID NO: 11483 - DNA, 21 bp, synthetic construct
  misc_feature 1..21: note = Description of Artificial Sequence: Syntheticoligonucleotide
  source 1..21: mol_type = other DNA
cgagactcacgtgagtctcgg

SEQ ID NO: 11484 - DNA, 21 bp, synthetic construct
  misc_feature 1..21: note = Description of Artificial Sequence: Syntheticoligonucleotide
  source 1..21: mol_type = other DNA
cgggactcacgtgagtcccga

SEQ ID NO: 11485 - DNA, 21 bp, synthetic construct
  misc_feature 1..21: note = Description of Artificial Sequence: Syntheticoligonucleotide
  source 1..21: mol_type = other DNA
tgggactcacgtgagtcccag

SEQ ID NO: 11486 - DNA, 21 bp, synthetic construct
  misc_feature 1..21: note = Description of Artificial Sequence: Syntheticoligonucleotide
  source 1..21: mol_type = other DNA
ctggactcacgtgagtccagg

SEQ ID NO: 11487 - DNA, 21 bp, synthetic construct
  misc_feature 1..21: note = Description of Artificial Sequence: Syntheticoligonucleotide
  source 1..21: mol_type = other DNA
cgtgactcacgtgagtcacgg

SEQ ID NO: 11488 - DNA, 21 bp, synthetic construct
  misc_feature 1..21: note = Description of Artificial Sequence: Syntheticoligonucleotide
  source 1..21: mol_type = other DNA
ggcgactcacgtgagtcgccg

SEQ ID NO: 11489 - DNA, 21 bp, synthetic construct
  misc_feature 1..21: note = Description of Artificial Sequence: Syntheticoligonucleotide
  source 1..21: mol_type = other DNA
agcgactcacgtgagtcgctg

SEQ ID NO: 11490 - DNA, 21 bp, synthetic construct
  misc_feature 1..21: note = Description of Artificial Sequence: Syntheticoligonucleotide
  source 1..21: mol_type = other DNA
gacgactcacgtgagtcgtcg

SEQ ID NO: 11491 - DNA, 21 bp, synthetic construct
  misc_feature 1..21: note = Description of Artificial Sequence: Syntheticoligonucleotide
  source 1..21: mol_type = other DNA
ggagactcacgtgagtctccg

SEQ ID NO: 11492 - DNA, 21 bp, synthetic construct
  misc_feature 1..21: note = Description of Artificial Sequence: Syntheticoligonucleotide
  source 1..21: mol_type = other DNA
tgcgactcacgtgagtcgcag

SEQ ID NO: 11493 - DNA, 21 bp, synthetic construct
  misc_feature 1..21: note = Description of Artificial Sequence: Syntheticoligonucleotide
  source 1..21: mol_type = other DNA
ggtgactcacgtgagtcaccg

SEQ ID NO: 11494 - DNA, 21 bp, synthetic construct
  misc_feature 1..21: note = Description of Artificial Sequence: Syntheticoligonucleotide
  source 1..21: mol_type = other DNA
acggactcacgtgagtccgtg

SEQ ID NO: 11495 - DNA, 21 bp, synthetic construct
  misc_feature 1..21: note = Description of Artificial Sequence: Syntheticoligonucleotide
  source 1..21: mol_type = other DNA
ccagactcacgtgagtctggg

SEQ ID NO: 11496 - DNA, 21 bp, synthetic construct
  misc_feature 1..21: note = Description of Artificial Sequence: Syntheticoligonucleotide
  source 1..21: mol_type = other DNA
tcggactcacgtgagtccgag

SEQ ID NO: 11497 - DNA, 21 bp, synthetic construct
  misc_feature 1..21: note = Description of Artificial Sequence: Syntheticoligonucleotide
  source 1..21: mol_type = other DNA
cctgactcacgtgagtcaggg

SEQ ID NO: 11498 - DNA, 21 bp, synthetic construct
  misc_feature 1..21: note = Description of Artificial Sequence: Syntheticoligonucleotide
  source 1..21: mol_type = other DNA
cacgactcacgtgagtcgtgg

SEQ ID NO: 11499 - DNA, 21 bp, synthetic construct
  misc_feature 1..21: note = Description of Artificial Sequence: Syntheticoligonucleotide
  source 1..21: mol_type = other DNA
gccgactcacgtgagtcggct

SEQ ID NO: 11500 - DNA, 21 bp, synthetic construct
  misc_feature 1..21: note = Description of Artificial Sequence: Syntheticoligonucleotide
  source 1..21: mol_type = other DNA
gccgactcacgtgagtcggca

SEQ ID NO: 11501 - DNA, 21 bp, synthetic construct
  misc_feature 1..21: note = Description of Artificial Sequence: Syntheticoligonucleotide
  source 1..21: mol_type = other DNA
cgagactcacgtgagtctcgc

SEQ ID NO: 11502 - DNA, 21 bp, synthetic construct
  misc_feature 1..21: note = Description of Artificial Sequence: Syntheticoligonucleotide
  source 1..21: mol_type = other DNA
cgtgactcacgtgagtcacgc

SEQ ID NO: 11503 - DNA, 21 bp, synthetic construct
  misc_feature 1..21: note = Description of Artificial Sequence: Syntheticoligonucleotide
  source 1..21: mol_type = other DNA
caggactcacgtgagtcctgc

SEQ ID NO: 11504 - DNA, 21 bp, synthetic construct
  misc_feature 1..21: note = Description of Artificial Sequence: Syntheticoligonucleotide
  source 1..21: mol_type = other DNA
ctggactcacgtgagtccagc

SEQ ID NO: 11505 - DNA, 21 bp, synthetic construct
  misc_feature 1..21: note = Description of Artificial Sequence: Syntheticoligonucleotide
  source 1..21: mol_type = other DNA
gaggactcacgtgagtcctcg

SEQ ID NO: 11506 - DNA, 21 bp, synthetic construct
  misc_feature 1..21: note = Description of Artificial Sequence: Syntheticoligonucleotide
  source 1..21: mol_type = other DNA
gtggactcacgtgagtccacg

SEQ ID NO: 11507 - DNA, 21 bp, synthetic construct
  misc_feature 1..21: note = Description of Artificial Sequence: Syntheticoligonucleotide
  source 1..21: mol_type = other DNA
accgactcacgtgagtcggtg

SEQ ID NO: 11508 - DNA, 21 bp, synthetic construct
  misc_feature 1..21: note = Description of Artificial Sequence: Syntheticoligonucleotide
  source 1..21: mol_type = other DNA
tccgactcacgtgagtcggag

SEQ ID NO: 11509 - DNA, 21 bp, synthetic construct
  misc_feature 1..21: note = Description of Artificial Sequence: Syntheticoligonucleotide
  source 1..21: mol_type = other DNA
cgggactcacgtgagtcccgc

SEQ ID NO: 11510 - DNA, 21 bp, synthetic construct
  misc_feature 1..21: note = Description of Artificial Sequence: Syntheticoligonucleotide
  source 1..21: mol_type = other DNA
agggactcacgtgagtccctc

SEQ ID NO: 11511 - DNA, 21 bp, synthetic construct
  misc_feature 1..21: note = Description of Artificial Sequence: Syntheticoligonucleotide
  source 1..21: mol_type = other DNA
tgggactcacgtgagtcccac

SEQ ID NO: 11512 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactcggccgagtcnnnn

SEQ ID NO: 11513 - DNA, 21 bp, synthetic construct
  misc_feature 1..21: note = Description of Artificial Sequence: Syntheticoligonucleotide
  source 1..21: mol_type = other DNA
gcggactcggccgagtccgcc

SEQ ID NO: 11514 - DNA, 21 bp, synthetic construct
  misc_feature 1..21: note = Description of Artificial Sequence: Syntheticoligonucleotide
  source 1..21: mol_type = other DNA
gcggactcggccgagtccgct

SEQ ID NO: 11515 - DNA, 21 bp, synthetic construct
  misc_feature 1..21: note = Description of Artificial Sequence: Syntheticoligonucleotide
  source 1..21: mol_type = other DNA
acggactcggccgagtccgtc

SEQ ID NO: 11516 - DNA, 21 bp, synthetic construct
  misc_feature 1..21: note = Description of Artificial Sequence: Syntheticoligonucleotide
  source 1..21: mol_type = other DNA
gaggactcggccgagtcctcc

SEQ ID NO: 11517 - DNA, 21 bp, synthetic construct
  misc_feature 1..21: note = Description of Artificial Sequence: Syntheticoligonucleotide
  source 1..21: mol_type = other DNA
gcagactcggccgagtctgcc

SEQ ID NO: 11518 - DNA, 21 bp, synthetic construct
  misc_feature 1..21: note = Description of Artificial Sequence: Syntheticoligonucleotide
  source 1..21: mol_type = other DNA
gcggactcggccgagtccgca

SEQ ID NO: 11519 - DNA, 21 bp, synthetic construct
  misc_feature 1..21: note = Description of Artificial Sequence: Syntheticoligonucleotide
  source 1..21: mol_type = other DNA
tcggactcggccgagtccgac

SEQ ID NO: 11520 - DNA, 21 bp, synthetic construct
  misc_feature 1..21: note = Description of Artificial Sequence: Syntheticoligonucleotide
  source 1..21: mol_type = other DNA
gtggactcggccgagtccacc

SEQ ID NO: 11521 - DNA, 21 bp, synthetic construct
  misc_feature 1..21: note = Description of Artificial Sequence: Syntheticoligonucleotide
  source 1..21: mol_type = other DNA
gctgactcggccgagtcagcc

SEQ ID NO: 11522 - DNA, 21 bp, synthetic construct
  misc_feature 1..21: note = Description of Artificial Sequence: Syntheticoligonucleotide
  source 1..21: mol_type = other DNA
cccgactcggccgagtcgggc

SEQ ID NO: 11523 - DNA, 21 bp, synthetic construct
  misc_feature 1..21: note = Description of Artificial Sequence: Syntheticoligonucleotide
  source 1..21: mol_type = other DNA
cccgactcggccgagtcgggt

SEQ ID NO: 11524 - DNA, 21 bp, synthetic construct
  misc_feature 1..21: note = Description of Artificial Sequence: Syntheticoligonucleotide
  source 1..21: mol_type = other DNA
accgactcggccgagtcggtc

SEQ ID NO: 11525 - DNA, 21 bp, synthetic construct
  misc_feature 1..21: note = Description of Artificial Sequence: Syntheticoligonucleotide
  source 1..21: mol_type = other DNA
cacgactcggccgagtcgtgc

SEQ ID NO: 11526 - DNA, 21 bp, synthetic construct
  misc_feature 1..21: note = Description of Artificial Sequence: Syntheticoligonucleotide
  source 1..21: mol_type = other DNA
ccagactcggccgagtctggc

SEQ ID NO: 11527 - DNA, 21 bp, synthetic construct
  misc_feature 1..21: note = Description of Artificial Sequence: Syntheticoligonucleotide
  source 1..21: mol_type = other DNA
cccgactcggccgagtcggga

SEQ ID NO: 11528 - DNA, 21 bp, synthetic construct
  misc_feature 1..21: note = Description of Artificial Sequence: Syntheticoligonucleotide
  source 1..21: mol_type = other DNA
tccgactcggccgagtcggac

SEQ ID NO: 11529 - DNA, 21 bp, synthetic construct
  misc_feature 1..21: note = Description of Artificial Sequence: Syntheticoligonucleotide
  source 1..21: mol_type = other DNA
cctgactcggccgagtcaggc

SEQ ID NO: 11530 - DNA, 21 bp, synthetic construct
  misc_feature 1..21: note = Description of Artificial Sequence: Syntheticoligonucleotide
  source 1..21: mol_type = other DNA
ggcgactcggccgagtcgccc

SEQ ID NO: 11531 - DNA, 21 bp, synthetic construct
  misc_feature 1..21: note = Description of Artificial Sequence: Syntheticoligonucleotide
  source 1..21: mol_type = other DNA
ggcgactcggccgagtcgcct

SEQ ID NO: 11532 - DNA, 21 bp, synthetic construct
  misc_feature 1..21: note = Description of Artificial Sequence: Syntheticoligonucleotide
  source 1..21: mol_type = other DNA
agcgactcggccgagtcgctc

SEQ ID NO: 11533 - DNA, 21 bp, synthetic construct
  misc_feature 1..21: note = Description of Artificial Sequence: Syntheticoligonucleotide
  source 1..21: mol_type = other DNA
gacgactcggccgagtcgtcc

SEQ ID NO: 11534 - DNA, 21 bp, synthetic construct
  misc_feature 1..21: note = Description of Artificial Sequence: Syntheticoligonucleotide
  source 1..21: mol_type = other DNA
ggagactcggccgagtctccc

SEQ ID NO: 11535 - DNA, 21 bp, synthetic construct
  misc_feature 1..21: note = Description of Artificial Sequence: Syntheticoligonucleotide
  source 1..21: mol_type = other DNA
ggcgactcggccgagtcgcca

SEQ ID NO: 11536 - DNA, 21 bp, synthetic construct
  misc_feature 1..21: note = Description of Artificial Sequence: Syntheticoligonucleotide
  source 1..21: mol_type = other DNA
tgcgactcggccgagtcgcac

SEQ ID NO: 11537 - DNA, 21 bp, synthetic construct
  misc_feature 1..21: note = Description of Artificial Sequence: Syntheticoligonucleotide
  source 1..21: mol_type = other DNA
ggtgactcggccgagtcaccc

SEQ ID NO: 11538 - DNA, 21 bp, synthetic construct
  misc_feature 1..21: note = Description of Artificial Sequence: Syntheticoligonucleotide
  source 1..21: mol_type = other DNA
cgggactcggccgagtcccgt

SEQ ID NO: 11539 - DNA, 21 bp, synthetic construct
  misc_feature 1..21: note = Description of Artificial Sequence: Syntheticoligonucleotide
  source 1..21: mol_type = other DNA
agggactcggccgagtccctg

SEQ ID NO: 11540 - DNA, 21 bp, synthetic construct
  misc_feature 1..21: note = Description of Artificial Sequence: Syntheticoligonucleotide
  source 1..21: mol_type = other DNA
caggactcggccgagtcctgg

SEQ ID NO: 11541 - DNA, 21 bp, synthetic construct
  misc_feature 1..21: note = Description of Artificial Sequence: Syntheticoligonucleotide
  source 1..21: mol_type = other DNA
cgagactcggccgagtctcgg

SEQ ID NO: 11542 - DNA, 21 bp, synthetic construct
  misc_feature 1..21: note = Description of Artificial Sequence: Syntheticoligonucleotide
  source 1..21: mol_type = other DNA
cgggactcggccgagtcccga

SEQ ID NO: 11543 - DNA, 21 bp, synthetic construct
  misc_feature 1..21: note = Description of Artificial Sequence: Syntheticoligonucleotide
  source 1..21: mol_type = other DNA
tgggactcggccgagtcccag

SEQ ID NO: 11544 - DNA, 21 bp, synthetic construct
  misc_feature 1..21: note = Description of Artificial Sequence: Syntheticoligonucleotide
  source 1..21: mol_type = other DNA
ctggactcggccgagtccagg

SEQ ID NO: 11545 - DNA, 21 bp, synthetic construct
  misc_feature 1..21: note = Description of Artificial Sequence: Syntheticoligonucleotide
  source 1..21: mol_type = other DNA
cgtgactcggccgagtcacgg

SEQ ID NO: 11546 - DNA, 21 bp, synthetic construct
  misc_feature 1..21: note = Description of Artificial Sequence: Syntheticoligonucleotide
  source 1..21: mol_type = other DNA
ggcgactcggccgagtcgccg

SEQ ID NO: 11547 - DNA, 21 bp, synthetic construct
  misc_feature 1..21: note = Description of Artificial Sequence: Syntheticoligonucleotide
  source 1..21: mol_type = other DNA
agcgactcggccgagtcgctg

SEQ ID NO: 11548 - DNA, 21 bp, synthetic construct
  misc_feature 1..21: note = Description of Artificial Sequence: Syntheticoligonucleotide
  source 1..21: mol_type = other DNA
gacgactcggccgagtcgtcg

SEQ ID NO: 11549 - DNA, 21 bp, synthetic construct
  misc_feature 1..21: note = Description of Artificial Sequence: Syntheticoligonucleotide
  source 1..21: mol_type = other DNA
ggagactcggccgagtctccg

SEQ ID NO: 11550 - DNA, 21 bp, synthetic construct
  misc_feature 1..21: note = Description of Artificial Sequence: Syntheticoligonucleotide
  source 1..21: mol_type = other DNA
tgcgactcggccgagtcgcag

SEQ ID NO: 11551 - DNA, 21 bp, synthetic construct
  misc_feature 1..21: note = Description of Artificial Sequence: Syntheticoligonucleotide
  source 1..21: mol_type = other DNA
ggtgactcggccgagtcaccg

SEQ ID NO: 11552 - DNA, 21 bp, synthetic construct
  misc_feature 1..21: note = Description of Artificial Sequence: Syntheticoligonucleotide
  source 1..21: mol_type = other DNA
acggactcggccgagtccgtg

SEQ ID NO: 11553 - DNA, 21 bp, synthetic construct
  misc_feature 1..21: note = Description of Artificial Sequence: Syntheticoligonucleotide
  source 1..21: mol_type = other DNA
ccagactcggccgagtctggg

SEQ ID NO: 11554 - DNA, 21 bp, synthetic construct
  misc_feature 1..21: note = Description of Artificial Sequence: Syntheticoligonucleotide
  source 1..21: mol_type = other DNA
tcggactcggccgagtccgag

SEQ ID NO: 11555 - DNA, 21 bp, synthetic construct
  misc_feature 1..21: note = Description of Artificial Sequence: Syntheticoligonucleotide
  source 1..21: mol_type = other DNA
cctgactcggccgagtcaggg

SEQ ID NO: 11556 - DNA, 21 bp, synthetic construct
  misc_feature 1..21: note = Description of Artificial Sequence: Syntheticoligonucleotide
  source 1..21: mol_type = other DNA
cacgactcggccgagtcgtgg

SEQ ID NO: 11557 - DNA, 21 bp, synthetic construct
  misc_feature 1..21: note = Description of Artificial Sequence: Syntheticoligonucleotide
  source 1..21: mol_type = other DNA
gccgactcggccgagtcggct

SEQ ID NO: 11558 - DNA, 21 bp, synthetic construct
  misc_feature 1..21: note = Description of Artificial Sequence: Syntheticoligonucleotide
  source 1..21: mol_type = other DNA
gccgactcggccgagtcggca

SEQ ID NO: 11559 - DNA, 21 bp, synthetic construct
  misc_feature 1..21: note = Description of Artificial Sequence: Syntheticoligonucleotide
  source 1..21: mol_type = other DNA
cgagactcggccgagtctcgc

SEQ ID NO: 11560 - DNA, 21 bp, synthetic construct
  misc_feature 1..21: note = Description of Artificial Sequence: Syntheticoligonucleotide
  source 1..21: mol_type = other DNA
cgtgactcggccgagtcacgc

SEQ ID NO: 11561 - DNA, 21 bp, synthetic construct
  misc_feature 1..21: note = Description of Artificial Sequence: Syntheticoligonucleotide
  source 1..21: mol_type = other DNA
caggactcggccgagtcctgc

SEQ ID NO: 11562 - DNA, 21 bp, synthetic construct
  misc_feature 1..21: note = Description of Artificial Sequence: Syntheticoligonucleotide
  source 1..21: mol_type = other DNA
ctggactcggccgagtccagc

SEQ ID NO: 11563 - DNA, 21 bp, synthetic construct
  misc_feature 1..21: note = Description of Artificial Sequence: Syntheticoligonucleotide
  source 1..21: mol_type = other DNA
gaggactcggccgagtcctcg

SEQ ID NO: 11564 - DNA, 21 bp, synthetic construct
  misc_feature 1..21: note = Description of Artificial Sequence: Syntheticoligonucleotide
  source 1..21: mol_type = other DNA
gtggactcggccgagtccacg

SEQ ID NO: 11565 - DNA, 21 bp, synthetic construct
  misc_feature 1..21: note = Description of Artificial Sequence: Syntheticoligonucleotide
  source 1..21: mol_type = other DNA
accgactcggccgagtcggtg

SEQ ID NO: 11566 - DNA, 21 bp, synthetic construct
  misc_feature 1..21: note = Description of Artificial Sequence: Syntheticoligonucleotide
  source 1..21: mol_type = other DNA
tccgactcggccgagtcggag

SEQ ID NO: 11567 - DNA, 21 bp, synthetic construct
  misc_feature 1..21: note = Description of Artificial Sequence: Syntheticoligonucleotide
  source 1..21: mol_type = other DNA
cgggactcggccgagtcccgc

SEQ ID NO: 11568 - DNA, 21 bp, synthetic construct
  misc_feature 1..21: note = Description of Artificial Sequence: Syntheticoligonucleotide
  source 1..21: mol_type = other DNA
agggactcggccgagtccctc

SEQ ID NO: 11569 - DNA, 21 bp, synthetic construct
  misc_feature 1..21: note = Description of Artificial Sequence: Syntheticoligonucleotide
  source 1..21: mol_type = other DNA
tgggactcggccgagtcccac

SEQ ID NO: 11570 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactcccgggagtcnnnn

SEQ ID NO: 11571 - DNA, 21 bp, synthetic construct
  misc_feature 1..21: note = Description of Artificial Sequence: Syntheticoligonucleotide
  source 1..21: mol_type = other DNA
gcggactcccgggagtccgcc

SEQ ID NO: 11572 - DNA, 21 bp, synthetic construct
  misc_feature 1..21: note = Description of Artificial Sequence: Syntheticoligonucleotide
  source 1..21: mol_type = other DNA
gcggactcccgggagtccgct

SEQ ID NO: 11573 - DNA, 21 bp, synthetic construct
  misc_feature 1..21: note = Description of Artificial Sequence: Syntheticoligonucleotide
  source 1..21: mol_type = other DNA
acggactcccgggagtccgtc

SEQ ID NO: 11574 - DNA, 21 bp, synthetic construct
  misc_feature 1..21: note = Description of Artificial Sequence: Syntheticoligonucleotide
  source 1..21: mol_type = other DNA
gaggactcccgggagtcctcc

SEQ ID NO: 11575 - DNA, 21 bp, synthetic construct
  misc_feature 1..21: note = Description of Artificial Sequence: Syntheticoligonucleotide
  source 1..21: mol_type = other DNA
gcagactcccgggagtctgcc

SEQ ID NO: 11576 - DNA, 21 bp, synthetic construct
  misc_feature 1..21: note = Description of Artificial Sequence: Syntheticoligonucleotide
  source 1..21: mol_type = other DNA
gcggactcccgggagtccgca

SEQ ID NO: 11577 - DNA, 21 bp, synthetic construct
  misc_feature 1..21: note = Description of Artificial Sequence: Syntheticoligonucleotide
  source 1..21: mol_type = other DNA
tcggactcccgggagtccgac

SEQ ID NO: 11578 - DNA, 21 bp, synthetic construct
  misc_feature 1..21: note = Description of Artificial Sequence: Syntheticoligonucleotide
  source 1..21: mol_type = other DNA
gtggactcccgggagtccacc

SEQ ID NO: 11579 - DNA, 21 bp, synthetic construct
  misc_feature 1..21: note = Description of Artificial Sequence: Syntheticoligonucleotide
  source 1..21: mol_type = other DNA
gctgactcccgggagtcagcc

SEQ ID NO: 11580 - DNA, 21 bp, synthetic construct
  misc_feature 1..21: note = Description of Artificial Sequence: Syntheticoligonucleotide
  source 1..21: mol_type = other DNA
cccgactcccgggagtcgggc

SEQ ID NO: 11581 - DNA, 21 bp, synthetic construct
  misc_feature 1..21: note = Description of Artificial Sequence: Syntheticoligonucleotide
  source 1..21: mol_type = other DNA
cccgactcccgggagtcgggt

SEQ ID NO: 11582 - DNA, 21 bp, synthetic construct
  misc_feature 1..21: note = Description of Artificial Sequence: Syntheticoligonucleotide
  source 1..21: mol_type = other DNA
accgactcccgggagtcggtc

SEQ ID NO: 11583 - DNA, 21 bp, synthetic construct
  misc_feature 1..21: note = Description of Artificial Sequence: Syntheticoligonucleotide
  source 1..21: mol_type = other DNA
cacgactcccgggagtcgtgc

SEQ ID NO: 11584 - DNA, 21 bp, synthetic construct
  misc_feature 1..21: note = Description of Artificial Sequence: Syntheticoligonucleotide
  source 1..21: mol_type = other DNA
ccagactcccgggagtctggc

SEQ ID NO: 11585 - DNA, 21 bp, synthetic construct
  misc_feature 1..21: note = Description of Artificial Sequence: Syntheticoligonucleotide
  source 1..21: mol_type = other DNA
cccgactcccgggagtcggga

SEQ ID NO: 11586 - DNA, 21 bp, synthetic construct
  misc_feature 1..21: note = Description of Artificial Sequence: Syntheticoligonucleotide
  source 1..21: mol_type = other DNA
tccgactcccgggagtcggac

SEQ ID NO: 11587 - DNA, 21 bp, synthetic construct
  misc_feature 1..21: note = Description of Artificial Sequence: Syntheticoligonucleotide
  source 1..21: mol_type = other DNA
cctgactcccgggagtcaggc

SEQ ID NO: 11588 - DNA, 21 bp, synthetic construct
  misc_feature 1..21: note = Description of Artificial Sequence: Syntheticoligonucleotide
  source 1..21: mol_type = other DNA
ggcgactcccgggagtcgccc

SEQ ID NO: 11589 - DNA, 21 bp, synthetic construct
  misc_feature 1..21: note = Description of Artificial Sequence: Syntheticoligonucleotide
  source 1..21: mol_type = other DNA
ggcgactcccgggagtcgcct

SEQ ID NO: 11590 - DNA, 21 bp, synthetic construct
  misc_feature 1..21: note = Description of Artificial Sequence: Syntheticoligonucleotide
  source 1..21: mol_type = other DNA
agcgactcccgggagtcgctc

SEQ ID NO: 11591 - DNA, 21 bp, synthetic construct
  misc_feature 1..21: note = Description of Artificial Sequence: Syntheticoligonucleotide
  source 1..21: mol_type = other DNA
gacgactcccgggagtcgtcc

SEQ ID NO: 11592 - DNA, 21 bp, synthetic construct
  misc_feature 1..21: note = Description of Artificial Sequence: Syntheticoligonucleotide
  source 1..21: mol_type = other DNA
ggagactcccgggagtctccc

SEQ ID NO: 11593 - DNA, 21 bp, synthetic construct
  misc_feature 1..21: note = Description of Artificial Sequence: Syntheticoligonucleotide
  source 1..21: mol_type = other DNA
ggcgactcccgggagtcgcca

SEQ ID NO: 11594 - DNA, 21 bp, synthetic construct
  misc_feature 1..21: note = Description of Artificial Sequence: Syntheticoligonucleotide
  source 1..21: mol_type = other DNA
tgcgactcccgggagtcgcac

SEQ ID NO: 11595 - DNA, 21 bp, synthetic construct
  misc_feature 1..21: note = Description of Artificial Sequence: Syntheticoligonucleotide
  source 1..21: mol_type = other DNA
ggtgactcccgggagtcaccc

SEQ ID NO: 11596 - DNA, 21 bp, synthetic construct
  misc_feature 1..21: note = Description of Artificial Sequence: Syntheticoligonucleotide
  source 1..21: mol_type = other DNA
cgggactcccgggagtcccgt

SEQ ID NO: 11597 - DNA, 21 bp, synthetic construct
  misc_feature 1..21: note = Description of Artificial Sequence: Syntheticoligonucleotide
  source 1..21: mol_type = other DNA
agggactcccgggagtccctg

SEQ ID NO: 11598 - DNA, 21 bp, synthetic construct
  misc_feature 1..21: note = Description of Artificial Sequence: Syntheticoligonucleotide
  source 1..21: mol_type = other DNA
caggactcccgggagtcctgg

SEQ ID NO: 11599 - DNA, 21 bp, synthetic construct
  misc_feature 1..21: note = Description of Artificial Sequence: Syntheticoligonucleotide
  source 1..21: mol_type = other DNA
cgagactcccgggagtctcgg

SEQ ID NO: 11600 - DNA, 21 bp, synthetic construct
  misc_feature 1..21: note = Description of Artificial Sequence: Syntheticoligonucleotide
  source 1..21: mol_type = other DNA
cgggactcccgggagtcccga

SEQ ID NO: 11601 - DNA, 21 bp, synthetic construct
  misc_feature 1..21: note = Description of Artificial Sequence: Syntheticoligonucleotide
  source 1..21: mol_type = other DNA
tgggactcccgggagtcccag

SEQ ID NO: 11602 - DNA, 21 bp, synthetic construct
  misc_feature 1..21: note = Description of Artificial Sequence: Syntheticoligonucleotide
  source 1..21: mol_type = other DNA
ctggactcccgggagtccagg

SEQ ID NO: 11603 - DNA, 21 bp, synthetic construct
  misc_feature 1..21: note = Description of Artificial Sequence: Syntheticoligonucleotide
  source 1..21: mol_type = other DNA
cgtgactcccgggagtcacgg

SEQ ID NO: 11604 - DNA, 21 bp, synthetic construct
  misc_feature 1..21: note = Description of Artificial Sequence: Syntheticoligonucleotide
  source 1..21: mol_type = other DNA
ggcgactcccgggagtcgccg

SEQ ID NO: 11605 - DNA, 21 bp, synthetic construct
  misc_feature 1..21: note = Description of Artificial Sequence: Syntheticoligonucleotide
  source 1..21: mol_type = other DNA
agcgactcccgggagtcgctg

SEQ ID NO: 11606 - DNA, 21 bp, synthetic construct
  misc_feature 1..21: note = Description of Artificial Sequence: Syntheticoligonucleotide
  source 1..21: mol_type = other DNA
gacgactcccgggagtcgtcg

SEQ ID NO: 11607 - DNA, 21 bp, synthetic construct
  misc_feature 1..21: note = Description of Artificial Sequence: Syntheticoligonucleotide
  source 1..21: mol_type = other DNA
ggagactcccgggagtctccg

SEQ ID NO: 11608 - DNA, 21 bp, synthetic construct
  misc_feature 1..21: note = Description of Artificial Sequence: Syntheticoligonucleotide
  source 1..21: mol_type = other DNA
tgcgactcccgggagtcgcag

SEQ ID NO: 11609 - DNA, 21 bp, synthetic construct
  misc_feature 1..21: note = Description of Artificial Sequence: Syntheticoligonucleotide
  source 1..21: mol_type = other DNA
ggtgactcccgggagtcaccg

SEQ ID NO: 11610 - DNA, 21 bp, synthetic construct
  misc_feature 1..21: note = Description of Artificial Sequence: Syntheticoligonucleotide
  source 1..21: mol_type = other DNA
acggactcccgggagtccgtg

SEQ ID NO: 11611 - DNA, 21 bp, synthetic construct
  misc_feature 1..21: note = Description of Artificial Sequence: Syntheticoligonucleotide
  source 1..21: mol_type = other DNA
ccagactcccgggagtctggg

SEQ ID NO: 11612 - DNA, 21 bp, synthetic construct
  misc_feature 1..21: note = Description of Artificial Sequence: Syntheticoligonucleotide
  source 1..21: mol_type = other DNA
tcggactcccgggagtccgag

SEQ ID NO: 11613 - DNA, 21 bp, synthetic construct
  misc_feature 1..21: note = Description of Artificial Sequence: Syntheticoligonucleotide
  source 1..21: mol_type = other DNA
cctgactcccgggagtcaggg

SEQ ID NO: 11614 - DNA, 21 bp, synthetic construct
  misc_feature 1..21: note = Description of Artificial Sequence: Syntheticoligonucleotide
  source 1..21: mol_type = other DNA
cacgactcccgggagtcgtgg

SEQ ID NO: 11615 - DNA, 21 bp, synthetic construct
  misc_feature 1..21: note = Description of Artificial Sequence: Syntheticoligonucleotide
  source 1..21: mol_type = other DNA
gccgactcccgggagtcggct

SEQ ID NO: 11616 - DNA, 21 bp, synthetic construct
  misc_feature 1..21: note = Description of Artificial Sequence: Syntheticoligonucleotide
  source 1..21: mol_type = other DNA
gccgactcccgggagtcggca

SEQ ID NO: 11617 - DNA, 21 bp, synthetic construct
  misc_feature 1..21: note = Description of Artificial Sequence: Syntheticoligonucleotide
  source 1..21: mol_type = other DNA
cgagactcccgggagtctcgc

SEQ ID NO: 11618 - DNA, 21 bp, synthetic construct
  misc_feature 1..21: note = Description of Artificial Sequence: Syntheticoligonucleotide
  source 1..21: mol_type = other DNA
cgtgactcccgggagtcacgc

SEQ ID NO: 11619 - DNA, 21 bp, synthetic construct
  misc_feature 1..21: note = Description of Artificial Sequence: Syntheticoligonucleotide
  source 1..21: mol_type = other DNA
caggactcccgggagtcctgc

SEQ ID NO: 11620 - DNA, 21 bp, synthetic construct
  misc_feature 1..21: note = Description of Artificial Sequence: Syntheticoligonucleotide
  source 1..21: mol_type = other DNA
ctggactcccgggagtccagc

SEQ ID NO: 11621 - DNA, 21 bp, synthetic construct
  misc_feature 1..21: note = Description of Artificial Sequence: Syntheticoligonucleotide
  source 1..21: mol_type = other DNA
gaggactcccgggagtcctcg

SEQ ID NO: 11622 - DNA, 21 bp, synthetic construct
  misc_feature 1..21: note = Description of Artificial Sequence: Syntheticoligonucleotide
  source 1..21: mol_type = other DNA
gtggactcccgggagtccacg

SEQ ID NO: 11623 - DNA, 21 bp, synthetic construct
  misc_feature 1..21: note = Description of Artificial Sequence: Syntheticoligonucleotide
  source 1..21: mol_type = other DNA
accgactcccgggagtcggtg

SEQ ID NO: 11624 - DNA, 21 bp, synthetic construct
  misc_feature 1..21: note = Description of Artificial Sequence: Syntheticoligonucleotide
  source 1..21: mol_type = other DNA
tccgactcccgggagtcggag

SEQ ID NO: 11625 - DNA, 21 bp, synthetic construct
  misc_feature 1..21: note = Description of Artificial Sequence: Syntheticoligonucleotide
  source 1..21: mol_type = other DNA
cgggactcccgggagtcccgc

SEQ ID NO: 11626 - DNA, 21 bp, synthetic construct
  misc_feature 1..21: note = Description of Artificial Sequence: Syntheticoligonucleotide
  source 1..21: mol_type = other DNA
agggactcccgggagtccctc

SEQ ID NO: 11627 - DNA, 21 bp, synthetic construct
  misc_feature 1..21: note = Description of Artificial Sequence: Syntheticoligonucleotide
  source 1..21: mol_type = other DNA
tgggactcccgggagtcccac

SEQ ID NO: 11628 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactcgtacgagtcnnnn

SEQ ID NO: 11629 - DNA, 21 bp, synthetic construct
  misc_feature 1..21: note = Description of Artificial Sequence: Syntheticoligonucleotide
  source 1..21: mol_type = other DNA
gcggactcgtacgagtccgcc

SEQ ID NO: 11630 - DNA, 21 bp, synthetic construct
  misc_feature 1..21: note = Description of Artificial Sequence: Syntheticoligonucleotide
  source 1..21: mol_type = other DNA
gcggactcgtacgagtccgct

SEQ ID NO: 11631 - DNA, 21 bp, synthetic construct
  misc_feature 1..21: note = Description of Artificial Sequence: Syntheticoligonucleotide
  source 1..21: mol_type = other DNA
acggactcgtacgagtccgtc

SEQ ID NO: 11632 - DNA, 21 bp, synthetic construct
  misc_feature 1..21: note = Description of Artificial Sequence: Syntheticoligonucleotide
  source 1..21: mol_type = other DNA
gaggactcgtacgagtcctcc

SEQ ID NO: 11633 - DNA, 21 bp, synthetic construct
  misc_feature 1..21: note = Description of Artificial Sequence: Syntheticoligonucleotide
  source 1..21: mol_type = other DNA
gcagactcgtacgagtctgcc

SEQ ID NO: 11634 - DNA, 21 bp, synthetic construct
  misc_feature 1..21: note = Description of Artificial Sequence: Syntheticoligonucleotide
  source 1..21: mol_type = other DNA
gcggactcgtacgagtccgca

SEQ ID NO: 11635 - DNA, 21 bp, synthetic construct
  misc_feature 1..21: note = Description of Artificial Sequence: Syntheticoligonucleotide
  source 1..21: mol_type = other DNA
tcggactcgtacgagtccgac

SEQ ID NO: 11636 - DNA, 21 bp, synthetic construct
  misc_feature 1..21: note = Description of Artificial Sequence: Syntheticoligonucleotide
  source 1..21: mol_type = other DNA
gtggactcgtacgagtccacc

SEQ ID NO: 11637 - DNA, 21 bp, synthetic construct
  misc_feature 1..21: note = Description of Artificial Sequence: Syntheticoligonucleotide
  source 1..21: mol_type = other DNA
gctgactcgtacgagtcagcc

SEQ ID NO: 11638 - DNA, 21 bp, synthetic construct
  misc_feature 1..21: note = Description of Artificial Sequence: Syntheticoligonucleotide
  source 1..21: mol_type = other DNA
cccgactcgtacgagtcgggc

SEQ ID NO: 11639 - DNA, 21 bp, synthetic construct
  misc_feature 1..21: note = Description of Artificial Sequence: Syntheticoligonucleotide
  source 1..21: mol_type = other DNA
cccgactcgtacgagtcgggt

SEQ ID NO: 11640 - DNA, 21 bp, synthetic construct
  misc_feature 1..21: note = Description of Artificial Sequence: Syntheticoligonucleotide
  source 1..21: mol_type = other DNA
accgactcgtacgagtcggtc

SEQ ID NO: 11641 - DNA, 21 bp, synthetic construct
  misc_feature 1..21: note = Description of Artificial Sequence: Syntheticoligonucleotide
  source 1..21: mol_type = other DNA
cacgactcgtacgagtcgtgc

SEQ ID NO: 11642 - DNA, 21 bp, synthetic construct
  misc_feature 1..21: note = Description of Artificial Sequence: Syntheticoligonucleotide
  source 1..21: mol_type = other DNA
ccagactcgtacgagtctggc

SEQ ID NO: 11643 - DNA, 21 bp, synthetic construct
  misc_feature 1..21: note = Description of Artificial Sequence: Syntheticoligonucleotide
  source 1..21: mol_type = other DNA
cccgactcgtacgagtcggga

SEQ ID NO: 11644 - DNA, 21 bp, synthetic construct
  misc_feature 1..21: note = Description of Artificial Sequence: Syntheticoligonucleotide
  source 1..21: mol_type = other DNA
tccgactcgtacgagtcggac

SEQ ID NO: 11645 - DNA, 21 bp, synthetic construct
  misc_feature 1..21: note = Description of Artificial Sequence: Syntheticoligonucleotide
  source 1..21: mol_type = other DNA
cctgactcgtacgagtcaggc

SEQ ID NO: 11646 - DNA, 21 bp, synthetic construct
  misc_feature 1..21: note = Description of Artificial Sequence: Syntheticoligonucleotide
  source 1..21: mol_type = other DNA
ggcgactcgtacgagtcgccc

SEQ ID NO: 11647 - DNA, 21 bp, synthetic construct
  misc_feature 1..21: note = Description of Artificial Sequence: Syntheticoligonucleotide
  source 1..21: mol_type = other DNA
ggcgactcgtacgagtcgcct

SEQ ID NO: 11648 - DNA, 21 bp, synthetic construct
  misc_feature 1..21: note = Description of Artificial Sequence: Syntheticoligonucleotide
  source 1..21: mol_type = other DNA
agcgactcgtacgagtcgctc

SEQ ID NO: 11649 - DNA, 21 bp, synthetic construct
  misc_feature 1..21: note = Description of Artificial Sequence: Syntheticoligonucleotide
  source 1..21: mol_type = other DNA
gacgactcgtacgagtcgtcc

SEQ ID NO: 11650 - DNA, 21 bp, synthetic construct
  misc_feature 1..21: note = Description of Artificial Sequence: Syntheticoligonucleotide
  source 1..21: mol_type = other DNA
ggagactcgtacgagtctccc

SEQ ID NO: 11651 - DNA, 21 bp, synthetic construct
  misc_feature 1..21: note = Description of Artificial Sequence: Syntheticoligonucleotide
  source 1..21: mol_type = other DNA
ggcgactcgtacgagtcgcca

SEQ ID NO: 11652 - DNA, 21 bp, synthetic construct
  misc_feature 1..21: note = Description of Artificial Sequence: Syntheticoligonucleotide
  source 1..21: mol_type = other DNA
tgcgactcgtacgagtcgcac

SEQ ID NO: 11653 - DNA, 21 bp, synthetic construct
  misc_feature 1..21: note = Description of Artificial Sequence: Syntheticoligonucleotide
  source 1..21: mol_type = other DNA
ggtgactcgtacgagtcaccc

SEQ ID NO: 11654 - DNA, 21 bp, synthetic construct
  misc_feature 1..21: note = Description of Artificial Sequence: Syntheticoligonucleotide
  source 1..21: mol_type = other DNA
cgggactcgtacgagtcccgt

SEQ ID NO: 11655 - DNA, 21 bp, synthetic construct
  misc_feature 1..21: note = Description of Artificial Sequence: Syntheticoligonucleotide
  source 1..21: mol_type = other DNA
agggactcgtacgagtccctg

SEQ ID NO: 11656 - DNA, 21 bp, synthetic construct
  misc_feature 1..21: note = Description of Artificial Sequence: Syntheticoligonucleotide
  source 1..21: mol_type = other DNA
caggactcgtacgagtcctgg

SEQ ID NO: 11657 - DNA, 21 bp, synthetic construct
  misc_feature 1..21: note = Description of Artificial Sequence: Syntheticoligonucleotide
  source 1..21: mol_type = other DNA
cgagactcgtacgagtctcgg

SEQ ID NO: 11658 - DNA, 21 bp, synthetic construct
  misc_feature 1..21: note = Description of Artificial Sequence: Syntheticoligonucleotide
  source 1..21: mol_type = other DNA
cgggactcgtacgagtcccga

SEQ ID NO: 11659 - DNA, 21 bp, synthetic construct
  misc_feature 1..21: note = Description of Artificial Sequence: Syntheticoligonucleotide
  source 1..21: mol_type = other DNA
tgggactcgtacgagtcccag

SEQ ID NO: 11660 - DNA, 21 bp, synthetic construct
  misc_feature 1..21: note = Description of Artificial Sequence: Syntheticoligonucleotide
  source 1..21: mol_type = other DNA
ctggactcgtacgagtccagg

SEQ ID NO: 11661 - DNA, 21 bp, synthetic construct
  misc_feature 1..21: note = Description of Artificial Sequence: Syntheticoligonucleotide
  source 1..21: mol_type = other DNA
cgtgactcgtacgagtcacgg

SEQ ID NO: 11662 - DNA, 21 bp, synthetic construct
  misc_feature 1..21: note = Description of Artificial Sequence: Syntheticoligonucleotide
  source 1..21: mol_type = other DNA
ggcgactcgtacgagtcgccg

SEQ ID NO: 11663 - DNA, 21 bp, synthetic construct
  misc_feature 1..21: note = Description of Artificial Sequence: Syntheticoligonucleotide
  source 1..21: mol_type = other DNA
agcgactcgtacgagtcgctg

SEQ ID NO: 11664 - DNA, 21 bp, synthetic construct
  misc_feature 1..21: note = Description of Artificial Sequence: Syntheticoligonucleotide
  source 1..21: mol_type = other DNA
gacgactcgtacgagtcgtcg

SEQ ID NO: 11665 - DNA, 21 bp, synthetic construct
  misc_feature 1..21: note = Description of Artificial Sequence: Syntheticoligonucleotide
  source 1..21: mol_type = other DNA
ggagactcgtacgagtctccg

SEQ ID NO: 11666 - DNA, 21 bp, synthetic construct
  misc_feature 1..21: note = Description of Artificial Sequence: Syntheticoligonucleotide
  source 1..21: mol_type = other DNA
tgcgactcgtacgagtcgcag

SEQ ID NO: 11667 - DNA, 21 bp, synthetic construct
  misc_feature 1..21: note = Description of Artificial Sequence: Syntheticoligonucleotide
  source 1..21: mol_type = other DNA
ggtgactcgtacgagtcaccg

SEQ ID NO: 11668 - DNA, 21 bp, synthetic construct
  misc_feature 1..21: note = Description of Artificial Sequence: Syntheticoligonucleotide
  source 1..21: mol_type = other DNA
acggactcgtacgagtccgtg

SEQ ID NO: 11669 - DNA, 21 bp, synthetic construct
  misc_feature 1..21: note = Description of Artificial Sequence: Syntheticoligonucleotide
  source 1..21: mol_type = other DNA
ccagactcgtacgagtctggg

SEQ ID NO: 11670 - DNA, 21 bp, synthetic construct
  misc_feature 1..21: note = Description of Artificial Sequence: Syntheticoligonucleotide
  source 1..21: mol_type = other DNA
tcggactcgtacgagtccgag

SEQ ID NO: 11671 - DNA, 21 bp, synthetic construct
  misc_feature 1..21: note = Description of Artificial Sequence: Syntheticoligonucleotide
  source 1..21: mol_type = other DNA
cctgactcgtacgagtcaggg

SEQ ID NO: 11672 - DNA, 21 bp, synthetic construct
  misc_feature 1..21: note = Description of Artificial Sequence: Syntheticoligonucleotide
  source 1..21: mol_type = other DNA
cacgactcgtacgagtcgtgg

SEQ ID NO: 11673 - DNA, 21 bp, synthetic construct
  misc_feature 1..21: note = Description of Artificial Sequence: Syntheticoligonucleotide
  source 1..21: mol_type = other DNA
gccgactcgtacgagtcggct

SEQ ID NO: 11674 - DNA, 21 bp, synthetic construct
  misc_feature 1..21: note = Description of Artificial Sequence: Syntheticoligonucleotide
  source 1..21: mol_type = other DNA
gccgactcgtacgagtcggca

SEQ ID NO: 11675 - DNA, 21 bp, synthetic construct
  misc_feature 1..21: note = Description of Artificial Sequence: Syntheticoligonucleotide
  source 1..21: mol_type = other DNA
cgagactcgtacgagtctcgc

SEQ ID NO: 11676 - DNA, 21 bp, synthetic construct
  misc_feature 1..21: note = Description of Artificial Sequence: Syntheticoligonucleotide
  source 1..21: mol_type = other DNA
cgtgactcgtacgagtcacgc

SEQ ID NO: 11677 - DNA, 21 bp, synthetic construct
  misc_feature 1..21: note = Description of Artificial Sequence: Syntheticoligonucleotide
  source 1..21: mol_type = other DNA
caggactcgtacgagtcctgc

SEQ ID NO: 11678 - DNA, 21 bp, synthetic construct
  misc_feature 1..21: note = Description of Artificial Sequence: Syntheticoligonucleotide
  source 1..21: mol_type = other DNA
ctggactcgtacgagtccagc

SEQ ID NO: 11679 - DNA, 21 bp, synthetic construct
  misc_feature 1..21: note = Description of Artificial Sequence: Syntheticoligonucleotide
  source 1..21: mol_type = other DNA
gaggactcgtacgagtcctcg

SEQ ID NO: 11680 - DNA, 21 bp, synthetic construct
  misc_feature 1..21: note = Description of Artificial Sequence: Syntheticoligonucleotide
  source 1..21: mol_type = other DNA
gtggactcgtacgagtccacg

SEQ ID NO: 11681 - DNA, 21 bp, synthetic construct
  misc_feature 1..21: note = Description of Artificial Sequence: Syntheticoligonucleotide
  source 1..21: mol_type = other DNA
accgactcgtacgagtcggtg

SEQ ID NO: 11682 - DNA, 21 bp, synthetic construct
  misc_feature 1..21: note = Description of Artificial Sequence: Syntheticoligonucleotide
  source 1..21: mol_type = other DNA
tccgactcgtacgagtcggag

SEQ ID NO: 11683 - DNA, 21 bp, synthetic construct
  misc_feature 1..21: note = Description of Artificial Sequence: Syntheticoligonucleotide
  source 1..21: mol_type = other DNA
cgggactcgtacgagtcccgc

SEQ ID NO: 11684 - DNA, 21 bp, synthetic construct
  misc_feature 1..21: note = Description of Artificial Sequence: Syntheticoligonucleotide
  source 1..21: mol_type = other DNA
agggactcgtacgagtccctc

SEQ ID NO: 11685 - DNA, 21 bp, synthetic construct
  misc_feature 1..21: note = Description of Artificial Sequence: Syntheticoligonucleotide
  source 1..21: mol_type = other DNA
tgggactcgtacgagtcccac

SEQ ID NO: 11686 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactcctaggagtcnnnn

SEQ ID NO: 11687 - DNA, 21 bp, synthetic construct
  misc_feature 1..21: note = Description of Artificial Sequence: Syntheticoligonucleotide
  source 1..21: mol_type = other DNA
gcggactcctaggagtccgcc

SEQ ID NO: 11688 - DNA, 21 bp, synthetic construct
  misc_feature 1..21: note = Description of Artificial Sequence: Syntheticoligonucleotide
  source 1..21: mol_type = other DNA
gcggactcctaggagtccgct

SEQ ID NO: 11689 - DNA, 21 bp, synthetic construct
  misc_feature 1..21: note = Description of Artificial Sequence: Syntheticoligonucleotide
  source 1..21: mol_type = other DNA
acggactcctaggagtccgtc

SEQ ID NO: 11690 - DNA, 21 bp, synthetic construct
  misc_feature 1..21: note = Description of Artificial Sequence: Syntheticoligonucleotide
  source 1..21: mol_type = other DNA
gaggactcctaggagtcctcc

SEQ ID NO: 11691 - DNA, 21 bp, synthetic construct
  misc_feature 1..21: note = Description of Artificial Sequence: Syntheticoligonucleotide
  source 1..21: mol_type = other DNA
gcagactcctaggagtctgcc

SEQ ID NO: 11692 - DNA, 21 bp, synthetic construct
  misc_feature 1..21: note = Description of Artificial Sequence: Syntheticoligonucleotide
  source 1..21: mol_type = other DNA
gcggactcctaggagtccgca

SEQ ID NO: 11693 - DNA, 21 bp, synthetic construct
  misc_feature 1..21: note = Description of Artificial Sequence: Syntheticoligonucleotide
  source 1..21: mol_type = other DNA
tcggactcctaggagtccgac

SEQ ID NO: 11694 - DNA, 21 bp, synthetic construct
  misc_feature 1..21: note = Description of Artificial Sequence: Syntheticoligonucleotide
  source 1..21: mol_type = other DNA
gtggactcctaggagtccacc

SEQ ID NO: 11695 - DNA, 21 bp, synthetic construct
  misc_feature 1..21: note = Description of Artificial Sequence: Syntheticoligonucleotide
  source 1..21: mol_type = other DNA
gctgactcctaggagtcagcc

SEQ ID NO: 11696 - DNA, 21 bp, synthetic construct
  misc_feature 1..21: note = Description of Artificial Sequence: Syntheticoligonucleotide
  source 1..21: mol_type = other DNA
cccgactcctaggagtcgggc

SEQ ID NO: 11697 - DNA, 21 bp, synthetic construct
  misc_feature 1..21: note = Description of Artificial Sequence: Syntheticoligonucleotide
  source 1..21: mol_type = other DNA
cccgactcctaggagtcgggt

SEQ ID NO: 11698 - DNA, 21 bp, synthetic construct
  misc_feature 1..21: note = Description of Artificial Sequence: Syntheticoligonucleotide
  source 1..21: mol_type = other DNA
accgactcctaggagtcggtc

SEQ ID NO: 11699 - DNA, 21 bp, synthetic construct
  misc_feature 1..21: note = Description of Artificial Sequence: Syntheticoligonucleotide
  source 1..21: mol_type = other DNA
cacgactcctaggagtcgtgc

SEQ ID NO: 11700 - DNA, 21 bp, synthetic construct
  misc_feature 1..21: note = Description of Artificial Sequence: Syntheticoligonucleotide
  source 1..21: mol_type = other DNA
ccagactcctaggagtctggc

SEQ ID NO: 11701 - DNA, 21 bp, synthetic construct
  misc_feature 1..21: note = Description of Artificial Sequence: Syntheticoligonucleotide
  source 1..21: mol_type = other DNA
cccgactcctaggagtcggga

SEQ ID NO: 11702 - DNA, 21 bp, synthetic construct
  misc_feature 1..21: note = Description of Artificial Sequence: Syntheticoligonucleotide
  source 1..21: mol_type = other DNA
tccgactcctaggagtcggac

SEQ ID NO: 11703 - DNA, 21 bp, synthetic construct
  misc_feature 1..21: note = Description of Artificial Sequence: Syntheticoligonucleotide
  source 1..21: mol_type = other DNA
cctgactcctaggagtcaggc

SEQ ID NO: 11704 - DNA, 21 bp, synthetic construct
  misc_feature 1..21: note = Description of Artificial Sequence: Syntheticoligonucleotide
  source 1..21: mol_type = other DNA
ggcgactcctaggagtcgccc

SEQ ID NO: 11705 - DNA, 21 bp, synthetic construct
  misc_feature 1..21: note = Description of Artificial Sequence: Syntheticoligonucleotide
  source 1..21: mol_type = other DNA
ggcgactcctaggagtcgcct

SEQ ID NO: 11706 - DNA, 21 bp, synthetic construct
  misc_feature 1..21: note = Description of Artificial Sequence: Syntheticoligonucleotide
  source 1..21: mol_type = other DNA
agcgactcctaggagtcgctc

SEQ ID NO: 11707 - DNA, 21 bp, synthetic construct
  misc_feature 1..21: note = Description of Artificial Sequence: Syntheticoligonucleotide
  source 1..21: mol_type = other DNA
gacgactcctaggagtcgtcc

SEQ ID NO: 11708 - DNA, 21 bp, synthetic construct
  misc_feature 1..21: note = Description of Artificial Sequence: Syntheticoligonucleotide
  source 1..21: mol_type = other DNA
ggagactcctaggagtctccc

SEQ ID NO: 11709 - DNA, 21 bp, synthetic construct
  misc_feature 1..21: note = Description of Artificial Sequence: Syntheticoligonucleotide
  source 1..21: mol_type = other DNA
ggcgactcctaggagtcgcca

SEQ ID NO: 11710 - DNA, 21 bp, synthetic construct
  misc_feature 1..21: note = Description of Artificial Sequence: Syntheticoligonucleotide
  source 1..21: mol_type = other DNA
tgcgactcctaggagtcgcac

SEQ ID NO: 11711 - DNA, 21 bp, synthetic construct
  misc_feature 1..21: note = Description of Artificial Sequence: Syntheticoligonucleotide
  source 1..21: mol_type = other DNA
ggtgactcctaggagtcaccc

SEQ ID NO: 11712 - DNA, 21 bp, synthetic construct
  misc_feature 1..21: note = Description of Artificial Sequence: Syntheticoligonucleotide
  source 1..21: mol_type = other DNA
cgggactcctaggagtcccgt

SEQ ID NO: 11713 - DNA, 21 bp, synthetic construct
  misc_feature 1..21: note = Description of Artificial Sequence: Syntheticoligonucleotide
  source 1..21: mol_type = other DNA
agggactcctaggagtccctg

SEQ ID NO: 11714 - DNA, 21 bp, synthetic construct
  misc_feature 1..21: note = Description of Artificial Sequence: Syntheticoligonucleotide
  source 1..21: mol_type = other DNA
caggactcctaggagtcctgg

SEQ ID NO: 11715 - DNA, 21 bp, synthetic construct
  misc_feature 1..21: note = Description of Artificial Sequence: Syntheticoligonucleotide
  source 1..21: mol_type = other DNA
cgagactcctaggagtctcgg

SEQ ID NO: 11716 - DNA, 21 bp, synthetic construct
  misc_feature 1..21: note = Description of Artificial Sequence: Syntheticoligonucleotide
  source 1..21: mol_type = other DNA
cgggactcctaggagtcccga

SEQ ID NO: 11717 - DNA, 21 bp, synthetic construct
  misc_feature 1..21: note = Description of Artificial Sequence: Syntheticoligonucleotide
  source 1..21: mol_type = other DNA
tgggactcctaggagtcccag

SEQ ID NO: 11718 - DNA, 21 bp, synthetic construct
  misc_feature 1..21: note = Description of Artificial Sequence: Syntheticoligonucleotide
  source 1..21: mol_type = other DNA
ctggactcctaggagtccagg

SEQ ID NO: 11719 - DNA, 21 bp, synthetic construct
  misc_feature 1..21: note = Description of Artificial Sequence: Syntheticoligonucleotide
  source 1..21: mol_type = other DNA
cgtgactcctaggagtcacgg

SEQ ID NO: 11720 - DNA, 21 bp, synthetic construct
  misc_feature 1..21: note = Description of Artificial Sequence: Syntheticoligonucleotide
  source 1..21: mol_type = other DNA
ggcgactcctaggagtcgccg

SEQ ID NO: 11721 - DNA, 21 bp, synthetic construct
  misc_feature 1..21: note = Description of Artificial Sequence: Syntheticoligonucleotide
  source 1..21: mol_type = other DNA
agcgactcctaggagtcgctg

SEQ ID NO: 11722 - DNA, 21 bp, synthetic construct
  misc_feature 1..21: note = Description of Artificial Sequence: Syntheticoligonucleotide
  source 1..21: mol_type = other DNA
gacgactcctaggagtcgtcg

SEQ ID NO: 11723 - DNA, 21 bp, synthetic construct
  misc_feature 1..21: note = Description of Artificial Sequence: Syntheticoligonucleotide
  source 1..21: mol_type = other DNA
ggagactcctaggagtctccg

SEQ ID NO: 11724 - DNA, 21 bp, synthetic construct
  misc_feature 1..21: note = Description of Artificial Sequence: Syntheticoligonucleotide
  source 1..21: mol_type = other DNA
tgcgactcctaggagtcgcag

SEQ ID NO: 11725 - DNA, 21 bp, synthetic construct
  misc_feature 1..21: note = Description of Artificial Sequence: Syntheticoligonucleotide
  source 1..21: mol_type = other DNA
ggtgactcctaggagtcaccg

SEQ ID NO: 11726 - DNA, 21 bp, synthetic construct
  misc_feature 1..21: note = Description of Artificial Sequence: Syntheticoligonucleotide
  source 1..21: mol_type = other DNA
acggactcctaggagtccgtg

SEQ ID NO: 11727 - DNA, 21 bp, synthetic construct
  misc_feature 1..21: note = Description of Artificial Sequence: Syntheticoligonucleotide
  source 1..21: mol_type = other DNA
ccagactcctaggagtctggg

SEQ ID NO: 11728 - DNA, 21 bp, synthetic construct
  misc_feature 1..21: note = Description of Artificial Sequence: Syntheticoligonucleotide
  source 1..21: mol_type = other DNA
tcggactcctaggagtccgag

SEQ ID NO: 11729 - DNA, 21 bp, synthetic construct
  misc_feature 1..21: note = Description of Artificial Sequence: Syntheticoligonucleotide
  source 1..21: mol_type = other DNA
cctgactcctaggagtcaggg

SEQ ID NO: 11730 - DNA, 21 bp, synthetic construct
  misc_feature 1..21: note = Description of Artificial Sequence: Syntheticoligonucleotide
  source 1..21: mol_type = other DNA
cacgactcctaggagtcgtgg

SEQ ID NO: 11731 - DNA, 21 bp, synthetic construct
  misc_feature 1..21: note = Description of Artificial Sequence: Syntheticoligonucleotide
  source 1..21: mol_type = other DNA
gccgactcctaggagtcggct

SEQ ID NO: 11732 - DNA, 21 bp, synthetic construct
  misc_feature 1..21: note = Description of Artificial Sequence: Syntheticoligonucleotide
  source 1..21: mol_type = other DNA
gccgactcctaggagtcggca

SEQ ID NO: 11733 - DNA, 21 bp, synthetic construct
  misc_feature 1..21: note = Description of Artificial Sequence: Syntheticoligonucleotide
  source 1..21: mol_type = other DNA
cgagactcctaggagtctcgc

SEQ ID NO: 11734 - DNA, 21 bp, synthetic construct
  misc_feature 1..21: note = Description of Artificial Sequence: Syntheticoligonucleotide
  source 1..21: mol_type = other DNA
cgtgactcctaggagtcacgc

SEQ ID NO: 11735 - DNA, 21 bp, synthetic construct
  misc_feature 1..21: note = Description of Artificial Sequence: Syntheticoligonucleotide
  source 1..21: mol_type = other DNA
caggactcctaggagtcctgc

SEQ ID NO: 11736 - DNA, 21 bp, synthetic construct
  misc_feature 1..21: note = Description of Artificial Sequence: Syntheticoligonucleotide
  source 1..21: mol_type = other DNA
ctggactcctaggagtccagc

SEQ ID NO: 11737 - DNA, 21 bp, synthetic construct
  misc_feature 1..21: note = Description of Artificial Sequence: Syntheticoligonucleotide
  source 1..21: mol_type = other DNA
gaggactcctaggagtcctcg

SEQ ID NO: 11738 - DNA, 21 bp, synthetic construct
  misc_feature 1..21: note = Description of Artificial Sequence: Syntheticoligonucleotide
  source 1..21: mol_type = other DNA
gtggactcctaggagtccacg

SEQ ID NO: 11739 - DNA, 21 bp, synthetic construct
  misc_feature 1..21: note = Description of Artificial Sequence: Syntheticoligonucleotide
  source 1..21: mol_type = other DNA
accgactcctaggagtcggtg

SEQ ID NO: 11740 - DNA, 21 bp, synthetic construct
  misc_feature 1..21: note = Description of Artificial Sequence: Syntheticoligonucleotide
  source 1..21: mol_type = other DNA
tccgactcctaggagtcggag

SEQ ID NO: 11741 - DNA, 21 bp, synthetic construct
  misc_feature 1..21: note = Description of Artificial Sequence: Syntheticoligonucleotide
  source 1..21: mol_type = other DNA
cgggactcctaggagtcccgc

SEQ ID NO: 11742 - DNA, 21 bp, synthetic construct
  misc_feature 1..21: note = Description of Artificial Sequence: Syntheticoligonucleotide
  source 1..21: mol_type = other DNA
agggactcctaggagtccctc

SEQ ID NO: 11743 - DNA, 21 bp, synthetic construct
  misc_feature 1..21: note = Description of Artificial Sequence: Syntheticoligonucleotide
  source 1..21: mol_type = other DNA
tgggactcctaggagtcccac

SEQ ID NO: 11744 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactccatggagtcnnnn

SEQ ID NO: 11745 - DNA, 21 bp, synthetic construct
  misc_feature 1..21: note = Description of Artificial Sequence: Syntheticoligonucleotide
  source 1..21: mol_type = other DNA
gcggactccatggagtccgcc

SEQ ID NO: 11746 - DNA, 21 bp, synthetic construct
  misc_feature 1..21: note = Description of Artificial Sequence: Syntheticoligonucleotide
  source 1..21: mol_type = other DNA
gcggactccatggagtccgct

SEQ ID NO: 11747 - DNA, 21 bp, synthetic construct
  misc_feature 1..21: note = Description of Artificial Sequence: Syntheticoligonucleotide
  source 1..21: mol_type = other DNA
acggactccatggagtccgtc

SEQ ID NO: 11748 - DNA, 21 bp, synthetic construct
  misc_feature 1..21: note = Description of Artificial Sequence: Syntheticoligonucleotide
  source 1..21: mol_type = other DNA
gaggactccatggagtcctcc

SEQ ID NO: 11749 - DNA, 21 bp, synthetic construct
  misc_feature 1..21: note = Description of Artificial Sequence: Syntheticoligonucleotide
  source 1..21: mol_type = other DNA
gcagactccatggagtctgcc

SEQ ID NO: 11750 - DNA, 21 bp, synthetic construct
  misc_feature 1..21: note = Description of Artificial Sequence: Syntheticoligonucleotide
  source 1..21: mol_type = other DNA
gcggactccatggagtccgca

SEQ ID NO: 11751 - DNA, 21 bp, synthetic construct
  misc_feature 1..21: note = Description of Artificial Sequence: Syntheticoligonucleotide
  source 1..21: mol_type = other DNA
tcggactccatggagtccgac

SEQ ID NO: 11752 - DNA, 21 bp, synthetic construct
  misc_feature 1..21: note = Description of Artificial Sequence: Syntheticoligonucleotide
  source 1..21: mol_type = other DNA
gtggactccatggagtccacc

SEQ ID NO: 11753 - DNA, 21 bp, synthetic construct
  misc_feature 1..21: note = Description of Artificial Sequence: Syntheticoligonucleotide
  source 1..21: mol_type = other DNA
gctgactccatggagtcagcc

SEQ ID NO: 11754 - DNA, 21 bp, synthetic construct
  misc_feature 1..21: note = Description of Artificial Sequence: Syntheticoligonucleotide
  source 1..21: mol_type = other DNA
cccgactccatggagtcgggc

SEQ ID NO: 11755 - DNA, 21 bp, synthetic construct
  misc_feature 1..21: note = Description of Artificial Sequence: Syntheticoligonucleotide
  source 1..21: mol_type = other DNA
cccgactccatggagtcgggt

SEQ ID NO: 11756 - DNA, 21 bp, synthetic construct
  misc_feature 1..21: note = Description of Artificial Sequence: Syntheticoligonucleotide
  source 1..21: mol_type = other DNA
accgactccatggagtcggtc

SEQ ID NO: 11757 - DNA, 21 bp, synthetic construct
  misc_feature 1..21: note = Description of Artificial Sequence: Syntheticoligonucleotide
  source 1..21: mol_type = other DNA
cacgactccatggagtcgtgc

SEQ ID NO: 11758 - DNA, 21 bp, synthetic construct
  misc_feature 1..21: note = Description of Artificial Sequence: Syntheticoligonucleotide
  source 1..21: mol_type = other DNA
ccagactccatggagtctggc

SEQ ID NO: 11759 - DNA, 21 bp, synthetic construct
  misc_feature 1..21: note = Description of Artificial Sequence: Syntheticoligonucleotide
  source 1..21: mol_type = other DNA
cccgactccatggagtcggga

SEQ ID NO: 11760 - DNA, 21 bp, synthetic construct
  misc_feature 1..21: note = Description of Artificial Sequence: Syntheticoligonucleotide
  source 1..21: mol_type = other DNA
tccgactccatggagtcggac

SEQ ID NO: 11761 - DNA, 21 bp, synthetic construct
  misc_feature 1..21: note = Description of Artificial Sequence: Syntheticoligonucleotide
  source 1..21: mol_type = other DNA
cctgactccatggagtcaggc

SEQ ID NO: 11762 - DNA, 21 bp, synthetic construct
  misc_feature 1..21: note = Description of Artificial Sequence: Syntheticoligonucleotide
  source 1..21: mol_type = other DNA
ggcgactccatggagtcgccc

SEQ ID NO: 11763 - DNA, 21 bp, synthetic construct
  misc_feature 1..21: note = Description of Artificial Sequence: Syntheticoligonucleotide
  source 1..21: mol_type = other DNA
ggcgactccatggagtcgcct

SEQ ID NO: 11764 - DNA, 21 bp, synthetic construct
  misc_feature 1..21: note = Description of Artificial Sequence: Syntheticoligonucleotide
  source 1..21: mol_type = other DNA
agcgactccatggagtcgctc

SEQ ID NO: 11765 - DNA, 21 bp, synthetic construct
  misc_feature 1..21: note = Description of Artificial Sequence: Syntheticoligonucleotide
  source 1..21: mol_type = other DNA
gacgactccatggagtcgtcc

SEQ ID NO: 11766 - DNA, 21 bp, synthetic construct
  misc_feature 1..21: note = Description of Artificial Sequence: Syntheticoligonucleotide
  source 1..21: mol_type = other DNA
ggagactccatggagtctccc

SEQ ID NO: 11767 - DNA, 21 bp, synthetic construct
  misc_feature 1..21: note = Description of Artificial Sequence: Syntheticoligonucleotide
  source 1..21: mol_type = other DNA
ggcgactccatggagtcgcca

SEQ ID NO: 11768 - DNA, 21 bp, synthetic construct
  misc_feature 1..21: note = Description of Artificial Sequence: Syntheticoligonucleotide
  source 1..21: mol_type = other DNA
tgcgactccatggagtcgcac

SEQ ID NO: 11769 - DNA, 21 bp, synthetic construct
  misc_feature 1..21: note = Description of Artificial Sequence: Syntheticoligonucleotide
  source 1..21: mol_type = other DNA
ggtgactccatggagtcaccc

SEQ ID NO: 11770 - DNA, 21 bp, synthetic construct
  misc_feature 1..21: note = Description of Artificial Sequence: Syntheticoligonucleotide
  source 1..21: mol_type = other DNA
cgggactccatggagtcccgt

SEQ ID NO: 11771 - DNA, 21 bp, synthetic construct
  misc_feature 1..21: note = Description of Artificial Sequence: Syntheticoligonucleotide
  source 1..21: mol_type = other DNA
agggactccatggagtccctg

SEQ ID NO: 11772 - DNA, 21 bp, synthetic construct
  misc_feature 1..21: note = Description of Artificial Sequence: Syntheticoligonucleotide
  source 1..21: mol_type = other DNA
caggactccatggagtcctgg

SEQ ID NO: 11773 - DNA, 21 bp, synthetic construct
  misc_feature 1..21: note = Description of Artificial Sequence: Syntheticoligonucleotide
  source 1..21: mol_type = other DNA
cgagactccatggagtctcgg

SEQ ID NO: 11774 - DNA, 21 bp, synthetic construct
  misc_feature 1..21: note = Description of Artificial Sequence: Syntheticoligonucleotide
  source 1..21: mol_type = other DNA
cgggactccatggagtcccga

SEQ ID NO: 11775 - DNA, 21 bp, synthetic construct
  misc_feature 1..21: note = Description of Artificial Sequence: Syntheticoligonucleotide
  source 1..21: mol_type = other DNA
tgggactccatggagtcccag

SEQ ID NO: 11776 - DNA, 21 bp, synthetic construct
  misc_feature 1..21: note = Description of Artificial Sequence: Syntheticoligonucleotide
  source 1..21: mol_type = other DNA
ctggactccatggagtccagg

SEQ ID NO: 11777 - DNA, 21 bp, synthetic construct
  misc_feature 1..21: note = Description of Artificial Sequence: Syntheticoligonucleotide
  source 1..21: mol_type = other DNA
cgtgactccatggagtcacgg

SEQ ID NO: 11778 - DNA, 21 bp, synthetic construct
  misc_feature 1..21: note = Description of Artificial Sequence: Syntheticoligonucleotide
  source 1..21: mol_type = other DNA
ggcgactccatggagtcgccg

SEQ ID NO: 11779 - DNA, 21 bp, synthetic construct
  misc_feature 1..21: note = Description of Artificial Sequence: Syntheticoligonucleotide
  source 1..21: mol_type = other DNA
agcgactccatggagtcgctg

SEQ ID NO: 11780 - DNA, 21 bp, synthetic construct
  misc_feature 1..21: note = Description of Artificial Sequence: Syntheticoligonucleotide
  source 1..21: mol_type = other DNA
gacgactccatggagtcgtcg

SEQ ID NO: 11781 - DNA, 21 bp, synthetic construct
  misc_feature 1..21: note = Description of Artificial Sequence: Syntheticoligonucleotide
  source 1..21: mol_type = other DNA
ggagactccatggagtctccg

SEQ ID NO: 11782 - DNA, 21 bp, synthetic construct
  misc_feature 1..21: note = Description of Artificial Sequence: Syntheticoligonucleotide
  source 1..21: mol_type = other DNA
tgcgactccatggagtcgcag

SEQ ID NO: 11783 - DNA, 21 bp, synthetic construct
  misc_feature 1..21: note = Description of Artificial Sequence: Syntheticoligonucleotide
  source 1..21: mol_type = other DNA
ggtgactccatggagtcaccg

SEQ ID NO: 11784 - DNA, 21 bp, synthetic construct
  misc_feature 1..21: note = Description of Artificial Sequence: Syntheticoligonucleotide
  source 1..21: mol_type = other DNA
acggactccatggagtccgtg

SEQ ID NO: 11785 - DNA, 21 bp, synthetic construct
  misc_feature 1..21: note = Description of Artificial Sequence: Syntheticoligonucleotide
  source 1..21: mol_type = other DNA
ccagactccatggagtctggg

SEQ ID NO: 11786 - DNA, 21 bp, synthetic construct
  misc_feature 1..21: note = Description of Artificial Sequence: Syntheticoligonucleotide
  source 1..21: mol_type = other DNA
tcggactccatggagtccgag

SEQ ID NO: 11787 - DNA, 21 bp, synthetic construct
  misc_feature 1..21: note = Description of Artificial Sequence: Syntheticoligonucleotide
  source 1..21: mol_type = other DNA
cctgactccatggagtcaggg

SEQ ID NO: 11788 - DNA, 21 bp, synthetic construct
  misc_feature 1..21: note = Description of Artificial Sequence: Syntheticoligonucleotide
  source 1..21: mol_type = other DNA
cacgactccatggagtcgtgg

SEQ ID NO: 11789 - DNA, 21 bp, synthetic construct
  misc_feature 1..21: note = Description of Artificial Sequence: Syntheticoligonucleotide
  source 1..21: mol_type = other DNA
gccgactccatggagtcggct

SEQ ID NO: 11790 - DNA, 21 bp, synthetic construct
  misc_feature 1..21: note = Description of Artificial Sequence: Syntheticoligonucleotide
  source 1..21: mol_type = other DNA
gccgactccatggagtcggca

SEQ ID NO: 11791 - DNA, 21 bp, synthetic construct
  misc_feature 1..21: note = Description of Artificial Sequence: Syntheticoligonucleotide
  source 1..21: mol_type = other DNA
cgagactccatggagtctcgc

SEQ ID NO: 11792 - DNA, 21 bp, synthetic construct
  misc_feature 1..21: note = Description of Artificial Sequence: Syntheticoligonucleotide
  source 1..21: mol_type = other DNA
cgtgactccatggagtcacgc

SEQ ID NO: 11793 - DNA, 21 bp, synthetic construct
  misc_feature 1..21: note = Description of Artificial Sequence: Syntheticoligonucleotide
  source 1..21: mol_type = other DNA
caggactccatggagtcctgc

SEQ ID NO: 11794 - DNA, 21 bp, synthetic construct
  misc_feature 1..21: note = Description of Artificial Sequence: Syntheticoligonucleotide
  source 1..21: mol_type = other DNA
ctggactccatggagtccagc

SEQ ID NO: 11795 - DNA, 21 bp, synthetic construct
  misc_feature 1..21: note = Description of Artificial Sequence: Syntheticoligonucleotide
  source 1..21: mol_type = other DNA
gaggactccatggagtcctcg

SEQ ID NO: 11796 - DNA, 21 bp, synthetic construct
  misc_feature 1..21: note = Description of Artificial Sequence: Syntheticoligonucleotide
  source 1..21: mol_type = other DNA
gtggactccatggagtccacg

SEQ ID NO: 11797 - DNA, 21 bp, synthetic construct
  misc_feature 1..21: note = Description of Artificial Sequence: Syntheticoligonucleotide
  source 1..21: mol_type = other DNA
accgactccatggagtcggtg

SEQ ID NO: 11798 - DNA, 21 bp, synthetic construct
  misc_feature 1..21: note = Description of Artificial Sequence: Syntheticoligonucleotide
  source 1..21: mol_type = other DNA
tccgactccatggagtcggag

SEQ ID NO: 11799 - DNA, 21 bp, synthetic construct
  misc_feature 1..21: note = Description of Artificial Sequence: Syntheticoligonucleotide
  source 1..21: mol_type = other DNA
cgggactccatggagtcccgc

SEQ ID NO: 11800 - DNA, 21 bp, synthetic construct
  misc_feature 1..21: note = Description of Artificial Sequence: Syntheticoligonucleotide
  source 1..21: mol_type = other DNA
agggactccatggagtccctc

SEQ ID NO: 11801 - DNA, 21 bp, synthetic construct
  misc_feature 1..21: note = Description of Artificial Sequence: Syntheticoligonucleotide
  source 1..21: mol_type = other DNA
tgggactccatggagtcccac

SEQ ID NO: 11802 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactctcgagagtcnnnn

SEQ ID NO: 11803 - DNA, 21 bp, synthetic construct
  misc_feature 1..21: note = Description of Artificial Sequence: Syntheticoligonucleotide
  source 1..21: mol_type = other DNA
gcggactctcgagagtccgcc

SEQ ID NO: 11804 - DNA, 21 bp, synthetic construct
  misc_feature 1..21: note = Description of Artificial Sequence: Syntheticoligonucleotide
  source 1..21: mol_type = other DNA
gcggactctcgagagtccgct

SEQ ID NO: 11805 - DNA, 21 bp, synthetic construct
  misc_feature 1..21: note = Description of Artificial Sequence: Syntheticoligonucleotide
  source 1..21: mol_type = other DNA
acggactctcgagagtccgtc

SEQ ID NO: 11806 - DNA, 21 bp, synthetic construct
  misc_feature 1..21: note = Description of Artificial Sequence: Syntheticoligonucleotide
  source 1..21: mol_type = other DNA
gaggactctcgagagtcctcc

SEQ ID NO: 11807 - DNA, 21 bp, synthetic construct
  misc_feature 1..21: note = Description of Artificial Sequence: Syntheticoligonucleotide
  source 1..21: mol_type = other DNA
gcagactctcgagagtctgcc

SEQ ID NO: 11808 - DNA, 21 bp, synthetic construct
  misc_feature 1..21: note = Description of Artificial Sequence: Syntheticoligonucleotide
  source 1..21: mol_type = other DNA
gcggactctcgagagtccgca

SEQ ID NO: 11809 - DNA, 21 bp, synthetic construct
  misc_feature 1..21: note = Description of Artificial Sequence: Syntheticoligonucleotide
  source 1..21: mol_type = other DNA
tcggactctcgagagtccgac

SEQ ID NO: 11810 - DNA, 21 bp, synthetic construct
  misc_feature 1..21: note = Description of Artificial Sequence: Syntheticoligonucleotide
  source 1..21: mol_type = other DNA
gtggactctcgagagtccacc

SEQ ID NO: 11811 - DNA, 21 bp, synthetic construct
  misc_feature 1..21: note = Description of Artificial Sequence: Syntheticoligonucleotide
  source 1..21: mol_type = other DNA
gctgactctcgagagtcagcc

SEQ ID NO: 11812 - DNA, 21 bp, synthetic construct
  misc_feature 1..21: note = Description of Artificial Sequence: Syntheticoligonucleotide
  source 1..21: mol_type = other DNA
cccgactctcgagagtcgggc

SEQ ID NO: 11813 - DNA, 21 bp, synthetic construct
  misc_feature 1..21: note = Description of Artificial Sequence: Syntheticoligonucleotide
  source 1..21: mol_type = other DNA
cccgactctcgagagtcgggt

SEQ ID NO: 11814 - DNA, 21 bp, synthetic construct
  misc_feature 1..21: note = Description of Artificial Sequence: Syntheticoligonucleotide
  source 1..21: mol_type = other DNA
accgactctcgagagtcggtc

SEQ ID NO: 11815 - DNA, 21 bp, synthetic construct
  misc_feature 1..21: note = Description of Artificial Sequence: Syntheticoligonucleotide
  source 1..21: mol_type = other DNA
cacgactctcgagagtcgtgc

SEQ ID NO: 11816 - DNA, 21 bp, synthetic construct
  misc_feature 1..21: note = Description of Artificial Sequence: Syntheticoligonucleotide
  source 1..21: mol_type = other DNA
ccagactctcgagagtctggc

SEQ ID NO: 11817 - DNA, 21 bp, synthetic construct
  misc_feature 1..21: note = Description of Artificial Sequence: Syntheticoligonucleotide
  source 1..21: mol_type = other DNA
cccgactctcgagagtcggga

SEQ ID NO: 11818 - DNA, 21 bp, synthetic construct
  misc_feature 1..21: note = Description of Artificial Sequence: Syntheticoligonucleotide
  source 1..21: mol_type = other DNA
tccgactctcgagagtcggac

SEQ ID NO: 11819 - DNA, 21 bp, synthetic construct
  misc_feature 1..21: note = Description of Artificial Sequence: Syntheticoligonucleotide
  source 1..21: mol_type = other DNA
cctgactctcgagagtcaggc

SEQ ID NO: 11820 - DNA, 21 bp, synthetic construct
  misc_feature 1..21: note = Description of Artificial Sequence: Syntheticoligonucleotide
  source 1..21: mol_type = other DNA
ggcgactctcgagagtcgccc

SEQ ID NO: 11821 - DNA, 21 bp, synthetic construct
  misc_feature 1..21: note = Description of Artificial Sequence: Syntheticoligonucleotide
  source 1..21: mol_type = other DNA
ggcgactctcgagagtcgcct

SEQ ID NO: 11822 - DNA, 21 bp, synthetic construct
  misc_feature 1..21: note = Description of Artificial Sequence: Syntheticoligonucleotide
  source 1..21: mol_type = other DNA
agcgactctcgagagtcgctc

SEQ ID NO: 11823 - DNA, 21 bp, synthetic construct
  misc_feature 1..21: note = Description of Artificial Sequence: Syntheticoligonucleotide
  source 1..21: mol_type = other DNA
gacgactctcgagagtcgtcc

SEQ ID NO: 11824 - DNA, 21 bp, synthetic construct
  misc_feature 1..21: note = Description of Artificial Sequence: Syntheticoligonucleotide
  source 1..21: mol_type = other DNA
ggagactctcgagagtctccc

SEQ ID NO: 11825 - DNA, 21 bp, synthetic construct
  misc_feature 1..21: note = Description of Artificial Sequence: Syntheticoligonucleotide
  source 1..21: mol_type = other DNA
ggcgactctcgagagtcgcca

SEQ ID NO: 11826 - DNA, 21 bp, synthetic construct
  misc_feature 1..21: note = Description of Artificial Sequence: Syntheticoligonucleotide
  source 1..21: mol_type = other DNA
tgcgactctcgagagtcgcac

SEQ ID NO: 11827 - DNA, 21 bp, synthetic construct
  misc_feature 1..21: note = Description of Artificial Sequence: Syntheticoligonucleotide
  source 1..21: mol_type = other DNA
ggtgactctcgagagtcaccc

SEQ ID NO: 11828 - DNA, 21 bp, synthetic construct
  misc_feature 1..21: note = Description of Artificial Sequence: Syntheticoligonucleotide
  source 1..21: mol_type = other DNA
cgggactctcgagagtcccgt

SEQ ID NO: 11829 - DNA, 21 bp, synthetic construct
  misc_feature 1..21: note = Description of Artificial Sequence: Syntheticoligonucleotide
  source 1..21: mol_type = other DNA
agggactctcgagagtccctg

SEQ ID NO: 11830 - DNA, 21 bp, synthetic construct
  misc_feature 1..21: note = Description of Artificial Sequence: Syntheticoligonucleotide
  source 1..21: mol_type = other DNA
caggactctcgagagtcctgg

SEQ ID NO: 11831 - DNA, 21 bp, synthetic construct
  misc_feature 1..21: note = Description of Artificial Sequence: Syntheticoligonucleotide
  source 1..21: mol_type = other DNA
cgagactctcgagagtctcgg

SEQ ID NO: 11832 - DNA, 21 bp, synthetic construct
  misc_feature 1..21: note = Description of Artificial Sequence: Syntheticoligonucleotide
  source 1..21: mol_type = other DNA
cgggactctcgagagtcccga

SEQ ID NO: 11833 - DNA, 21 bp, synthetic construct
  misc_feature 1..21: note = Description of Artificial Sequence: Syntheticoligonucleotide
  source 1..21: mol_type = other DNA
tgggactctcgagagtcccag

SEQ ID NO: 11834 - DNA, 21 bp, synthetic construct
  misc_feature 1..21: note = Description of Artificial Sequence: Syntheticoligonucleotide
  source 1..21: mol_type = other DNA
ctggactctcgagagtccagg

SEQ ID NO: 11835 - DNA, 21 bp, synthetic construct
  misc_feature 1..21: note = Description of Artificial Sequence: Syntheticoligonucleotide
  source 1..21: mol_type = other DNA
cgtgactctcgagagtcacgg

SEQ ID NO: 11836 - DNA, 21 bp, synthetic construct
  misc_feature 1..21: note = Description of Artificial Sequence: Syntheticoligonucleotide
  source 1..21: mol_type = other DNA
ggcgactctcgagagtcgccg

SEQ ID NO: 11837 - DNA, 21 bp, synthetic construct
  misc_feature 1..21: note = Description of Artificial Sequence: Syntheticoligonucleotide
  source 1..21: mol_type = other DNA
agcgactctcgagagtcgctg

SEQ ID NO: 11838 - DNA, 21 bp, synthetic construct
  misc_feature 1..21: note = Description of Artificial Sequence: Syntheticoligonucleotide
  source 1..21: mol_type = other DNA
gacgactctcgagagtcgtcg

SEQ ID NO: 11839 - DNA, 21 bp, synthetic construct
  misc_feature 1..21: note = Description of Artificial Sequence: Syntheticoligonucleotide
  source 1..21: mol_type = other DNA
ggagactctcgagagtctccg

SEQ ID NO: 11840 - DNA, 21 bp, synthetic construct
  misc_feature 1..21: note = Description of Artificial Sequence: Syntheticoligonucleotide
  source 1..21: mol_type = other DNA
tgcgactctcgagagtcgcag

SEQ ID NO: 11841 - DNA, 21 bp, synthetic construct
  misc_feature 1..21: note = Description of Artificial Sequence: Syntheticoligonucleotide
  source 1..21: mol_type = other DNA
ggtgactctcgagagtcaccg

SEQ ID NO: 11842 - DNA, 21 bp, synthetic construct
  misc_feature 1..21: note = Description of Artificial Sequence: Syntheticoligonucleotide
  source 1..21: mol_type = other DNA
acggactctcgagagtccgtg

SEQ ID NO: 11843 - DNA, 21 bp, synthetic construct
  misc_feature 1..21: note = Description of Artificial Sequence: Syntheticoligonucleotide
  source 1..21: mol_type = other DNA
ccagactctcgagagtctggg

SEQ ID NO: 11844 - DNA, 21 bp, synthetic construct
  misc_feature 1..21: note = Description of Artificial Sequence: Syntheticoligonucleotide
  source 1..21: mol_type = other DNA
tcggactctcgagagtccgag

SEQ ID NO: 11845 - DNA, 21 bp, synthetic construct
  misc_feature 1..21: note = Description of Artificial Sequence: Syntheticoligonucleotide
  source 1..21: mol_type = other DNA
cctgactctcgagagtcaggg

SEQ ID NO: 11846 - DNA, 21 bp, synthetic construct
  misc_feature 1..21: note = Description of Artificial Sequence: Syntheticoligonucleotide
  source 1..21: mol_type = other DNA
cacgactctcgagagtcgtgg

SEQ ID NO: 11847 - DNA, 21 bp, synthetic construct
  misc_feature 1..21: note = Description of Artificial Sequence: Syntheticoligonucleotide
  source 1..21: mol_type = other DNA
gccgactctcgagagtcggct

SEQ ID NO: 11848 - DNA, 21 bp, synthetic construct
  misc_feature 1..21: note = Description of Artificial Sequence: Syntheticoligonucleotide
  source 1..21: mol_type = other DNA
gccgactctcgagagtcggca

SEQ ID NO: 11849 - DNA, 21 bp, synthetic construct
  misc_feature 1..21: note = Description of Artificial Sequence: Syntheticoligonucleotide
  source 1..21: mol_type = other DNA
cgagactctcgagagtctcgc

SEQ ID NO: 11850 - DNA, 21 bp, synthetic construct
  misc_feature 1..21: note = Description of Artificial Sequence: Syntheticoligonucleotide
  source 1..21: mol_type = other DNA
cgtgactctcgagagtcacgc

SEQ ID NO: 11851 - DNA, 21 bp, synthetic construct
  misc_feature 1..21: note = Description of Artificial Sequence: Syntheticoligonucleotide
  source 1..21: mol_type = other DNA
caggactctcgagagtcctgc

SEQ ID NO: 11852 - DNA, 21 bp, synthetic construct
  misc_feature 1..21: note = Description of Artificial Sequence: Syntheticoligonucleotide
  source 1..21: mol_type = other DNA
ctggactctcgagagtccagc

SEQ ID NO: 11853 - DNA, 21 bp, synthetic construct
  misc_feature 1..21: note = Description of Artificial Sequence: Syntheticoligonucleotide
  source 1..21: mol_type = other DNA
gaggactctcgagagtcctcg

SEQ ID NO: 11854 - DNA, 21 bp, synthetic construct
  misc_feature 1..21: note = Description of Artificial Sequence: Syntheticoligonucleotide
  source 1..21: mol_type = other DNA
gtggactctcgagagtccacg

SEQ ID NO: 11855 - DNA, 21 bp, synthetic construct
  misc_feature 1..21: note = Description of Artificial Sequence: Syntheticoligonucleotide
  source 1..21: mol_type = other DNA
accgactctcgagagtcggtg

SEQ ID NO: 11856 - DNA, 21 bp, synthetic construct
  misc_feature 1..21: note = Description of Artificial Sequence: Syntheticoligonucleotide
  source 1..21: mol_type = other DNA
tccgactctcgagagtcggag

SEQ ID NO: 11857 - DNA, 21 bp, synthetic construct
  misc_feature 1..21: note = Description of Artificial Sequence: Syntheticoligonucleotide
  source 1..21: mol_type = other DNA
cgggactctcgagagtcccgc

SEQ ID NO: 11858 - DNA, 21 bp, synthetic construct
  misc_feature 1..21: note = Description of Artificial Sequence: Syntheticoligonucleotide
  source 1..21: mol_type = other DNA
agggactctcgagagtccctc

SEQ ID NO: 11859 - DNA, 21 bp, synthetic construct
  misc_feature 1..21: note = Description of Artificial Sequence: Syntheticoligonucleotide
  source 1..21: mol_type = other DNA
tgggactctcgagagtcccac

SEQ ID NO: 11860 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactcagctgagtcnnnn

SEQ ID NO: 11861 - DNA, 21 bp, synthetic construct
  misc_feature 1..21: note = Description of Artificial Sequence: Syntheticoligonucleotide
  source 1..21: mol_type = other DNA
gcggactcagctgagtccgcc

SEQ ID NO: 11862 - DNA, 21 bp, synthetic construct
  misc_feature 1..21: note = Description of Artificial Sequence: Syntheticoligonucleotide
  source 1..21: mol_type = other DNA
gcggactcagctgagtccgct

SEQ ID NO: 11863 - DNA, 21 bp, synthetic construct
  misc_feature 1..21: note = Description of Artificial Sequence: Syntheticoligonucleotide
  source 1..21: mol_type = other DNA
acggactcagctgagtccgtc

SEQ ID NO: 11864 - DNA, 21 bp, synthetic construct
  misc_feature 1..21: note = Description of Artificial Sequence: Syntheticoligonucleotide
  source 1..21: mol_type = other DNA
gaggactcagctgagtcctcc

SEQ ID NO: 11865 - DNA, 21 bp, synthetic construct
  misc_feature 1..21: note = Description of Artificial Sequence: Syntheticoligonucleotide
  source 1..21: mol_type = other DNA
gcagactcagctgagtctgcc

SEQ ID NO: 11866 - DNA, 21 bp, synthetic construct
  misc_feature 1..21: note = Description of Artificial Sequence: Syntheticoligonucleotide
  source 1..21: mol_type = other DNA
gcggactcagctgagtccgca

SEQ ID NO: 11867 - DNA, 21 bp, synthetic construct
  misc_feature 1..21: note = Description of Artificial Sequence: Syntheticoligonucleotide
  source 1..21: mol_type = other DNA
tcggactcagctgagtccgac

SEQ ID NO: 11868 - DNA, 21 bp, synthetic construct
  misc_feature 1..21: note = Description of Artificial Sequence: Syntheticoligonucleotide
  source 1..21: mol_type = other DNA
gtggactcagctgagtccacc

SEQ ID NO: 11869 - DNA, 21 bp, synthetic construct
  misc_feature 1..21: note = Description of Artificial Sequence: Syntheticoligonucleotide
  source 1..21: mol_type = other DNA
gctgactcagctgagtcagcc

SEQ ID NO: 11870 - DNA, 21 bp, synthetic construct
  misc_feature 1..21: note = Description of Artificial Sequence: Syntheticoligonucleotide
  source 1..21: mol_type = other DNA
cccgactcagctgagtcgggc

SEQ ID NO: 11871 - DNA, 21 bp, synthetic construct
  misc_feature 1..21: note = Description of Artificial Sequence: Syntheticoligonucleotide
  source 1..21: mol_type = other DNA
cccgactcagctgagtcgggt

SEQ ID NO: 11872 - DNA, 21 bp, synthetic construct
  misc_feature 1..21: note = Description of Artificial Sequence: Syntheticoligonucleotide
  source 1..21: mol_type = other DNA
accgactcagctgagtcggtc

SEQ ID NO: 11873 - DNA, 21 bp, synthetic construct
  misc_feature 1..21: note = Description of Artificial Sequence: Syntheticoligonucleotide
  source 1..21: mol_type = other DNA
cacgactcagctgagtcgtgc

SEQ ID NO: 11874 - DNA, 21 bp, synthetic construct
  misc_feature 1..21: note = Description of Artificial Sequence: Syntheticoligonucleotide
  source 1..21: mol_type = other DNA
ccagactcagctgagtctggc

SEQ ID NO: 11875 - DNA, 21 bp, synthetic construct
  misc_feature 1..21: note = Description of Artificial Sequence: Syntheticoligonucleotide
  source 1..21: mol_type = other DNA
cccgactcagctgagtcggga

SEQ ID NO: 11876 - DNA, 21 bp, synthetic construct
  misc_feature 1..21: note = Description of Artificial Sequence: Syntheticoligonucleotide
  source 1..21: mol_type = other DNA
tccgactcagctgagtcggac

SEQ ID NO: 11877 - DNA, 21 bp, synthetic construct
  misc_feature 1..21: note = Description of Artificial Sequence: Syntheticoligonucleotide
  source 1..21: mol_type = other DNA
cctgactcagctgagtcaggc

SEQ ID NO: 11878 - DNA, 21 bp, synthetic construct
  misc_feature 1..21: note = Description of Artificial Sequence: Syntheticoligonucleotide
  source 1..21: mol_type = other DNA
ggcgactcagctgagtcgccc

SEQ ID NO: 11879 - DNA, 21 bp, synthetic construct
  misc_feature 1..21: note = Description of Artificial Sequence: Syntheticoligonucleotide
  source 1..21: mol_type = other DNA
ggcgactcagctgagtcgcct

SEQ ID NO: 11880 - DNA, 21 bp, synthetic construct
  misc_feature 1..21: note = Description of Artificial Sequence: Syntheticoligonucleotide
  source 1..21: mol_type = other DNA
agcgactcagctgagtcgctc

SEQ ID NO: 11881 - DNA, 21 bp, synthetic construct
  misc_feature 1..21: note = Description of Artificial Sequence: Syntheticoligonucleotide
  source 1..21: mol_type = other DNA
gacgactcagctgagtcgtcc

SEQ ID NO: 11882 - DNA, 21 bp, synthetic construct
  misc_feature 1..21: note = Description of Artificial Sequence: Syntheticoligonucleotide
  source 1..21: mol_type = other DNA
ggagactcagctgagtctccc

SEQ ID NO: 11883 - DNA, 21 bp, synthetic construct
  misc_feature 1..21: note = Description of Artificial Sequence: Syntheticoligonucleotide
  source 1..21: mol_type = other DNA
ggcgactcagctgagtcgcca

SEQ ID NO: 11884 - DNA, 21 bp, synthetic construct
  misc_feature 1..21: note = Description of Artificial Sequence: Syntheticoligonucleotide
  source 1..21: mol_type = other DNA
tgcgactcagctgagtcgcac

SEQ ID NO: 11885 - DNA, 21 bp, synthetic construct
  misc_feature 1..21: note = Description of Artificial Sequence: Syntheticoligonucleotide
  source 1..21: mol_type = other DNA
ggtgactcagctgagtcaccc

SEQ ID NO: 11886 - DNA, 21 bp, synthetic construct
  misc_feature 1..21: note = Description of Artificial Sequence: Syntheticoligonucleotide
  source 1..21: mol_type = other DNA
cgggactcagctgagtcccgt

SEQ ID NO: 11887 - DNA, 21 bp, synthetic construct
  misc_feature 1..21: note = Description of Artificial Sequence: Syntheticoligonucleotide
  source 1..21: mol_type = other DNA
agggactcagctgagtccctg

SEQ ID NO: 11888 - DNA, 21 bp, synthetic construct
  misc_feature 1..21: note = Description of Artificial Sequence: Syntheticoligonucleotide
  source 1..21: mol_type = other DNA
caggactcagctgagtcctgg

SEQ ID NO: 11889 - DNA, 21 bp, synthetic construct
  misc_feature 1..21: note = Description of Artificial Sequence: Syntheticoligonucleotide
  source 1..21: mol_type = other DNA
cgagactcagctgagtctcgg

SEQ ID NO: 11890 - DNA, 21 bp, synthetic construct
  misc_feature 1..21: note = Description of Artificial Sequence: Syntheticoligonucleotide
  source 1..21: mol_type = other DNA
cgggactcagctgagtcccga

SEQ ID NO: 11891 - DNA, 21 bp, synthetic construct
  misc_feature 1..21: note = Description of Artificial Sequence: Syntheticoligonucleotide
  source 1..21: mol_type = other DNA
tgggactcagctgagtcccag

SEQ ID NO: 11892 - DNA, 21 bp, synthetic construct
  misc_feature 1..21: note = Description of Artificial Sequence: Syntheticoligonucleotide
  source 1..21: mol_type = other DNA
ctggactcagctgagtccagg

SEQ ID NO: 11893 - DNA, 21 bp, synthetic construct
  misc_feature 1..21: note = Description of Artificial Sequence: Syntheticoligonucleotide
  source 1..21: mol_type = other DNA
cgtgactcagctgagtcacgg

SEQ ID NO: 11894 - DNA, 21 bp, synthetic construct
  misc_feature 1..21: note = Description of Artificial Sequence: Syntheticoligonucleotide
  source 1..21: mol_type = other DNA
ggcgactcagctgagtcgccg

SEQ ID NO: 11895 - DNA, 21 bp, synthetic construct
  misc_feature 1..21: note = Description of Artificial Sequence: Syntheticoligonucleotide
  source 1..21: mol_type = other DNA
agcgactcagctgagtcgctg

SEQ ID NO: 11896 - DNA, 21 bp, synthetic construct
  misc_feature 1..21: note = Description of Artificial Sequence: Syntheticoligonucleotide
  source 1..21: mol_type = other DNA
gacgactcagctgagtcgtcg

SEQ ID NO: 11897 - DNA, 21 bp, synthetic construct
  misc_feature 1..21: note = Description of Artificial Sequence: Syntheticoligonucleotide
  source 1..21: mol_type = other DNA
ggagactcagctgagtctccg

SEQ ID NO: 11898 - DNA, 21 bp, synthetic construct
  misc_feature 1..21: note = Description of Artificial Sequence: Syntheticoligonucleotide
  source 1..21: mol_type = other DNA
tgcgactcagctgagtcgcag

SEQ ID NO: 11899 - DNA, 21 bp, synthetic construct
  misc_feature 1..21: note = Description of Artificial Sequence: Syntheticoligonucleotide
  source 1..21: mol_type = other DNA
ggtgactcagctgagtcaccg

SEQ ID NO: 11900 - DNA, 21 bp, synthetic construct
  misc_feature 1..21: note = Description of Artificial Sequence: Syntheticoligonucleotide
  source 1..21: mol_type = other DNA
acggactcagctgagtccgtg

SEQ ID NO: 11901 - DNA, 21 bp, synthetic construct
  misc_feature 1..21: note = Description of Artificial Sequence: Syntheticoligonucleotide
  source 1..21: mol_type = other DNA
ccagactcagctgagtctggg

SEQ ID NO: 11902 - DNA, 21 bp, synthetic construct
  misc_feature 1..21: note = Description of Artificial Sequence: Syntheticoligonucleotide
  source 1..21: mol_type = other DNA
tcggactcagctgagtccgag

SEQ ID NO: 11903 - DNA, 21 bp, synthetic construct
  misc_feature 1..21: note = Description of Artificial Sequence: Syntheticoligonucleotide
  source 1..21: mol_type = other DNA
cctgactcagctgagtcaggg

SEQ ID NO: 11904 - DNA, 21 bp, synthetic construct
  misc_feature 1..21: note = Description of Artificial Sequence: Syntheticoligonucleotide
  source 1..21: mol_type = other DNA
cacgactcagctgagtcgtgg

SEQ ID NO: 11905 - DNA, 21 bp, synthetic construct
  misc_feature 1..21: note = Description of Artificial Sequence: Syntheticoligonucleotide
  source 1..21: mol_type = other DNA
gccgactcagctgagtcggct

SEQ ID NO: 11906 - DNA, 21 bp, synthetic construct
  misc_feature 1..21: note = Description of Artificial Sequence: Syntheticoligonucleotide
  source 1..21: mol_type = other DNA
gccgactcagctgagtcggca

SEQ ID NO: 11907 - DNA, 21 bp, synthetic construct
  misc_feature 1..21: note = Description of Artificial Sequence: Syntheticoligonucleotide
  source 1..21: mol_type = other DNA
cgagactcagctgagtctcgc

SEQ ID NO: 11908 - DNA, 21 bp, synthetic construct
  misc_feature 1..21: note = Description of Artificial Sequence: Syntheticoligonucleotide
  source 1..21: mol_type = other DNA
cgtgactcagctgagtcacgc

SEQ ID NO: 11909 - DNA, 21 bp, synthetic construct
  misc_feature 1..21: note = Description of Artificial Sequence: Syntheticoligonucleotide
  source 1..21: mol_type = other DNA
caggactcagctgagtcctgc

SEQ ID NO: 11910 - DNA, 21 bp, synthetic construct
  misc_feature 1..21: note = Description of Artificial Sequence: Syntheticoligonucleotide
  source 1..21: mol_type = other DNA
ctggactcagctgagtccagc

SEQ ID NO: 11911 - DNA, 21 bp, synthetic construct
  misc_feature 1..21: note = Description of Artificial Sequence: Syntheticoligonucleotide
  source 1..21: mol_type = other DNA
gaggactcagctgagtcctcg

SEQ ID NO: 11912 - DNA, 21 bp, synthetic construct
  misc_feature 1..21: note = Description of Artificial Sequence: Syntheticoligonucleotide
  source 1..21: mol_type = other DNA
gtggactcagctgagtccacg

SEQ ID NO: 11913 - DNA, 21 bp, synthetic construct
  misc_feature 1..21: note = Description of Artificial Sequence: Syntheticoligonucleotide
  source 1..21: mol_type = other DNA
accgactcagctgagtcggtg

SEQ ID NO: 11914 - DNA, 21 bp, synthetic construct
  misc_feature 1..21: note = Description of Artificial Sequence: Syntheticoligonucleotide
  source 1..21: mol_type = other DNA
tccgactcagctgagtcggag

SEQ ID NO: 11915 - DNA, 21 bp, synthetic construct
  misc_feature 1..21: note = Description of Artificial Sequence: Syntheticoligonucleotide
  source 1..21: mol_type = other DNA
cgggactcagctgagtcccgc

SEQ ID NO: 11916 - DNA, 21 bp, synthetic construct
  misc_feature 1..21: note = Description of Artificial Sequence: Syntheticoligonucleotide
  source 1..21: mol_type = other DNA
agggactcagctgagtccctc

SEQ ID NO: 11917 - DNA, 21 bp, synthetic construct
  misc_feature 1..21: note = Description of Artificial Sequence: Syntheticoligonucleotide
  source 1..21: mol_type = other DNA
tgggactcagctgagtcccac

SEQ ID NO: 11918 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactcaattgagtcnnnn

SEQ ID NO: 11919 - DNA, 21 bp, synthetic construct
  misc_feature 1..21: note = Description of Artificial Sequence: Syntheticoligonucleotide
  source 1..21: mol_type = other DNA
gcggactcaattgagtccgcc

SEQ ID NO: 11920 - DNA, 21 bp, synthetic construct
  misc_feature 1..21: note = Description of Artificial Sequence: Syntheticoligonucleotide
  source 1..21: mol_type = other DNA
gcggactcaattgagtccgct

SEQ ID NO: 11921 - DNA, 21 bp, synthetic construct
  misc_feature 1..21: note = Description of Artificial Sequence: Syntheticoligonucleotide
  source 1..21: mol_type = other DNA
acggactcaattgagtccgtc

SEQ ID NO: 11922 - DNA, 21 bp, synthetic construct
  misc_feature 1..21: note = Description of Artificial Sequence: Syntheticoligonucleotide
  source 1..21: mol_type = other DNA
gaggactcaattgagtcctcc

SEQ ID NO: 11923 - DNA, 21 bp, synthetic construct
  misc_feature 1..21: note = Description of Artificial Sequence: Syntheticoligonucleotide
  source 1..21: mol_type = other DNA
gcagactcaattgagtctgcc

SEQ ID NO: 11924 - DNA, 21 bp, synthetic construct
  misc_feature 1..21: note = Description of Artificial Sequence: Syntheticoligonucleotide
  source 1..21: mol_type = other DNA
gcggactcaattgagtccgca

SEQ ID NO: 11925 - DNA, 21 bp, synthetic construct
  misc_feature 1..21: note = Description of Artificial Sequence: Syntheticoligonucleotide
  source 1..21: mol_type = other DNA
tcggactcaattgagtccgac

SEQ ID NO: 11926 - DNA, 21 bp, synthetic construct
  misc_feature 1..21: note = Description of Artificial Sequence: Syntheticoligonucleotide
  source 1..21: mol_type = other DNA
gtggactcaattgagtccacc

SEQ ID NO: 11927 - DNA, 21 bp, synthetic construct
  misc_feature 1..21: note = Description of Artificial Sequence: Syntheticoligonucleotide
  source 1..21: mol_type = other DNA
gctgactcaattgagtcagcc

SEQ ID NO: 11928 - DNA, 21 bp, synthetic construct
  misc_feature 1..21: note = Description of Artificial Sequence: Syntheticoligonucleotide
  source 1..21: mol_type = other DNA
cccgactcaattgagtcgggc

SEQ ID NO: 11929 - DNA, 21 bp, synthetic construct
  misc_feature 1..21: note = Description of Artificial Sequence: Syntheticoligonucleotide
  source 1..21: mol_type = other DNA
cccgactcaattgagtcgggt

SEQ ID NO: 11930 - DNA, 21 bp, synthetic construct
  misc_feature 1..21: note = Description of Artificial Sequence: Syntheticoligonucleotide
  source 1..21: mol_type = other DNA
accgactcaattgagtcggtc

SEQ ID NO: 11931 - DNA, 21 bp, synthetic construct
  misc_feature 1..21: note = Description of Artificial Sequence: Syntheticoligonucleotide
  source 1..21: mol_type = other DNA
cacgactcaattgagtcgtgc

SEQ ID NO: 11932 - DNA, 21 bp, synthetic construct
  misc_feature 1..21: note = Description of Artificial Sequence: Syntheticoligonucleotide
  source 1..21: mol_type = other DNA
ccagactcaattgagtctggc

SEQ ID NO: 11933 - DNA, 21 bp, synthetic construct
  misc_feature 1..21: note = Description of Artificial Sequence: Syntheticoligonucleotide
  source 1..21: mol_type = other DNA
cccgactcaattgagtcggga

SEQ ID NO: 11934 - DNA, 21 bp, synthetic construct
  misc_feature 1..21: note = Description of Artificial Sequence: Syntheticoligonucleotide
  source 1..21: mol_type = other DNA
tccgactcaattgagtcggac

SEQ ID NO: 11935 - DNA, 21 bp, synthetic construct
  misc_feature 1..21: note = Description of Artificial Sequence: Syntheticoligonucleotide
  source 1..21: mol_type = other DNA
cctgactcaattgagtcaggc

SEQ ID NO: 11936 - DNA, 21 bp, synthetic construct
  misc_feature 1..21: note = Description of Artificial Sequence: Syntheticoligonucleotide
  source 1..21: mol_type = other DNA
ggcgactcaattgagtcgccc

SEQ ID NO: 11937 - DNA, 21 bp, synthetic construct
  misc_feature 1..21: note = Description of Artificial Sequence: Syntheticoligonucleotide
  source 1..21: mol_type = other DNA
ggcgactcaattgagtcgcct

SEQ ID NO: 11938 - DNA, 21 bp, synthetic construct
  misc_feature 1..21: note = Description of Artificial Sequence: Syntheticoligonucleotide
  source 1..21: mol_type = other DNA
agcgactcaattgagtcgctc

SEQ ID NO: 11939 - DNA, 21 bp, synthetic construct
  misc_feature 1..21: note = Description of Artificial Sequence: Syntheticoligonucleotide
  source 1..21: mol_type = other DNA
gacgactcaattgagtcgtcc

SEQ ID NO: 11940 - DNA, 21 bp, synthetic construct
  misc_feature 1..21: note = Description of Artificial Sequence: Syntheticoligonucleotide
  source 1..21: mol_type = other DNA
ggagactcaattgagtctccc

SEQ ID NO: 11941 - DNA, 21 bp, synthetic construct
  misc_feature 1..21: note = Description of Artificial Sequence: Syntheticoligonucleotide
  source 1..21: mol_type = other DNA
ggcgactcaattgagtcgcca

SEQ ID NO: 11942 - DNA, 21 bp, synthetic construct
  misc_feature 1..21: note = Description of Artificial Sequence: Syntheticoligonucleotide
  source 1..21: mol_type = other DNA
tgcgactcaattgagtcgcac

SEQ ID NO: 11943 - DNA, 21 bp, synthetic construct
  misc_feature 1..21: note = Description of Artificial Sequence: Syntheticoligonucleotide
  source 1..21: mol_type = other DNA
ggtgactcaattgagtcaccc

SEQ ID NO: 11944 - DNA, 21 bp, synthetic construct
  misc_feature 1..21: note = Description of Artificial Sequence: Syntheticoligonucleotide
  source 1..21: mol_type = other DNA
cgggactcaattgagtcccgt

SEQ ID NO: 11945 - DNA, 21 bp, synthetic construct
  misc_feature 1..21: note = Description of Artificial Sequence: Syntheticoligonucleotide
  source 1..21: mol_type = other DNA
agggactcaattgagtccctg

SEQ ID NO: 11946 - DNA, 21 bp, synthetic construct
  misc_feature 1..21: note = Description of Artificial Sequence: Syntheticoligonucleotide
  source 1..21: mol_type = other DNA
caggactcaattgagtcctgg

SEQ ID NO: 11947 - DNA, 21 bp, synthetic construct
  misc_feature 1..21: note = Description of Artificial Sequence: Syntheticoligonucleotide
  source 1..21: mol_type = other DNA
cgagactcaattgagtctcgg

SEQ ID NO: 11948 - DNA, 21 bp, synthetic construct
  misc_feature 1..21: note = Description of Artificial Sequence: Syntheticoligonucleotide
  source 1..21: mol_type = other DNA
cgggactcaattgagtcccga

SEQ ID NO: 11949 - DNA, 21 bp, synthetic construct
  misc_feature 1..21: note = Description of Artificial Sequence: Syntheticoligonucleotide
  source 1..21: mol_type = other DNA
tgggactcaattgagtcccag

SEQ ID NO: 11950 - DNA, 21 bp, synthetic construct
  misc_feature 1..21: note = Description of Artificial Sequence: Syntheticoligonucleotide
  source 1..21: mol_type = other DNA
ctggactcaattgagtccagg

SEQ ID NO: 11951 - DNA, 21 bp, synthetic construct
  misc_feature 1..21: note = Description of Artificial Sequence: Syntheticoligonucleotide
  source 1..21: mol_type = other DNA
cgtgactcaattgagtcacgg

SEQ ID NO: 11952 - DNA, 21 bp, synthetic construct
  misc_feature 1..21: note = Description of Artificial Sequence: Syntheticoligonucleotide
  source 1..21: mol_type = other DNA
ggcgactcaattgagtcgccg

SEQ ID NO: 11953 - DNA, 21 bp, synthetic construct
  misc_feature 1..21: note = Description of Artificial Sequence: Syntheticoligonucleotide
  source 1..21: mol_type = other DNA
agcgactcaattgagtcgctg

SEQ ID NO: 11954 - DNA, 21 bp, synthetic construct
  misc_feature 1..21: note = Description of Artificial Sequence: Syntheticoligonucleotide
  source 1..21: mol_type = other DNA
gacgactcaattgagtcgtcg

SEQ ID NO: 11955 - DNA, 21 bp, synthetic construct
  misc_feature 1..21: note = Description of Artificial Sequence: Syntheticoligonucleotide
  source 1..21: mol_type = other DNA
ggagactcaattgagtctccg

SEQ ID NO: 11956 - DNA, 21 bp, synthetic construct
  misc_feature 1..21: note = Description of Artificial Sequence: Syntheticoligonucleotide
  source 1..21: mol_type = other DNA
tgcgactcaattgagtcgcag

SEQ ID NO: 11957 - DNA, 21 bp, synthetic construct
  misc_feature 1..21: note = Description of Artificial Sequence: Syntheticoligonucleotide
  source 1..21: mol_type = other DNA
ggtgactcaattgagtcaccg

SEQ ID NO: 11958 - DNA, 21 bp, synthetic construct
  misc_feature 1..21: note = Description of Artificial Sequence: Syntheticoligonucleotide
  source 1..21: mol_type = other DNA
acggactcaattgagtccgtg

SEQ ID NO: 11959 - DNA, 21 bp, synthetic construct
  misc_feature 1..21: note = Description of Artificial Sequence: Syntheticoligonucleotide
  source 1..21: mol_type = other DNA
ccagactcaattgagtctggg

SEQ ID NO: 11960 - DNA, 21 bp, synthetic construct
  misc_feature 1..21: note = Description of Artificial Sequence: Syntheticoligonucleotide
  source 1..21: mol_type = other DNA
tcggactcaattgagtccgag

SEQ ID NO: 11961 - DNA, 21 bp, synthetic construct
  misc_feature 1..21: note = Description of Artificial Sequence: Syntheticoligonucleotide
  source 1..21: mol_type = other DNA
cctgactcaattgagtcaggg

SEQ ID NO: 11962 - DNA, 21 bp, synthetic construct
  misc_feature 1..21: note = Description of Artificial Sequence: Syntheticoligonucleotide
  source 1..21: mol_type = other DNA
cacgactcaattgagtcgtgg

SEQ ID NO: 11963 - DNA, 21 bp, synthetic construct
  misc_feature 1..21: note = Description of Artificial Sequence: Syntheticoligonucleotide
  source 1..21: mol_type = other DNA
gccgactcaattgagtcggct

SEQ ID NO: 11964 - DNA, 21 bp, synthetic construct
  misc_feature 1..21: note = Description of Artificial Sequence: Syntheticoligonucleotide
  source 1..21: mol_type = other DNA
gccgactcaattgagtcggca

SEQ ID NO: 11965 - DNA, 21 bp, synthetic construct
  misc_feature 1..21: note = Description of Artificial Sequence: Syntheticoligonucleotide
  source 1..21: mol_type = other DNA
cgagactcaattgagtctcgc

SEQ ID NO: 11966 - DNA, 21 bp, synthetic construct
  misc_feature 1..21: note = Description of Artificial Sequence: Syntheticoligonucleotide
  source 1..21: mol_type = other DNA
cgtgactcaattgagtcacgc

SEQ ID NO: 11967 - DNA, 21 bp, synthetic construct
  misc_feature 1..21: note = Description of Artificial Sequence: Syntheticoligonucleotide
  source 1..21: mol_type = other DNA
caggactcaattgagtcctgc

SEQ ID NO: 11968 - DNA, 21 bp, synthetic construct
  misc_feature 1..21: note = Description of Artificial Sequence: Syntheticoligonucleotide
  source 1..21: mol_type = other DNA
ctggactcaattgagtccagc

SEQ ID NO: 11969 - DNA, 21 bp, synthetic construct
  misc_feature 1..21: note = Description of Artificial Sequence: Syntheticoligonucleotide
  source 1..21: mol_type = other DNA
gaggactcaattgagtcctcg

SEQ ID NO: 11970 - DNA, 21 bp, synthetic construct
  misc_feature 1..21: note = Description of Artificial Sequence: Syntheticoligonucleotide
  source 1..21: mol_type = other DNA
gtggactcaattgagtccacg

SEQ ID NO: 11971 - DNA, 21 bp, synthetic construct
  misc_feature 1..21: note = Description of Artificial Sequence: Syntheticoligonucleotide
  source 1..21: mol_type = other DNA
accgactcaattgagtcggtg

SEQ ID NO: 11972 - DNA, 21 bp, synthetic construct
  misc_feature 1..21: note = Description of Artificial Sequence: Syntheticoligonucleotide
  source 1..21: mol_type = other DNA
tccgactcaattgagtcggag

SEQ ID NO: 11973 - DNA, 21 bp, synthetic construct
  misc_feature 1..21: note = Description of Artificial Sequence: Syntheticoligonucleotide
  source 1..21: mol_type = other DNA
cgggactcaattgagtcccgc

SEQ ID NO: 11974 - DNA, 21 bp, synthetic construct
  misc_feature 1..21: note = Description of Artificial Sequence: Syntheticoligonucleotide
  source 1..21: mol_type = other DNA
agggactcaattgagtccctc

SEQ ID NO: 11975 - DNA, 21 bp, synthetic construct
  misc_feature 1..21: note = Description of Artificial Sequence: Syntheticoligonucleotide
  source 1..21: mol_type = other DNA
tgggactcaattgagtcccac

SEQ ID NO: 11976 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactctatagagtcnnnn

SEQ ID NO: 11977 - DNA, 21 bp, synthetic construct
  misc_feature 1..21: note = Description of Artificial Sequence: Syntheticoligonucleotide
  source 1..21: mol_type = other DNA
gcggactctatagagtccgcc

SEQ ID NO: 11978 - DNA, 21 bp, synthetic construct
  misc_feature 1..21: note = Description of Artificial Sequence: Syntheticoligonucleotide
  source 1..21: mol_type = other DNA
gcggactctatagagtccgct

SEQ ID NO: 11979 - DNA, 21 bp, synthetic construct
  misc_feature 1..21: note = Description of Artificial Sequence: Syntheticoligonucleotide
  source 1..21: mol_type = other DNA
acggactctatagagtccgtc

SEQ ID NO: 11980 - DNA, 21 bp, synthetic construct
  misc_feature 1..21: note = Description of Artificial Sequence: Syntheticoligonucleotide
  source 1..21: mol_type = other DNA
gaggactctatagagtcctcc

SEQ ID NO: 11981 - DNA, 21 bp, synthetic construct
  misc_feature 1..21: note = Description of Artificial Sequence: Syntheticoligonucleotide
  source 1..21: mol_type = other DNA
gcagactctatagagtctgcc

SEQ ID NO: 11982 - DNA, 21 bp, synthetic construct
  misc_feature 1..21: note = Description of Artificial Sequence: Syntheticoligonucleotide
  source 1..21: mol_type = other DNA
gcggactctatagagtccgca

SEQ ID NO: 11983 - DNA, 21 bp, synthetic construct
  misc_feature 1..21: note = Description of Artificial Sequence: Syntheticoligonucleotide
  source 1..21: mol_type = other DNA
tcggactctatagagtccgac

SEQ ID NO: 11984 - DNA, 21 bp, synthetic construct
  misc_feature 1..21: note = Description of Artificial Sequence: Syntheticoligonucleotide
  source 1..21: mol_type = other DNA
gtggactctatagagtccacc

SEQ ID NO: 11985 - DNA, 21 bp, synthetic construct
  misc_feature 1..21: note = Description of Artificial Sequence: Syntheticoligonucleotide
  source 1..21: mol_type = other DNA
gctgactctatagagtcagcc

SEQ ID NO: 11986 - DNA, 21 bp, synthetic construct
  misc_feature 1..21: note = Description of Artificial Sequence: Syntheticoligonucleotide
  source 1..21: mol_type = other DNA
cccgactctatagagtcgggc

SEQ ID NO: 11987 - DNA, 21 bp, synthetic construct
  misc_feature 1..21: note = Description of Artificial Sequence: Syntheticoligonucleotide
  source 1..21: mol_type = other DNA
cccgactctatagagtcgggt

SEQ ID NO: 11988 - DNA, 21 bp, synthetic construct
  misc_feature 1..21: note = Description of Artificial Sequence: Syntheticoligonucleotide
  source 1..21: mol_type = other DNA
accgactctatagagtcggtc

SEQ ID NO: 11989 - DNA, 21 bp, synthetic construct
  misc_feature 1..21: note = Description of Artificial Sequence: Syntheticoligonucleotide
  source 1..21: mol_type = other DNA
cacgactctatagagtcgtgc

SEQ ID NO: 11990 - DNA, 21 bp, synthetic construct
  misc_feature 1..21: note = Description of Artificial Sequence: Syntheticoligonucleotide
  source 1..21: mol_type = other DNA
ccagactctatagagtctggc

SEQ ID NO: 11991 - DNA, 21 bp, synthetic construct
  misc_feature 1..21: note = Description of Artificial Sequence: Syntheticoligonucleotide
  source 1..21: mol_type = other DNA
cccgactctatagagtcggga

SEQ ID NO: 11992 - DNA, 21 bp, synthetic construct
  misc_feature 1..21: note = Description of Artificial Sequence: Syntheticoligonucleotide
  source 1..21: mol_type = other DNA
tccgactctatagagtcggac

SEQ ID NO: 11993 - DNA, 21 bp, synthetic construct
  misc_feature 1..21: note = Description of Artificial Sequence: Syntheticoligonucleotide
  source 1..21: mol_type = other DNA
cctgactctatagagtcaggc

SEQ ID NO: 11994 - DNA, 21 bp, synthetic construct
  misc_feature 1..21: note = Description of Artificial Sequence: Syntheticoligonucleotide
  source 1..21: mol_type = other DNA
ggcgactctatagagtcgccc

SEQ ID NO: 11995 - DNA, 21 bp, synthetic construct
  misc_feature 1..21: note = Description of Artificial Sequence: Syntheticoligonucleotide
  source 1..21: mol_type = other DNA
ggcgactctatagagtcgcct

SEQ ID NO: 11996 - DNA, 21 bp, synthetic construct
  misc_feature 1..21: note = Description of Artificial Sequence: Syntheticoligonucleotide
  source 1..21: mol_type = other DNA
agcgactctatagagtcgctc

SEQ ID NO: 11997 - DNA, 21 bp, synthetic construct
  misc_feature 1..21: note = Description of Artificial Sequence: Syntheticoligonucleotide
  source 1..21: mol_type = other DNA
gacgactctatagagtcgtcc

SEQ ID NO: 11998 - DNA, 21 bp, synthetic construct
  misc_feature 1..21: note = Description of Artificial Sequence: Syntheticoligonucleotide
  source 1..21: mol_type = other DNA
ggagactctatagagtctccc

SEQ ID NO: 11999 - DNA, 21 bp, synthetic construct
  misc_feature 1..21: note = Description of Artificial Sequence: Syntheticoligonucleotide
  source 1..21: mol_type = other DNA
ggcgactctatagagtcgcca

SEQ ID NO: 12000 - DNA, 21 bp, synthetic construct
  misc_feature 1..21: note = Description of Artificial Sequence: Syntheticoligonucleotide
  source 1..21: mol_type = other DNA
tgcgactctatagagtcgcac

SEQ ID NO: 12001 - DNA, 21 bp, synthetic construct
  misc_feature 1..21: note = Description of Artificial Sequence: Syntheticoligonucleotide
  source 1..21: mol_type = other DNA
ggtgactctatagagtcaccc

SEQ ID NO: 12002 - DNA, 21 bp, synthetic construct
  misc_feature 1..21: note = Description of Artificial Sequence: Syntheticoligonucleotide
  source 1..21: mol_type = other DNA
cgggactctatagagtcccgt

SEQ ID NO: 12003 - DNA, 21 bp, synthetic construct
  misc_feature 1..21: note = Description of Artificial Sequence: Syntheticoligonucleotide
  source 1..21: mol_type = other DNA
agggactctatagagtccctg

SEQ ID NO: 12004 - DNA, 21 bp, synthetic construct
  misc_feature 1..21: note = Description of Artificial Sequence: Syntheticoligonucleotide
  source 1..21: mol_type = other DNA
caggactctatagagtcctgg

SEQ ID NO: 12005 - DNA, 21 bp, synthetic construct
  misc_feature 1..21: note = Description of Artificial Sequence: Syntheticoligonucleotide
  source 1..21: mol_type = other DNA
cgagactctatagagtctcgg

SEQ ID NO: 12006 - DNA, 21 bp, synthetic construct
  misc_feature 1..21: note = Description of Artificial Sequence: Syntheticoligonucleotide
  source 1..21: mol_type = other DNA
cgggactctatagagtcccga

SEQ ID NO: 12007 - DNA, 21 bp, synthetic construct
  misc_feature 1..21: note = Description of Artificial Sequence: Syntheticoligonucleotide
  source 1..21: mol_type = other DNA
tgggactctatagagtcccag

SEQ ID NO: 12008 - DNA, 21 bp, synthetic construct
  misc_feature 1..21: note = Description of Artificial Sequence: Syntheticoligonucleotide
  source 1..21: mol_type = other DNA
ctggactctatagagtccagg

SEQ ID NO: 12009 - DNA, 21 bp, synthetic construct
  misc_feature 1..21: note = Description of Artificial Sequence: Syntheticoligonucleotide
  source 1..21: mol_type = other DNA
cgtgactctatagagtcacgg

SEQ ID NO: 12010 - DNA, 21 bp, synthetic construct
  misc_feature 1..21: note = Description of Artificial Sequence: Syntheticoligonucleotide
  source 1..21: mol_type = other DNA
ggcgactctatagagtcgccg

SEQ ID NO: 12011 - DNA, 21 bp, synthetic construct
  misc_feature 1..21: note = Description of Artificial Sequence: Syntheticoligonucleotide
  source 1..21: mol_type = other DNA
agcgactctatagagtcgctg

SEQ ID NO: 12012 - DNA, 21 bp, synthetic construct
  misc_feature 1..21: note = Description of Artificial Sequence: Syntheticoligonucleotide
  source 1..21: mol_type = other DNA
gacgactctatagagtcgtcg

SEQ ID NO: 12013 - DNA, 21 bp, synthetic construct
  misc_feature 1..21: note = Description of Artificial Sequence: Syntheticoligonucleotide
  source 1..21: mol_type = other DNA
ggagactctatagagtctccg

SEQ ID NO: 12014 - DNA, 21 bp, synthetic construct
  misc_feature 1..21: note = Description of Artificial Sequence: Syntheticoligonucleotide
  source 1..21: mol_type = other DNA
tgcgactctatagagtcgcag

SEQ ID NO: 12015 - DNA, 21 bp, synthetic construct
  misc_feature 1..21: note = Description of Artificial Sequence: Syntheticoligonucleotide
  source 1..21: mol_type = other DNA
ggtgactctatagagtcaccg

SEQ ID NO: 12016 - DNA, 21 bp, synthetic construct
  misc_feature 1..21: note = Description of Artificial Sequence: Syntheticoligonucleotide
  source 1..21: mol_type = other DNA
acggactctatagagtccgtg

SEQ ID NO: 12017 - DNA, 21 bp, synthetic construct
  misc_feature 1..21: note = Description of Artificial Sequence: Syntheticoligonucleotide
  source 1..21: mol_type = other DNA
ccagactctatagagtctggg

SEQ ID NO: 12018 - DNA, 21 bp, synthetic construct
  misc_feature 1..21: note = Description of Artificial Sequence: Syntheticoligonucleotide
  source 1..21: mol_type = other DNA
tcggactctatagagtccgag

SEQ ID NO: 12019 - DNA, 21 bp, synthetic construct
  misc_feature 1..21: note = Description of Artificial Sequence: Syntheticoligonucleotide
  source 1..21: mol_type = other DNA
cctgactctatagagtcaggg

SEQ ID NO: 12020 - DNA, 21 bp, synthetic construct
  misc_feature 1..21: note = Description of Artificial Sequence: Syntheticoligonucleotide
  source 1..21: mol_type = other DNA
cacgactctatagagtcgtgg

SEQ ID NO: 12021 - DNA, 21 bp, synthetic construct
  misc_feature 1..21: note = Description of Artificial Sequence: Syntheticoligonucleotide
  source 1..21: mol_type = other DNA
gccgactctatagagtcggct

SEQ ID NO: 12022 - DNA, 21 bp, synthetic construct
  misc_feature 1..21: note = Description of Artificial Sequence: Syntheticoligonucleotide
  source 1..21: mol_type = other DNA
gccgactctatagagtcggca

SEQ ID NO: 12023 - DNA, 21 bp, synthetic construct
  misc_feature 1..21: note = Description of Artificial Sequence: Syntheticoligonucleotide
  source 1..21: mol_type = other DNA
cgagactctatagagtctcgc

SEQ ID NO: 12024 - DNA, 21 bp, synthetic construct
  misc_feature 1..21: note = Description of Artificial Sequence: Syntheticoligonucleotide
  source 1..21: mol_type = other DNA
cgtgactctatagagtcacgc

SEQ ID NO: 12025 - DNA, 21 bp, synthetic construct
  misc_feature 1..21: note = Description of Artificial Sequence: Syntheticoligonucleotide
  source 1..21: mol_type = other DNA
caggactctatagagtcctgc

SEQ ID NO: 12026 - DNA, 21 bp, synthetic construct
  misc_feature 1..21: note = Description of Artificial Sequence: Syntheticoligonucleotide
  source 1..21: mol_type = other DNA
ctggactctatagagtccagc

SEQ ID NO: 12027 - DNA, 21 bp, synthetic construct
  misc_feature 1..21: note = Description of Artificial Sequence: Syntheticoligonucleotide
  source 1..21: mol_type = other DNA
gaggactctatagagtcctcg

SEQ ID NO: 12028 - DNA, 21 bp, synthetic construct
  misc_feature 1..21: note = Description of Artificial Sequence: Syntheticoligonucleotide
  source 1..21: mol_type = other DNA
gtggactctatagagtccacg

SEQ ID NO: 12029 - DNA, 21 bp, synthetic construct
  misc_feature 1..21: note = Description of Artificial Sequence: Syntheticoligonucleotide
  source 1..21: mol_type = other DNA
accgactctatagagtcggtg

SEQ ID NO: 12030 - DNA, 21 bp, synthetic construct
  misc_feature 1..21: note = Description of Artificial Sequence: Syntheticoligonucleotide
  source 1..21: mol_type = other DNA
tccgactctatagagtcggag

SEQ ID NO: 12031 - DNA, 21 bp, synthetic construct
  misc_feature 1..21: note = Description of Artificial Sequence: Syntheticoligonucleotide
  source 1..21: mol_type = other DNA
cgggactctatagagtcccgc

SEQ ID NO: 12032 - DNA, 21 bp, synthetic construct
  misc_feature 1..21: note = Description of Artificial Sequence: Syntheticoligonucleotide
  source 1..21: mol_type = other DNA
agggactctatagagtccctc

SEQ ID NO: 12033 - DNA, 21 bp, synthetic construct
  misc_feature 1..21: note = Description of Artificial Sequence: Syntheticoligonucleotide
  source 1..21: mol_type = other DNA
tgggactctatagagtcccac

SEQ ID NO: 12034 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactcatatgagtcnnnn

SEQ ID NO: 12035 - DNA, 21 bp, synthetic construct
  misc_feature 1..21: note = Description of Artificial Sequence: Syntheticoligonucleotide
  source 1..21: mol_type = other DNA
gcggactcatatgagtccgcc

SEQ ID NO: 12036 - DNA, 21 bp, synthetic construct
  misc_feature 1..21: note = Description of Artificial Sequence: Syntheticoligonucleotide
  source 1..21: mol_type = other DNA
gcggactcatatgagtccgct

SEQ ID NO: 12037 - DNA, 21 bp, synthetic construct
  misc_feature 1..21: note = Description of Artificial Sequence: Syntheticoligonucleotide
  source 1..21: mol_type = other DNA
acggactcatatgagtccgtc

SEQ ID NO: 12038 - DNA, 21 bp, synthetic construct
  misc_feature 1..21: note = Description of Artificial Sequence: Syntheticoligonucleotide
  source 1..21: mol_type = other DNA
gaggactcatatgagtcctcc

SEQ ID NO: 12039 - DNA, 21 bp, synthetic construct
  misc_feature 1..21: note = Description of Artificial Sequence: Syntheticoligonucleotide
  source 1..21: mol_type = other DNA
gcagactcatatgagtctgcc

SEQ ID NO: 12040 - DNA, 21 bp, synthetic construct
  misc_feature 1..21: note = Description of Artificial Sequence: Syntheticoligonucleotide
  source 1..21: mol_type = other DNA
gcggactcatatgagtccgca

SEQ ID NO: 12041 - DNA, 21 bp, synthetic construct
  misc_feature 1..21: note = Description of Artificial Sequence: Syntheticoligonucleotide
  source 1..21: mol_type = other DNA
tcggactcatatgagtccgac

SEQ ID NO: 12042 - DNA, 21 bp, synthetic construct
  misc_feature 1..21: note = Description of Artificial Sequence: Syntheticoligonucleotide
  source 1..21: mol_type = other DNA
gtggactcatatgagtccacc

SEQ ID NO: 12043 - DNA, 21 bp, synthetic construct
  misc_feature 1..21: note = Description of Artificial Sequence: Syntheticoligonucleotide
  source 1..21: mol_type = other DNA
gctgactcatatgagtcagcc

SEQ ID NO: 12044 - DNA, 21 bp, synthetic construct
  misc_feature 1..21: note = Description of Artificial Sequence: Syntheticoligonucleotide
  source 1..21: mol_type = other DNA
cccgactcatatgagtcgggc

SEQ ID NO: 12045 - DNA, 21 bp, synthetic construct
  misc_feature 1..21: note = Description of Artificial Sequence: Syntheticoligonucleotide
  source 1..21: mol_type = other DNA
cccgactcatatgagtcgggt

SEQ ID NO: 12046 - DNA, 21 bp, synthetic construct
  misc_feature 1..21: note = Description of Artificial Sequence: Syntheticoligonucleotide
  source 1..21: mol_type = other DNA
accgactcatatgagtcggtc

SEQ ID NO: 12047 - DNA, 21 bp, synthetic construct
  misc_feature 1..21: note = Description of Artificial Sequence: Syntheticoligonucleotide
  source 1..21: mol_type = other DNA
cacgactcatatgagtcgtgc

SEQ ID NO: 12048 - DNA, 21 bp, synthetic construct
  misc_feature 1..21: note = Description of Artificial Sequence: Syntheticoligonucleotide
  source 1..21: mol_type = other DNA
ccagactcatatgagtctggc

SEQ ID NO: 12049 - DNA, 21 bp, synthetic construct
  misc_feature 1..21: note = Description of Artificial Sequence: Syntheticoligonucleotide
  source 1..21: mol_type = other DNA
cccgactcatatgagtcggga

SEQ ID NO: 12050 - DNA, 21 bp, synthetic construct
  misc_feature 1..21: note = Description of Artificial Sequence: Syntheticoligonucleotide
  source 1..21: mol_type = other DNA
tccgactcatatgagtcggac

SEQ ID NO: 12051 - DNA, 21 bp, synthetic construct
  misc_feature 1..21: note = Description of Artificial Sequence: Syntheticoligonucleotide
  source 1..21: mol_type = other DNA
cctgactcatatgagtcaggc

SEQ ID NO: 12052 - DNA, 21 bp, synthetic construct
  misc_feature 1..21: note = Description of Artificial Sequence: Syntheticoligonucleotide
  source 1..21: mol_type = other DNA
ggcgactcatatgagtcgccc

SEQ ID NO: 12053 - DNA, 21 bp, synthetic construct
  misc_feature 1..21: note = Description of Artificial Sequence: Syntheticoligonucleotide
  source 1..21: mol_type = other DNA
ggcgactcatatgagtcgcct

SEQ ID NO: 12054 - DNA, 21 bp, synthetic construct
  misc_feature 1..21: note = Description of Artificial Sequence: Syntheticoligonucleotide
  source 1..21: mol_type = other DNA
agcgactcatatgagtcgctc

SEQ ID NO: 12055 - DNA, 21 bp, synthetic construct
  misc_feature 1..21: note = Description of Artificial Sequence: Syntheticoligonucleotide
  source 1..21: mol_type = other DNA
gacgactcatatgagtcgtcc

SEQ ID NO: 12056 - DNA, 21 bp, synthetic construct
  misc_feature 1..21: note = Description of Artificial Sequence: Syntheticoligonucleotide
  source 1..21: mol_type = other DNA
ggagactcatatgagtctccc

SEQ ID NO: 12057 - DNA, 21 bp, synthetic construct
  misc_feature 1..21: note = Description of Artificial Sequence: Syntheticoligonucleotide
  source 1..21: mol_type = other DNA
ggcgactcatatgagtcgcca

SEQ ID NO: 12058 - DNA, 21 bp, synthetic construct
  misc_feature 1..21: note = Description of Artificial Sequence: Syntheticoligonucleotide
  source 1..21: mol_type = other DNA
tgcgactcatatgagtcgcac

SEQ ID NO: 12059 - DNA, 21 bp, synthetic construct
  misc_feature 1..21: note = Description of Artificial Sequence: Syntheticoligonucleotide
  source 1..21: mol_type = other DNA
ggtgactcatatgagtcaccc

SEQ ID NO: 12060 - DNA, 21 bp, synthetic construct
  misc_feature 1..21: note = Description of Artificial Sequence: Syntheticoligonucleotide
  source 1..21: mol_type = other DNA
cgggactcatatgagtcccgt

SEQ ID NO: 12061 - DNA, 21 bp, synthetic construct
  misc_feature 1..21: note = Description of Artificial Sequence: Syntheticoligonucleotide
  source 1..21: mol_type = other DNA
agggactcatatgagtccctg

SEQ ID NO: 12062 - DNA, 21 bp, synthetic construct
  misc_feature 1..21: note = Description of Artificial Sequence: Syntheticoligonucleotide
  source 1..21: mol_type = other DNA
caggactcatatgagtcctgg

SEQ ID NO: 12063 - DNA, 21 bp, synthetic construct
  misc_feature 1..21: note = Description of Artificial Sequence: Syntheticoligonucleotide
  source 1..21: mol_type = other DNA
cgagactcatatgagtctcgg

SEQ ID NO: 12064 - DNA, 21 bp, synthetic construct
  misc_feature 1..21: note = Description of Artificial Sequence: Syntheticoligonucleotide
  source 1..21: mol_type = other DNA
cgggactcatatgagtcccga

SEQ ID NO: 12065 - DNA, 21 bp, synthetic construct
  misc_feature 1..21: note = Description of Artificial Sequence: Syntheticoligonucleotide
  source 1..21: mol_type = other DNA
tgggactcatatgagtcccag

SEQ ID NO: 12066 - DNA, 21 bp, synthetic construct
  misc_feature 1..21: note = Description of Artificial Sequence: Syntheticoligonucleotide
  source 1..21: mol_type = other DNA
ctggactcatatgagtccagg

SEQ ID NO: 12067 - DNA, 21 bp, synthetic construct
  misc_feature 1..21: note = Description of Artificial Sequence: Syntheticoligonucleotide
  source 1..21: mol_type = other DNA
cgtgactcatatgagtcacgg

SEQ ID NO: 12068 - DNA, 21 bp, synthetic construct
  misc_feature 1..21: note = Description of Artificial Sequence: Syntheticoligonucleotide
  source 1..21: mol_type = other DNA
ggcgactcatatgagtcgccg

SEQ ID NO: 12069 - DNA, 21 bp, synthetic construct
  misc_feature 1..21: note = Description of Artificial Sequence: Syntheticoligonucleotide
  source 1..21: mol_type = other DNA
agcgactcatatgagtcgctg

SEQ ID NO: 12070 - DNA, 21 bp, synthetic construct
  misc_feature 1..21: note = Description of Artificial Sequence: Syntheticoligonucleotide
  source 1..21: mol_type = other DNA
gacgactcatatgagtcgtcg

SEQ ID NO: 12071 - DNA, 21 bp, synthetic construct
  misc_feature 1..21: note = Description of Artificial Sequence: Syntheticoligonucleotide
  source 1..21: mol_type = other DNA
ggagactcatatgagtctccg

SEQ ID NO: 12072 - DNA, 21 bp, synthetic construct
  misc_feature 1..21: note = Description of Artificial Sequence: Syntheticoligonucleotide
  source 1..21: mol_type = other DNA
tgcgactcatatgagtcgcag

SEQ ID NO: 12073 - DNA, 21 bp, synthetic construct
  misc_feature 1..21: note = Description of Artificial Sequence: Syntheticoligonucleotide
  source 1..21: mol_type = other DNA
ggtgactcatatgagtcaccg

SEQ ID NO: 12074 - DNA, 21 bp, synthetic construct
  misc_feature 1..21: note = Description of Artificial Sequence: Syntheticoligonucleotide
  source 1..21: mol_type = other DNA
acggactcatatgagtccgtg

SEQ ID NO: 12075 - DNA, 21 bp, synthetic construct
  misc_feature 1..21: note = Description of Artificial Sequence: Syntheticoligonucleotide
  source 1..21: mol_type = other DNA
ccagactcatatgagtctggg

SEQ ID NO: 12076 - DNA, 21 bp, synthetic construct
  misc_feature 1..21: note = Description of Artificial Sequence: Syntheticoligonucleotide
  source 1..21: mol_type = other DNA
tcggactcatatgagtccgag

SEQ ID NO: 12077 - DNA, 21 bp, synthetic construct
  misc_feature 1..21: note = Description of Artificial Sequence: Syntheticoligonucleotide
  source 1..21: mol_type = other DNA
cctgactcatatgagtcaggg

SEQ ID NO: 12078 - DNA, 21 bp, synthetic construct
  misc_feature 1..21: note = Description of Artificial Sequence: Syntheticoligonucleotide
  source 1..21: mol_type = other DNA
cacgactcatatgagtcgtgg

SEQ ID NO: 12079 - DNA, 21 bp, synthetic construct
  misc_feature 1..21: note = Description of Artificial Sequence: Syntheticoligonucleotide
  source 1..21: mol_type = other DNA
gccgactcatatgagtcggct

SEQ ID NO: 12080 - DNA, 21 bp, synthetic construct
  misc_feature 1..21: note = Description of Artificial Sequence: Syntheticoligonucleotide
  source 1..21: mol_type = other DNA
gccgactcatatgagtcggca

SEQ ID NO: 12081 - DNA, 21 bp, synthetic construct
  misc_feature 1..21: note = Description of Artificial Sequence: Syntheticoligonucleotide
  source 1..21: mol_type = other DNA
cgagactcatatgagtctcgc

SEQ ID NO: 12082 - DNA, 21 bp, synthetic construct
  misc_feature 1..21: note = Description of Artificial Sequence: Syntheticoligonucleotide
  source 1..21: mol_type = other DNA
cgtgactcatatgagtcacgc

SEQ ID NO: 12083 - DNA, 21 bp, synthetic construct
  misc_feature 1..21: note = Description of Artificial Sequence: Syntheticoligonucleotide
  source 1..21: mol_type = other DNA
caggactcatatgagtcctgc

SEQ ID NO: 12084 - DNA, 21 bp, synthetic construct
  misc_feature 1..21: note = Description of Artificial Sequence: Syntheticoligonucleotide
  source 1..21: mol_type = other DNA
ctggactcatatgagtccagc

SEQ ID NO: 12085 - DNA, 21 bp, synthetic construct
  misc_feature 1..21: note = Description of Artificial Sequence: Syntheticoligonucleotide
  source 1..21: mol_type = other DNA
gaggactcatatgagtcctcg

SEQ ID NO: 12086 - DNA, 21 bp, synthetic construct
  misc_feature 1..21: note = Description of Artificial Sequence: Syntheticoligonucleotide
  source 1..21: mol_type = other DNA
gtggactcatatgagtccacg

SEQ ID NO: 12087 - DNA, 21 bp, synthetic construct
  misc_feature 1..21: note = Description of Artificial Sequence: Syntheticoligonucleotide
  source 1..21: mol_type = other DNA
accgactcatatgagtcggtg

SEQ ID NO: 12088 - DNA, 21 bp, synthetic construct
  misc_feature 1..21: note = Description of Artificial Sequence: Syntheticoligonucleotide
  source 1..21: mol_type = other DNA
tccgactcatatgagtcggag

SEQ ID NO: 12089 - DNA, 21 bp, synthetic construct
  misc_feature 1..21: note = Description of Artificial Sequence: Syntheticoligonucleotide
  source 1..21: mol_type = other DNA
cgggactcatatgagtcccgc

SEQ ID NO: 12090 - DNA, 21 bp, synthetic construct
  misc_feature 1..21: note = Description of Artificial Sequence: Syntheticoligonucleotide
  source 1..21: mol_type = other DNA
agggactcatatgagtccctc

SEQ ID NO: 12091 - DNA, 21 bp, synthetic construct
  misc_feature 1..21: note = Description of Artificial Sequence: Syntheticoligonucleotide
  source 1..21: mol_type = other DNA
tgggactcatatgagtcccac

SEQ ID NO: 12092 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactcttaagagtcnnnn

SEQ ID NO: 12093 - DNA, 21 bp, synthetic construct
  misc_feature 1..21: note = Description of Artificial Sequence: Syntheticoligonucleotide
  source 1..21: mol_type = other DNA
gcggactcttaagagtccgcc

SEQ ID NO: 12094 - DNA, 21 bp, synthetic construct
  misc_feature 1..21: note = Description of Artificial Sequence: Syntheticoligonucleotide
  source 1..21: mol_type = other DNA
gcggactcttaagagtccgct

SEQ ID NO: 12095 - DNA, 21 bp, synthetic construct
  misc_feature 1..21: note = Description of Artificial Sequence: Syntheticoligonucleotide
  source 1..21: mol_type = other DNA
acggactcttaagagtccgtc

SEQ ID NO: 12096 - DNA, 21 bp, synthetic construct
  misc_feature 1..21: note = Description of Artificial Sequence: Syntheticoligonucleotide
  source 1..21: mol_type = other DNA
gaggactcttaagagtcctcc

SEQ ID NO: 12097 - DNA, 21 bp, synthetic construct
  misc_feature 1..21: note = Description of Artificial Sequence: Syntheticoligonucleotide
  source 1..21: mol_type = other DNA
gcagactcttaagagtctgcc

SEQ ID NO: 12098 - DNA, 21 bp, synthetic construct
  misc_feature 1..21: note = Description of Artificial Sequence: Syntheticoligonucleotide
  source 1..21: mol_type = other DNA
gcggactcttaagagtccgca

SEQ ID NO: 12099 - DNA, 21 bp, synthetic construct
  misc_feature 1..21: note = Description of Artificial Sequence: Syntheticoligonucleotide
  source 1..21: mol_type = other DNA
tcggactcttaagagtccgac

SEQ ID NO: 12100 - DNA, 21 bp, synthetic construct
  misc_feature 1..21: note = Description of Artificial Sequence: Syntheticoligonucleotide
  source 1..21: mol_type = other DNA
gtggactcttaagagtccacc

SEQ ID NO: 12101 - DNA, 21 bp, synthetic construct
  misc_feature 1..21: note = Description of Artificial Sequence: Syntheticoligonucleotide
  source 1..21: mol_type = other DNA
gctgactcttaagagtcagcc

SEQ ID NO: 12102 - DNA, 21 bp, synthetic construct
  misc_feature 1..21: note = Description of Artificial Sequence: Syntheticoligonucleotide
  source 1..21: mol_type = other DNA
cccgactcttaagagtcgggc

SEQ ID NO: 12103 - DNA, 21 bp, synthetic construct
  misc_feature 1..21: note = Description of Artificial Sequence: Syntheticoligonucleotide
  source 1..21: mol_type = other DNA
cccgactcttaagagtcgggt

SEQ ID NO: 12104 - DNA, 21 bp, synthetic construct
  misc_feature 1..21: note = Description of Artificial Sequence: Syntheticoligonucleotide
  source 1..21: mol_type = other DNA
accgactcttaagagtcggtc

SEQ ID NO: 12105 - DNA, 21 bp, synthetic construct
  misc_feature 1..21: note = Description of Artificial Sequence: Syntheticoligonucleotide
  source 1..21: mol_type = other DNA
cacgactcttaagagtcgtgc

SEQ ID NO: 12106 - DNA, 21 bp, synthetic construct
  misc_feature 1..21: note = Description of Artificial Sequence: Syntheticoligonucleotide
  source 1..21: mol_type = other DNA
ccagactcttaagagtctggc

SEQ ID NO: 12107 - DNA, 21 bp, synthetic construct
  misc_feature 1..21: note = Description of Artificial Sequence: Syntheticoligonucleotide
  source 1..21: mol_type = other DNA
cccgactcttaagagtcggga

SEQ ID NO: 12108 - DNA, 21 bp, synthetic construct
  misc_feature 1..21: note = Description of Artificial Sequence: Syntheticoligonucleotide
  source 1..21: mol_type = other DNA
tccgactcttaagagtcggac

SEQ ID NO: 12109 - DNA, 21 bp, synthetic construct
  misc_feature 1..21: note = Description of Artificial Sequence: Syntheticoligonucleotide
  source 1..21: mol_type = other DNA
cctgactcttaagagtcaggc

SEQ ID NO: 12110 - DNA, 21 bp, synthetic construct
  misc_feature 1..21: note = Description of Artificial Sequence: Syntheticoligonucleotide
  source 1..21: mol_type = other DNA
ggcgactcttaagagtcgccc

SEQ ID NO: 12111 - DNA, 21 bp, synthetic construct
  misc_feature 1..21: note = Description of Artificial Sequence: Syntheticoligonucleotide
  source 1..21: mol_type = other DNA
ggcgactcttaagagtcgcct

SEQ ID NO: 12112 - DNA, 21 bp, synthetic construct
  misc_feature 1..21: note = Description of Artificial Sequence: Syntheticoligonucleotide
  source 1..21: mol_type = other DNA
agcgactcttaagagtcgctc

SEQ ID NO: 12113 - DNA, 21 bp, synthetic construct
  misc_feature 1..21: note = Description of Artificial Sequence: Syntheticoligonucleotide
  source 1..21: mol_type = other DNA
gacgactcttaagagtcgtcc

SEQ ID NO: 12114 - DNA, 21 bp, synthetic construct
  misc_feature 1..21: note = Description of Artificial Sequence: Syntheticoligonucleotide
  source 1..21: mol_type = other DNA
ggagactcttaagagtctccc

SEQ ID NO: 12115 - DNA, 21 bp, synthetic construct
  misc_feature 1..21: note = Description of Artificial Sequence: Syntheticoligonucleotide
  source 1..21: mol_type = other DNA
ggcgactcttaagagtcgcca

SEQ ID NO: 12116 - DNA, 21 bp, synthetic construct
  misc_feature 1..21: note = Description of Artificial Sequence: Syntheticoligonucleotide
  source 1..21: mol_type = other DNA
tgcgactcttaagagtcgcac

SEQ ID NO: 12117 - DNA, 21 bp, synthetic construct
  misc_feature 1..21: note = Description of Artificial Sequence: Syntheticoligonucleotide
  source 1..21: mol_type = other DNA
ggtgactcttaagagtcaccc

SEQ ID NO: 12118 - DNA, 21 bp, synthetic construct
  misc_feature 1..21: note = Description of Artificial Sequence: Syntheticoligonucleotide
  source 1..21: mol_type = other DNA
cgggactcttaagagtcccgt

SEQ ID NO: 12119 - DNA, 21 bp, synthetic construct
  misc_feature 1..21: note = Description of Artificial Sequence: Syntheticoligonucleotide
  source 1..21: mol_type = other DNA
agggactcttaagagtccctg

SEQ ID NO: 12120 - DNA, 21 bp, synthetic construct
  misc_feature 1..21: note = Description of Artificial Sequence: Syntheticoligonucleotide
  source 1..21: mol_type = other DNA
caggactcttaagagtcctgg

SEQ ID NO: 12121 - DNA, 21 bp, synthetic construct
  misc_feature 1..21: note = Description of Artificial Sequence: Syntheticoligonucleotide
  source 1..21: mol_type = other DNA
cgagactcttaagagtctcgg

SEQ ID NO: 12122 - DNA, 21 bp, synthetic construct
  misc_feature 1..21: note = Description of Artificial Sequence: Syntheticoligonucleotide
  source 1..21: mol_type = other DNA
cgggactcttaagagtcccga

SEQ ID NO: 12123 - DNA, 21 bp, synthetic construct
  misc_feature 1..21: note = Description of Artificial Sequence: Syntheticoligonucleotide
  source 1..21: mol_type = other DNA
tgggactcttaagagtcccag

SEQ ID NO: 12124 - DNA, 21 bp, synthetic construct
  misc_feature 1..21: note = Description of Artificial Sequence: Syntheticoligonucleotide
  source 1..21: mol_type = other DNA
ctggactcttaagagtccagg

SEQ ID NO: 12125 - DNA, 21 bp, synthetic construct
  misc_feature 1..21: note = Description of Artificial Sequence: Syntheticoligonucleotide
  source 1..21: mol_type = other DNA
cgtgactcttaagagtcacgg

SEQ ID NO: 12126 - DNA, 21 bp, synthetic construct
  misc_feature 1..21: note = Description of Artificial Sequence: Syntheticoligonucleotide
  source 1..21: mol_type = other DNA
ggcgactcttaagagtcgccg

SEQ ID NO: 12127 - DNA, 21 bp, synthetic construct
  misc_feature 1..21: note = Description of Artificial Sequence: Syntheticoligonucleotide
  source 1..21: mol_type = other DNA
agcgactcttaagagtcgctg

SEQ ID NO: 12128 - DNA, 21 bp, synthetic construct
  misc_feature 1..21: note = Description of Artificial Sequence: Syntheticoligonucleotide
  source 1..21: mol_type = other DNA
gacgactcttaagagtcgtcg

SEQ ID NO: 12129 - DNA, 21 bp, synthetic construct
  misc_feature 1..21: note = Description of Artificial Sequence: Syntheticoligonucleotide
  source 1..21: mol_type = other DNA
ggagactcttaagagtctccg

SEQ ID NO: 12130 - DNA, 21 bp, synthetic construct
  misc_feature 1..21: note = Description of Artificial Sequence: Syntheticoligonucleotide
  source 1..21: mol_type = other DNA
tgcgactcttaagagtcgcag

SEQ ID NO: 12131 - DNA, 21 bp, synthetic construct
  misc_feature 1..21: note = Description of Artificial Sequence: Syntheticoligonucleotide
  source 1..21: mol_type = other DNA
ggtgactcttaagagtcaccg

SEQ ID NO: 12132 - DNA, 21 bp, synthetic construct
  misc_feature 1..21: note = Description of Artificial Sequence: Syntheticoligonucleotide
  source 1..21: mol_type = other DNA
acggactcttaagagtccgtg

SEQ ID NO: 12133 - DNA, 21 bp, synthetic construct
  misc_feature 1..21: note = Description of Artificial Sequence: Syntheticoligonucleotide
  source 1..21: mol_type = other DNA
ccagactcttaagagtctggg

SEQ ID NO: 12134 - DNA, 21 bp, synthetic construct
  misc_feature 1..21: note = Description of Artificial Sequence: Syntheticoligonucleotide
  source 1..21: mol_type = other DNA
tcggactcttaagagtccgag

SEQ ID NO: 12135 - DNA, 21 bp, synthetic construct
  misc_feature 1..21: note = Description of Artificial Sequence: Syntheticoligonucleotide
  source 1..21: mol_type = other DNA
cctgactcttaagagtcaggg

SEQ ID NO: 12136 - DNA, 21 bp, synthetic construct
  misc_feature 1..21: note = Description of Artificial Sequence: Syntheticoligonucleotide
  source 1..21: mol_type = other DNA
cacgactcttaagagtcgtgg

SEQ ID NO: 12137 - DNA, 21 bp, synthetic construct
  misc_feature 1..21: note = Description of Artificial Sequence: Syntheticoligonucleotide
  source 1..21: mol_type = other DNA
gccgactcttaagagtcggct

SEQ ID NO: 12138 - DNA, 21 bp, synthetic construct
  misc_feature 1..21: note = Description of Artificial Sequence: Syntheticoligonucleotide
  source 1..21: mol_type = other DNA
gccgactcttaagagtcggca

SEQ ID NO: 12139 - DNA, 21 bp, synthetic construct
  misc_feature 1..21: note = Description of Artificial Sequence: Syntheticoligonucleotide
  source 1..21: mol_type = other DNA
cgagactcttaagagtctcgc

SEQ ID NO: 12140 - DNA, 21 bp, synthetic construct
  misc_feature 1..21: note = Description of Artificial Sequence: Syntheticoligonucleotide
  source 1..21: mol_type = other DNA
cgtgactcttaagagtcacgc

SEQ ID NO: 12141 - DNA, 21 bp, synthetic construct
  misc_feature 1..21: note = Description of Artificial Sequence: Syntheticoligonucleotide
  source 1..21: mol_type = other DNA
caggactcttaagagtcctgc

SEQ ID NO: 12142 - DNA, 21 bp, synthetic construct
  misc_feature 1..21: note = Description of Artificial Sequence: Syntheticoligonucleotide
  source 1..21: mol_type = other DNA
ctggactcttaagagtccagc

SEQ ID NO: 12143 - DNA, 21 bp, synthetic construct
  misc_feature 1..21: note = Description of Artificial Sequence: Syntheticoligonucleotide
  source 1..21: mol_type = other DNA
gaggactcttaagagtcctcg

SEQ ID NO: 12144 - DNA, 21 bp, synthetic construct
  misc_feature 1..21: note = Description of Artificial Sequence: Syntheticoligonucleotide
  source 1..21: mol_type = other DNA
gtggactcttaagagtccacg

SEQ ID NO: 12145 - DNA, 21 bp, synthetic construct
  misc_feature 1..21: note = Description of Artificial Sequence: Syntheticoligonucleotide
  source 1..21: mol_type = other DNA
accgactcttaagagtcggtg

SEQ ID NO: 12146 - DNA, 21 bp, synthetic construct
  misc_feature 1..21: note = Description of Artificial Sequence: Syntheticoligonucleotide
  source 1..21: mol_type = other DNA
tccgactcttaagagtcggag

SEQ ID NO: 12147 - DNA, 21 bp, synthetic construct
  misc_feature 1..21: note = Description of Artificial Sequence: Syntheticoligonucleotide
  source 1..21: mol_type = other DNA
cgggactcttaagagtcccgc

SEQ ID NO: 12148 - DNA, 21 bp, synthetic construct
  misc_feature 1..21: note = Description of Artificial Sequence: Syntheticoligonucleotide
  source 1..21: mol_type = other DNA
agggactcttaagagtccctc

SEQ ID NO: 12149 - DNA, 21 bp, synthetic construct
  misc_feature 1..21: note = Description of Artificial Sequence: Syntheticoligonucleotide
  source 1..21: mol_type = other DNA
tgggactcttaagagtcccac

SEQ ID NO: 12150 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactccgcggagtcnnnn

SEQ ID NO: 12151 - DNA, 20 bp, synthetic construct
  misc_feature 1..20: note = Description of Artificial Sequence: Syntheticoligonucleotide
  source 1..20: mol_type = other DNA
cggactccgcggagtccgcc

SEQ ID NO: 12152 - DNA, 20 bp, synthetic construct
  misc_feature 1..20: note = Description of Artificial Sequence: Syntheticoligonucleotide
  source 1..20: mol_type = other DNA
cggactccgcggagtccgct

SEQ ID NO: 12153 - DNA, 20 bp, synthetic construct
  misc_feature 1..20: note = Description of Artificial Sequence: Syntheticoligonucleotide
  source 1..20: mol_type = other DNA
cggactccgcggagtccgtc

SEQ ID NO: 12154 - DNA, 20 bp, synthetic construct
  misc_feature 1..20: note = Description of Artificial Sequence: Syntheticoligonucleotide
  source 1..20: mol_type = other DNA
aggactccgcggagtcctcc

SEQ ID NO: 12155 - DNA, 20 bp, synthetic construct
  misc_feature 1..20: note = Description of Artificial Sequence: Syntheticoligonucleotide
  source 1..20: mol_type = other DNA
cagactccgcggagtctgcc

SEQ ID NO: 12156 - DNA, 20 bp, synthetic construct
  misc_feature 1..20: note = Description of Artificial Sequence: Syntheticoligonucleotide
  source 1..20: mol_type = other DNA
cggactccgcggagtccgca

SEQ ID NO: 12157 - DNA, 20 bp, synthetic construct
  misc_feature 1..20: note = Description of Artificial Sequence: Syntheticoligonucleotide
  source 1..20: mol_type = other DNA
cggactccgcggagtccgac

SEQ ID NO: 12158 - DNA, 20 bp, synthetic construct
  misc_feature 1..20: note = Description of Artificial Sequence: Syntheticoligonucleotide
  source 1..20: mol_type = other DNA
tggactccgcggagtccacc

SEQ ID NO: 12159 - DNA, 20 bp, synthetic construct
  misc_feature 1..20: note = Description of Artificial Sequence: Syntheticoligonucleotide
  source 1..20: mol_type = other DNA
ctgactccgcggagtcagcc

SEQ ID NO: 12160 - DNA, 20 bp, synthetic construct
  misc_feature 1..20: note = Description of Artificial Sequence: Syntheticoligonucleotide
  source 1..20: mol_type = other DNA
ccgactccgcggagtcgggc

SEQ ID NO: 12161 - DNA, 20 bp, synthetic construct
  misc_feature 1..20: note = Description of Artificial Sequence: Syntheticoligonucleotide
  source 1..20: mol_type = other DNA
ccgactccgcggagtcgggt

SEQ ID NO: 12162 - DNA, 20 bp, synthetic construct
  misc_feature 1..20: note = Description of Artificial Sequence: Syntheticoligonucleotide
  source 1..20: mol_type = other DNA
ccgactccgcggagtcggtc

SEQ ID NO: 12163 - DNA, 20 bp, synthetic construct
  misc_feature 1..20: note = Description of Artificial Sequence: Syntheticoligonucleotide
  source 1..20: mol_type = other DNA
acgactccgcggagtcgtgc

SEQ ID NO: 12164 - DNA, 20 bp, synthetic construct
  misc_feature 1..20: note = Description of Artificial Sequence: Syntheticoligonucleotide
  source 1..20: mol_type = other DNA
cagactccgcggagtctggc

SEQ ID NO: 12165 - DNA, 20 bp, synthetic construct
  misc_feature 1..20: note = Description of Artificial Sequence: Syntheticoligonucleotide
  source 1..20: mol_type = other DNA
ccgactccgcggagtcggga

SEQ ID NO: 12166 - DNA, 20 bp, synthetic construct
  misc_feature 1..20: note = Description of Artificial Sequence: Syntheticoligonucleotide
  source 1..20: mol_type = other DNA
ccgactccgcggagtcggac

SEQ ID NO: 12167 - DNA, 20 bp, synthetic construct
  misc_feature 1..20: note = Description of Artificial Sequence: Syntheticoligonucleotide
  source 1..20: mol_type = other DNA
ctgactccgcggagtcaggc

SEQ ID NO: 12168 - DNA, 20 bp, synthetic construct
  misc_feature 1..20: note = Description of Artificial Sequence: Syntheticoligonucleotide
  source 1..20: mol_type = other DNA
gcgactccgcggagtcgccc

SEQ ID NO: 12169 - DNA, 20 bp, synthetic construct
  misc_feature 1..20: note = Description of Artificial Sequence: Syntheticoligonucleotide
  source 1..20: mol_type = other DNA
gcgactccgcggagtcgcct

SEQ ID NO: 12170 - DNA, 20 bp, synthetic construct
  misc_feature 1..20: note = Description of Artificial Sequence: Syntheticoligonucleotide
  source 1..20: mol_type = other DNA
gcgactccgcggagtcgctc

SEQ ID NO: 12171 - DNA, 20 bp, synthetic construct
  misc_feature 1..20: note = Description of Artificial Sequence: Syntheticoligonucleotide
  source 1..20: mol_type = other DNA
acgactccgcggagtcgtcc

SEQ ID NO: 12172 - DNA, 20 bp, synthetic construct
  misc_feature 1..20: note = Description of Artificial Sequence: Syntheticoligonucleotide
  source 1..20: mol_type = other DNA
gagactccgcggagtctccc

SEQ ID NO: 12173 - DNA, 20 bp, synthetic construct
  misc_feature 1..20: note = Description of Artificial Sequence: Syntheticoligonucleotide
  source 1..20: mol_type = other DNA
gcgactccgcggagtcgcca

SEQ ID NO: 12174 - DNA, 20 bp, synthetic construct
  misc_feature 1..20: note = Description of Artificial Sequence: Syntheticoligonucleotide
  source 1..20: mol_type = other DNA
gcgactccgcggagtcgcac

SEQ ID NO: 12175 - DNA, 20 bp, synthetic construct
  misc_feature 1..20: note = Description of Artificial Sequence: Syntheticoligonucleotide
  source 1..20: mol_type = other DNA
gtgactccgcggagtcaccc

SEQ ID NO: 12176 - DNA, 20 bp, synthetic construct
  misc_feature 1..20: note = Description of Artificial Sequence: Syntheticoligonucleotide
  source 1..20: mol_type = other DNA
gggactccgcggagtcccgt

SEQ ID NO: 12177 - DNA, 20 bp, synthetic construct
  misc_feature 1..20: note = Description of Artificial Sequence: Syntheticoligonucleotide
  source 1..20: mol_type = other DNA
gggactccgcggagtccctg

SEQ ID NO: 12178 - DNA, 20 bp, synthetic construct
  misc_feature 1..20: note = Description of Artificial Sequence: Syntheticoligonucleotide
  source 1..20: mol_type = other DNA
aggactccgcggagtcctgg

SEQ ID NO: 12179 - DNA, 20 bp, synthetic construct
  misc_feature 1..20: note = Description of Artificial Sequence: Syntheticoligonucleotide
  source 1..20: mol_type = other DNA
gagactccgcggagtctcgg

SEQ ID NO: 12180 - DNA, 20 bp, synthetic construct
  misc_feature 1..20: note = Description of Artificial Sequence: Syntheticoligonucleotide
  source 1..20: mol_type = other DNA
gggactccgcggagtcccga

SEQ ID NO: 12181 - DNA, 20 bp, synthetic construct
  misc_feature 1..20: note = Description of Artificial Sequence: Syntheticoligonucleotide
  source 1..20: mol_type = other DNA
gggactccgcggagtcccag

SEQ ID NO: 12182 - DNA, 20 bp, synthetic construct
  misc_feature 1..20: note = Description of Artificial Sequence: Syntheticoligonucleotide
  source 1..20: mol_type = other DNA
tggactccgcggagtccagg

SEQ ID NO: 12183 - DNA, 20 bp, synthetic construct
  misc_feature 1..20: note = Description of Artificial Sequence: Syntheticoligonucleotide
  source 1..20: mol_type = other DNA
gtgactccgcggagtcacgg

SEQ ID NO: 12184 - DNA, 20 bp, synthetic construct
  misc_feature 1..20: note = Description of Artificial Sequence: Syntheticoligonucleotide
  source 1..20: mol_type = other DNA
gcgactccgcggagtcgccg

SEQ ID NO: 12185 - DNA, 20 bp, synthetic construct
  misc_feature 1..20: note = Description of Artificial Sequence: Syntheticoligonucleotide
  source 1..20: mol_type = other DNA
gcgactccgcggagtcgctg

SEQ ID NO: 12186 - DNA, 20 bp, synthetic construct
  misc_feature 1..20: note = Description of Artificial Sequence: Syntheticoligonucleotide
  source 1..20: mol_type = other DNA
acgactccgcggagtcgtcg

SEQ ID NO: 12187 - DNA, 20 bp, synthetic construct
  misc_feature 1..20: note = Description of Artificial Sequence: Syntheticoligonucleotide
  source 1..20: mol_type = other DNA
gagactccgcggagtctccg

SEQ ID NO: 12188 - DNA, 20 bp, synthetic construct
  misc_feature 1..20: note = Description of Artificial Sequence: Syntheticoligonucleotide
  source 1..20: mol_type = other DNA
gcgactccgcggagtcgcag

SEQ ID NO: 12189 - DNA, 20 bp, synthetic construct
  misc_feature 1..20: note = Description of Artificial Sequence: Syntheticoligonucleotide
  source 1..20: mol_type = other DNA
gtgactccgcggagtcaccg

SEQ ID NO: 12190 - DNA, 20 bp, synthetic construct
  misc_feature 1..20: note = Description of Artificial Sequence: Syntheticoligonucleotide
  source 1..20: mol_type = other DNA
cggactccgcggagtccgtg

SEQ ID NO: 12191 - DNA, 20 bp, synthetic construct
  misc_feature 1..20: note = Description of Artificial Sequence: Syntheticoligonucleotide
  source 1..20: mol_type = other DNA
cagactccgcggagtctggg

SEQ ID NO: 12192 - DNA, 20 bp, synthetic construct
  misc_feature 1..20: note = Description of Artificial Sequence: Syntheticoligonucleotide
  source 1..20: mol_type = other DNA
cggactccgcggagtccgag

SEQ ID NO: 12193 - DNA, 20 bp, synthetic construct
  misc_feature 1..20: note = Description of Artificial Sequence: Syntheticoligonucleotide
  source 1..20: mol_type = other DNA
ctgactccgcggagtcaggg

SEQ ID NO: 12194 - DNA, 20 bp, synthetic construct
  misc_feature 1..20: note = Description of Artificial Sequence: Syntheticoligonucleotide
  source 1..20: mol_type = other DNA
acgactccgcggagtcgtgg

SEQ ID NO: 12195 - DNA, 20 bp, synthetic construct
  misc_feature 1..20: note = Description of Artificial Sequence: Syntheticoligonucleotide
  source 1..20: mol_type = other DNA
ccgactccgcggagtcggct

SEQ ID NO: 12196 - DNA, 20 bp, synthetic construct
  misc_feature 1..20: note = Description of Artificial Sequence: Syntheticoligonucleotide
  source 1..20: mol_type = other DNA
ccgactccgcggagtcggca

SEQ ID NO: 12197 - DNA, 20 bp, synthetic construct
  misc_feature 1..20: note = Description of Artificial Sequence: Syntheticoligonucleotide
  source 1..20: mol_type = other DNA
gagactccgcggagtctcgc

SEQ ID NO: 12198 - DNA, 20 bp, synthetic construct
  misc_feature 1..20: note = Description of Artificial Sequence: Syntheticoligonucleotide
  source 1..20: mol_type = other DNA
gtgactccgcggagtcacgc

SEQ ID NO: 12199 - DNA, 20 bp, synthetic construct
  misc_feature 1..20: note = Description of Artificial Sequence: Syntheticoligonucleotide
  source 1..20: mol_type = other DNA
aggactccgcggagtcctgc

SEQ ID NO: 12200 - DNA, 20 bp, synthetic construct
  misc_feature 1..20: note = Description of Artificial Sequence: Syntheticoligonucleotide
  source 1..20: mol_type = other DNA
tggactccgcggagtccagc

SEQ ID NO: 12201 - DNA, 20 bp, synthetic construct
  misc_feature 1..20: note = Description of Artificial Sequence: Syntheticoligonucleotide
  source 1..20: mol_type = other DNA
aggactccgcggagtcctcg

SEQ ID NO: 12202 - DNA, 20 bp, synthetic construct
  misc_feature 1..20: note = Description of Artificial Sequence: Syntheticoligonucleotide
  source 1..20: mol_type = other DNA
tggactccgcggagtccacg

SEQ ID NO: 12203 - DNA, 20 bp, synthetic construct
  misc_feature 1..20: note = Description of Artificial Sequence: Syntheticoligonucleotide
  source 1..20: mol_type = other DNA
ccgactccgcggagtcggtg

SEQ ID NO: 12204 - DNA, 20 bp, synthetic construct
  misc_feature 1..20: note = Description of Artificial Sequence: Syntheticoligonucleotide
  source 1..20: mol_type = other DNA
ccgactccgcggagtcggag

SEQ ID NO: 12205 - DNA, 20 bp, synthetic construct
  misc_feature 1..20: note = Description of Artificial Sequence: Syntheticoligonucleotide
  source 1..20: mol_type = other DNA
gggactccgcggagtcccgc

SEQ ID NO: 12206 - DNA, 20 bp, synthetic construct
  misc_feature 1..20: note = Description of Artificial Sequence: Syntheticoligonucleotide
  source 1..20: mol_type = other DNA
gggactccgcggagtccctc

SEQ ID NO: 12207 - DNA, 20 bp, synthetic construct
  misc_feature 1..20: note = Description of Artificial Sequence: Syntheticoligonucleotide
  source 1..20: mol_type = other DNA
gggactccgcggagtcccac

SEQ ID NO: 12208 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactctgcagagtcnnnn

SEQ ID NO: 12209 - DNA, 20 bp, synthetic construct
  misc_feature 1..20: note = Description of Artificial Sequence: Syntheticoligonucleotide
  source 1..20: mol_type = other DNA
cggactctgcagagtccgcc

SEQ ID NO: 12210 - DNA, 20 bp, synthetic construct
  misc_feature 1..20: note = Description of Artificial Sequence: Syntheticoligonucleotide
  source 1..20: mol_type = other DNA
cggactctgcagagtccgct

SEQ ID NO: 12211 - DNA, 20 bp, synthetic construct
  misc_feature 1..20: note = Description of Artificial Sequence: Syntheticoligonucleotide
  source 1..20: mol_type = other DNA
cggactctgcagagtccgtc

SEQ ID NO: 12212 - DNA, 20 bp, synthetic construct
  misc_feature 1..20: note = Description of Artificial Sequence: Syntheticoligonucleotide
  source 1..20: mol_type = other DNA
aggactctgcagagtcctcc

SEQ ID NO: 12213 - DNA, 20 bp, synthetic construct
  misc_feature 1..20: note = Description of Artificial Sequence: Syntheticoligonucleotide
  source 1..20: mol_type = other DNA
cagactctgcagagtctgcc

SEQ ID NO: 12214 - DNA, 20 bp, synthetic construct
  misc_feature 1..20: note = Description of Artificial Sequence: Syntheticoligonucleotide
  source 1..20: mol_type = other DNA
cggactctgcagagtccgca

SEQ ID NO: 12215 - DNA, 20 bp, synthetic construct
  misc_feature 1..20: note = Description of Artificial Sequence: Syntheticoligonucleotide
  source 1..20: mol_type = other DNA
cggactctgcagagtccgac

SEQ ID NO: 12216 - DNA, 20 bp, synthetic construct
  misc_feature 1..20: note = Description of Artificial Sequence: Syntheticoligonucleotide
  source 1..20: mol_type = other DNA
tggactctgcagagtccacc

SEQ ID NO: 12217 - DNA, 20 bp, synthetic construct
  misc_feature 1..20: note = Description of Artificial Sequence: Syntheticoligonucleotide
  source 1..20: mol_type = other DNA
ctgactctgcagagtcagcc

SEQ ID NO: 12218 - DNA, 20 bp, synthetic construct
  misc_feature 1..20: note = Description of Artificial Sequence: Syntheticoligonucleotide
  source 1..20: mol_type = other DNA
ccgactctgcagagtcgggc

SEQ ID NO: 12219 - DNA, 20 bp, synthetic construct
  misc_feature 1..20: note = Description of Artificial Sequence: Syntheticoligonucleotide
  source 1..20: mol_type = other DNA
ccgactctgcagagtcgggt

SEQ ID NO: 12220 - DNA, 20 bp, synthetic construct
  misc_feature 1..20: note = Description of Artificial Sequence: Syntheticoligonucleotide
  source 1..20: mol_type = other DNA
ccgactctgcagagtcggtc

SEQ ID NO: 12221 - DNA, 20 bp, synthetic construct
  misc_feature 1..20: note = Description of Artificial Sequence: Syntheticoligonucleotide
  source 1..20: mol_type = other DNA
acgactctgcagagtcgtgc

SEQ ID NO: 12222 - DNA, 20 bp, synthetic construct
  misc_feature 1..20: note = Description of Artificial Sequence: Syntheticoligonucleotide
  source 1..20: mol_type = other DNA
cagactctgcagagtctggc

SEQ ID NO: 12223 - DNA, 20 bp, synthetic construct
  misc_feature 1..20: note = Description of Artificial Sequence: Syntheticoligonucleotide
  source 1..20: mol_type = other DNA
ccgactctgcagagtcggga

SEQ ID NO: 12224 - DNA, 20 bp, synthetic construct
  misc_feature 1..20: note = Description of Artificial Sequence: Syntheticoligonucleotide
  source 1..20: mol_type = other DNA
ccgactctgcagagtcggac

SEQ ID NO: 12225 - DNA, 20 bp, synthetic construct
  misc_feature 1..20: note = Description of Artificial Sequence: Syntheticoligonucleotide
  source 1..20: mol_type = other DNA
ctgactctgcagagtcaggc

SEQ ID NO: 12226 - DNA, 20 bp, synthetic construct
  misc_feature 1..20: note = Description of Artificial Sequence: Syntheticoligonucleotide
  source 1..20: mol_type = other DNA
gcgactctgcagagtcgccc

SEQ ID NO: 12227 - DNA, 20 bp, synthetic construct
  misc_feature 1..20: note = Description of Artificial Sequence: Syntheticoligonucleotide
  source 1..20: mol_type = other DNA
gcgactctgcagagtcgcct

SEQ ID NO: 12228 - DNA, 20 bp, synthetic construct
  misc_feature 1..20: note = Description of Artificial Sequence: Syntheticoligonucleotide
  source 1..20: mol_type = other DNA
gcgactctgcagagtcgctc

SEQ ID NO: 12229 - DNA, 20 bp, synthetic construct
  misc_feature 1..20: note = Description of Artificial Sequence: Syntheticoligonucleotide
  source 1..20: mol_type = other DNA
acgactctgcagagtcgtcc

SEQ ID NO: 12230 - DNA, 20 bp, synthetic construct
  misc_feature 1..20: note = Description of Artificial Sequence: Syntheticoligonucleotide
  source 1..20: mol_type = other DNA
gagactctgcagagtctccc

SEQ ID NO: 12231 - DNA, 20 bp, synthetic construct
  misc_feature 1..20: note = Description of Artificial Sequence: Syntheticoligonucleotide
  source 1..20: mol_type = other DNA
gcgactctgcagagtcgcca

SEQ ID NO: 12232 - DNA, 20 bp, synthetic construct
  misc_feature 1..20: note = Description of Artificial Sequence: Syntheticoligonucleotide
  source 1..20: mol_type = other DNA
gcgactctgcagagtcgcac

SEQ ID NO: 12233 - DNA, 20 bp, synthetic construct
  misc_feature 1..20: note = Description of Artificial Sequence: Syntheticoligonucleotide
  source 1..20: mol_type = other DNA
gtgactctgcagagtcaccc

SEQ ID NO: 12234 - DNA, 20 bp, synthetic construct
  misc_feature 1..20: note = Description of Artificial Sequence: Syntheticoligonucleotide
  source 1..20: mol_type = other DNA
gggactctgcagagtcccgt

SEQ ID NO: 12235 - DNA, 20 bp, synthetic construct
  misc_feature 1..20: note = Description of Artificial Sequence: Syntheticoligonucleotide
  source 1..20: mol_type = other DNA
gggactctgcagagtccctg

SEQ ID NO: 12236 - DNA, 20 bp, synthetic construct
  misc_feature 1..20: note = Description of Artificial Sequence: Syntheticoligonucleotide
  source 1..20: mol_type = other DNA
aggactctgcagagtcctgg

SEQ ID NO: 12237 - DNA, 20 bp, synthetic construct
  misc_feature 1..20: note = Description of Artificial Sequence: Syntheticoligonucleotide
  source 1..20: mol_type = other DNA
gagactctgcagagtctcgg

SEQ ID NO: 12238 - DNA, 20 bp, synthetic construct
  misc_feature 1..20: note = Description of Artificial Sequence: Syntheticoligonucleotide
  source 1..20: mol_type = other DNA
gggactctgcagagtcccga

SEQ ID NO: 12239 - DNA, 20 bp, synthetic construct
  misc_feature 1..20: note = Description of Artificial Sequence: Syntheticoligonucleotide
  source 1..20: mol_type = other DNA
gggactctgcagagtcccag

SEQ ID NO: 12240 - DNA, 20 bp, synthetic construct
  misc_feature 1..20: note = Description of Artificial Sequence: Syntheticoligonucleotide
  source 1..20: mol_type = other DNA
tggactctgcagagtccagg

SEQ ID NO: 12241 - DNA, 20 bp, synthetic construct
  misc_feature 1..20: note = Description of Artificial Sequence: Syntheticoligonucleotide
  source 1..20: mol_type = other DNA
gtgactctgcagagtcacgg

SEQ ID NO: 12242 - DNA, 20 bp, synthetic construct
  misc_feature 1..20: note = Description of Artificial Sequence: Syntheticoligonucleotide
  source 1..20: mol_type = other DNA
gcgactctgcagagtcgccg

SEQ ID NO: 12243 - DNA, 20 bp, synthetic construct
  misc_feature 1..20: note = Description of Artificial Sequence: Syntheticoligonucleotide
  source 1..20: mol_type = other DNA
gcgactctgcagagtcgctg

SEQ ID NO: 12244 - DNA, 20 bp, synthetic construct
  misc_feature 1..20: note = Description of Artificial Sequence: Syntheticoligonucleotide
  source 1..20: mol_type = other DNA
acgactctgcagagtcgtcg

SEQ ID NO: 12245 - DNA, 20 bp, synthetic construct
  misc_feature 1..20: note = Description of Artificial Sequence: Syntheticoligonucleotide
  source 1..20: mol_type = other DNA
gagactctgcagagtctccg

SEQ ID NO: 12246 - DNA, 20 bp, synthetic construct
  misc_feature 1..20: note = Description of Artificial Sequence: Syntheticoligonucleotide
  source 1..20: mol_type = other DNA
gcgactctgcagagtcgcag

SEQ ID NO: 12247 - DNA, 20 bp, synthetic construct
  misc_feature 1..20: note = Description of Artificial Sequence: Syntheticoligonucleotide
  source 1..20: mol_type = other DNA
gtgactctgcagagtcaccg

SEQ ID NO: 12248 - DNA, 20 bp, synthetic construct
  misc_feature 1..20: note = Description of Artificial Sequence: Syntheticoligonucleotide
  source 1..20: mol_type = other DNA
cggactctgcagagtccgtg

SEQ ID NO: 12249 - DNA, 20 bp, synthetic construct
  misc_feature 1..20: note = Description of Artificial Sequence: Syntheticoligonucleotide
  source 1..20: mol_type = other DNA
cagactctgcagagtctggg

SEQ ID NO: 12250 - DNA, 20 bp, synthetic construct
  misc_feature 1..20: note = Description of Artificial Sequence: Syntheticoligonucleotide
  source 1..20: mol_type = other DNA
cggactctgcagagtccgag

SEQ ID NO: 12251 - DNA, 20 bp, synthetic construct
  misc_feature 1..20: note = Description of Artificial Sequence: Syntheticoligonucleotide
  source 1..20: mol_type = other DNA
ctgactctgcagagtcaggg

SEQ ID NO: 12252 - DNA, 20 bp, synthetic construct
  misc_feature 1..20: note = Description of Artificial Sequence: Syntheticoligonucleotide
  source 1..20: mol_type = other DNA
acgactctgcagagtcgtgg

SEQ ID NO: 12253 - DNA, 20 bp, synthetic construct
  misc_feature 1..20: note = Description of Artificial Sequence: Syntheticoligonucleotide
  source 1..20: mol_type = other DNA
ccgactctgcagagtcggct

SEQ ID NO: 12254 - DNA, 20 bp, synthetic construct
  misc_feature 1..20: note = Description of Artificial Sequence: Syntheticoligonucleotide
  source 1..20: mol_type = other DNA
ccgactctgcagagtcggca

SEQ ID NO: 12255 - DNA, 20 bp, synthetic construct
  misc_feature 1..20: note = Description of Artificial Sequence: Syntheticoligonucleotide
  source 1..20: mol_type = other DNA
gagactctgcagagtctcgc

SEQ ID NO: 12256 - DNA, 20 bp, synthetic construct
  misc_feature 1..20: note = Description of Artificial Sequence: Syntheticoligonucleotide
  source 1..20: mol_type = other DNA
gtgactctgcagagtcacgc

SEQ ID NO: 12257 - DNA, 20 bp, synthetic construct
  misc_feature 1..20: note = Description of Artificial Sequence: Syntheticoligonucleotide
  source 1..20: mol_type = other DNA
aggactctgcagagtcctgc

SEQ ID NO: 12258 - DNA, 20 bp, synthetic construct
  misc_feature 1..20: note = Description of Artificial Sequence: Syntheticoligonucleotide
  source 1..20: mol_type = other DNA
tggactctgcagagtccagc

SEQ ID NO: 12259 - DNA, 20 bp, synthetic construct
  misc_feature 1..20: note = Description of Artificial Sequence: Syntheticoligonucleotide
  source 1..20: mol_type = other DNA
aggactctgcagagtcctcg

SEQ ID NO: 12260 - DNA, 20 bp, synthetic construct
  misc_feature 1..20: note = Description of Artificial Sequence: Syntheticoligonucleotide
  source 1..20: mol_type = other DNA
tggactctgcagagtccacg

SEQ ID NO: 12261 - DNA, 20 bp, synthetic construct
  misc_feature 1..20: note = Description of Artificial Sequence: Syntheticoligonucleotide
  source 1..20: mol_type = other DNA
ccgactctgcagagtcggtg

SEQ ID NO: 12262 - DNA, 20 bp, synthetic construct
  misc_feature 1..20: note = Description of Artificial Sequence: Syntheticoligonucleotide
  source 1..20: mol_type = other DNA
ccgactctgcagagtcggag

SEQ ID NO: 12263 - DNA, 20 bp, synthetic construct
  misc_feature 1..20: note = Description of Artificial Sequence: Syntheticoligonucleotide
  source 1..20: mol_type = other DNA
gggactctgcagagtcccgc

SEQ ID NO: 12264 - DNA, 20 bp, synthetic construct
  misc_feature 1..20: note = Description of Artificial Sequence: Syntheticoligonucleotide
  source 1..20: mol_type = other DNA
gggactctgcagagtccctc

SEQ ID NO: 12265 - DNA, 20 bp, synthetic construct
  misc_feature 1..20: note = Description of Artificial Sequence: Syntheticoligonucleotide
  source 1..20: mol_type = other DNA
gggactctgcagagtcccac

SEQ ID NO: 12266 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactcgcgcgagtcnnnn

SEQ ID NO: 12267 - DNA, 20 bp, synthetic construct
  misc_feature 1..20: note = Description of Artificial Sequence: Syntheticoligonucleotide
  source 1..20: mol_type = other DNA
cggactcgcgcgagtccgcc

SEQ ID NO: 12268 - DNA, 20 bp, synthetic construct
  misc_feature 1..20: note = Description of Artificial Sequence: Syntheticoligonucleotide
  source 1..20: mol_type = other DNA
cggactcgcgcgagtccgct

SEQ ID NO: 12269 - DNA, 20 bp, synthetic construct
  misc_feature 1..20: note = Description of Artificial Sequence: Syntheticoligonucleotide
  source 1..20: mol_type = other DNA
cggactcgcgcgagtccgtc

SEQ ID NO: 12270 - DNA, 20 bp, synthetic construct
  misc_feature 1..20: note = Description of Artificial Sequence: Syntheticoligonucleotide
  source 1..20: mol_type = other DNA
aggactcgcgcgagtcctcc

SEQ ID NO: 12271 - DNA, 20 bp, synthetic construct
  misc_feature 1..20: note = Description of Artificial Sequence: Syntheticoligonucleotide
  source 1..20: mol_type = other DNA
cagactcgcgcgagtctgcc

SEQ ID NO: 12272 - DNA, 20 bp, synthetic construct
  misc_feature 1..20: note = Description of Artificial Sequence: Syntheticoligonucleotide
  source 1..20: mol_type = other DNA
cggactcgcgcgagtccgca

SEQ ID NO: 12273 - DNA, 20 bp, synthetic construct
  misc_feature 1..20: note = Description of Artificial Sequence: Syntheticoligonucleotide
  source 1..20: mol_type = other DNA
cggactcgcgcgagtccgac

SEQ ID NO: 12274 - DNA, 20 bp, synthetic construct
  misc_feature 1..20: note = Description of Artificial Sequence: Syntheticoligonucleotide
  source 1..20: mol_type = other DNA
tggactcgcgcgagtccacc

SEQ ID NO: 12275 - DNA, 20 bp, synthetic construct
  misc_feature 1..20: note = Description of Artificial Sequence: Syntheticoligonucleotide
  source 1..20: mol_type = other DNA
ctgactcgcgcgagtcagcc

SEQ ID NO: 12276 - DNA, 20 bp, synthetic construct
  misc_feature 1..20: note = Description of Artificial Sequence: Syntheticoligonucleotide
  source 1..20: mol_type = other DNA
ccgactcgcgcgagtcgggc

SEQ ID NO: 12277 - DNA, 20 bp, synthetic construct
  misc_feature 1..20: note = Description of Artificial Sequence: Syntheticoligonucleotide
  source 1..20: mol_type = other DNA
ccgactcgcgcgagtcgggt

SEQ ID NO: 12278 - DNA, 20 bp, synthetic construct
  misc_feature 1..20: note = Description of Artificial Sequence: Syntheticoligonucleotide
  source 1..20: mol_type = other DNA
ccgactcgcgcgagtcggtc

SEQ ID NO: 12279 - DNA, 20 bp, synthetic construct
  misc_feature 1..20: note = Description of Artificial Sequence: Syntheticoligonucleotide
  source 1..20: mol_type = other DNA
acgactcgcgcgagtcgtgc

SEQ ID NO: 12280 - DNA, 20 bp, synthetic construct
  misc_feature 1..20: note = Description of Artificial Sequence: Syntheticoligonucleotide
  source 1..20: mol_type = other DNA
cagactcgcgcgagtctggc

SEQ ID NO: 12281 - DNA, 20 bp, synthetic construct
  misc_feature 1..20: note = Description of Artificial Sequence: Syntheticoligonucleotide
  source 1..20: mol_type = other DNA
ccgactcgcgcgagtcggga

SEQ ID NO: 12282 - DNA, 20 bp, synthetic construct
  misc_feature 1..20: note = Description of Artificial Sequence: Syntheticoligonucleotide
  source 1..20: mol_type = other DNA
ccgactcgcgcgagtcggac

SEQ ID NO: 12283 - DNA, 20 bp, synthetic construct
  misc_feature 1..20: note = Description of Artificial Sequence: Syntheticoligonucleotide
  source 1..20: mol_type = other DNA
ctgactcgcgcgagtcaggc

SEQ ID NO: 12284 - DNA, 20 bp, synthetic construct
  misc_feature 1..20: note = Description of Artificial Sequence: Syntheticoligonucleotide
  source 1..20: mol_type = other DNA
gcgactcgcgcgagtcgccc

SEQ ID NO: 12285 - DNA, 20 bp, synthetic construct
  misc_feature 1..20: note = Description of Artificial Sequence: Syntheticoligonucleotide
  source 1..20: mol_type = other DNA
gcgactcgcgcgagtcgcct

SEQ ID NO: 12286 - DNA, 20 bp, synthetic construct
  misc_feature 1..20: note = Description of Artificial Sequence: Syntheticoligonucleotide
  source 1..20: mol_type = other DNA
gcgactcgcgcgagtcgctc

SEQ ID NO: 12287 - DNA, 20 bp, synthetic construct
  misc_feature 1..20: note = Description of Artificial Sequence: Syntheticoligonucleotide
  source 1..20: mol_type = other DNA
acgactcgcgcgagtcgtcc

SEQ ID NO: 12288 - DNA, 20 bp, synthetic construct
  misc_feature 1..20: note = Description of Artificial Sequence: Syntheticoligonucleotide
  source 1..20: mol_type = other DNA
gagactcgcgcgagtctccc

SEQ ID NO: 12289 - DNA, 20 bp, synthetic construct
  misc_feature 1..20: note = Description of Artificial Sequence: Syntheticoligonucleotide
  source 1..20: mol_type = other DNA
gcgactcgcgcgagtcgcca

SEQ ID NO: 12290 - DNA, 20 bp, synthetic construct
  misc_feature 1..20: note = Description of Artificial Sequence: Syntheticoligonucleotide
  source 1..20: mol_type = other DNA
gcgactcgcgcgagtcgcac

SEQ ID NO: 12291 - DNA, 20 bp, synthetic construct
  misc_feature 1..20: note = Description of Artificial Sequence: Syntheticoligonucleotide
  source 1..20: mol_type = other DNA
gtgactcgcgcgagtcaccc

SEQ ID NO: 12292 - DNA, 20 bp, synthetic construct
  misc_feature 1..20: note = Description of Artificial Sequence: Syntheticoligonucleotide
  source 1..20: mol_type = other DNA
gggactcgcgcgagtcccgt

SEQ ID NO: 12293 - DNA, 20 bp, synthetic construct
  misc_feature 1..20: note = Description of Artificial Sequence: Syntheticoligonucleotide
  source 1..20: mol_type = other DNA
gggactcgcgcgagtccctg

SEQ ID NO: 12294 - DNA, 20 bp, synthetic construct
  misc_feature 1..20: note = Description of Artificial Sequence: Syntheticoligonucleotide
  source 1..20: mol_type = other DNA
aggactcgcgcgagtcctgg

SEQ ID NO: 12295 - DNA, 20 bp, synthetic construct
  misc_feature 1..20: note = Description of Artificial Sequence: Syntheticoligonucleotide
  source 1..20: mol_type = other DNA
gagactcgcgcgagtctcgg

SEQ ID NO: 12296 - DNA, 20 bp, synthetic construct
  misc_feature 1..20: note = Description of Artificial Sequence: Syntheticoligonucleotide
  source 1..20: mol_type = other DNA
gggactcgcgcgagtcccga

SEQ ID NO: 12297 - DNA, 20 bp, synthetic construct
  misc_feature 1..20: note = Description of Artificial Sequence: Syntheticoligonucleotide
  source 1..20: mol_type = other DNA
gggactcgcgcgagtcccag

SEQ ID NO: 12298 - DNA, 20 bp, synthetic construct
  misc_feature 1..20: note = Description of Artificial Sequence: Syntheticoligonucleotide
  source 1..20: mol_type = other DNA
tggactcgcgcgagtccagg

SEQ ID NO: 12299 - DNA, 20 bp, synthetic construct
  misc_feature 1..20: note = Description of Artificial Sequence: Syntheticoligonucleotide
  source 1..20: mol_type = other DNA
gtgactcgcgcgagtcacgg

SEQ ID NO: 12300 - DNA, 20 bp, synthetic construct
  misc_feature 1..20: note = Description of Artificial Sequence: Syntheticoligonucleotide
  source 1..20: mol_type = other DNA
gcgactcgcgcgagtcgccg

SEQ ID NO: 12301 - DNA, 20 bp, synthetic construct
  misc_feature 1..20: note = Description of Artificial Sequence: Syntheticoligonucleotide
  source 1..20: mol_type = other DNA
gcgactcgcgcgagtcgctg

SEQ ID NO: 12302 - DNA, 20 bp, synthetic construct
  misc_feature 1..20: note = Description of Artificial Sequence: Syntheticoligonucleotide
  source 1..20: mol_type = other DNA
acgactcgcgcgagtcgtcg

SEQ ID NO: 12303 - DNA, 20 bp, synthetic construct
  misc_feature 1..20: note = Description of Artificial Sequence: Syntheticoligonucleotide
  source 1..20: mol_type = other DNA
gagactcgcgcgagtctccg

SEQ ID NO: 12304 - DNA, 20 bp, synthetic construct
  misc_feature 1..20: note = Description of Artificial Sequence: Syntheticoligonucleotide
  source 1..20: mol_type = other DNA
gcgactcgcgcgagtcgcag

SEQ ID NO: 12305 - DNA, 20 bp, synthetic construct
  misc_feature 1..20: note = Description of Artificial Sequence: Syntheticoligonucleotide
  source 1..20: mol_type = other DNA
gtgactcgcgcgagtcaccg

SEQ ID NO: 12306 - DNA, 20 bp, synthetic construct
  misc_feature 1..20: note = Description of Artificial Sequence: Syntheticoligonucleotide
  source 1..20: mol_type = other DNA
cggactcgcgcgagtccgtg

SEQ ID NO: 12307 - DNA, 20 bp, synthetic construct
  misc_feature 1..20: note = Description of Artificial Sequence: Syntheticoligonucleotide
  source 1..20: mol_type = other DNA
cagactcgcgcgagtctggg

SEQ ID NO: 12308 - DNA, 20 bp, synthetic construct
  misc_feature 1..20: note = Description of Artificial Sequence: Syntheticoligonucleotide
  source 1..20: mol_type = other DNA
cggactcgcgcgagtccgag

SEQ ID NO: 12309 - DNA, 20 bp, synthetic construct
  misc_feature 1..20: note = Description of Artificial Sequence: Syntheticoligonucleotide
  source 1..20: mol_type = other DNA
ctgactcgcgcgagtcaggg

SEQ ID NO: 12310 - DNA, 20 bp, synthetic construct
  misc_feature 1..20: note = Description of Artificial Sequence: Syntheticoligonucleotide
  source 1..20: mol_type = other DNA
acgactcgcgcgagtcgtgg

SEQ ID NO: 12311 - DNA, 20 bp, synthetic construct
  misc_feature 1..20: note = Description of Artificial Sequence: Syntheticoligonucleotide
  source 1..20: mol_type = other DNA
ccgactcgcgcgagtcggct

SEQ ID NO: 12312 - DNA, 20 bp, synthetic construct
  misc_feature 1..20: note = Description of Artificial Sequence: Syntheticoligonucleotide
  source 1..20: mol_type = other DNA
ccgactcgcgcgagtcggca

SEQ ID NO: 12313 - DNA, 20 bp, synthetic construct
  misc_feature 1..20: note = Description of Artificial Sequence: Syntheticoligonucleotide
  source 1..20: mol_type = other DNA
gagactcgcgcgagtctcgc

SEQ ID NO: 12314 - DNA, 20 bp, synthetic construct
  misc_feature 1..20: note = Description of Artificial Sequence: Syntheticoligonucleotide
  source 1..20: mol_type = other DNA
gtgactcgcgcgagtcacgc

SEQ ID NO: 12315 - DNA, 20 bp, synthetic construct
  misc_feature 1..20: note = Description of Artificial Sequence: Syntheticoligonucleotide
  source 1..20: mol_type = other DNA
aggactcgcgcgagtcctgc

SEQ ID NO: 12316 - DNA, 20 bp, synthetic construct
  misc_feature 1..20: note = Description of Artificial Sequence: Syntheticoligonucleotide
  source 1..20: mol_type = other DNA
tggactcgcgcgagtccagc

SEQ ID NO: 12317 - DNA, 20 bp, synthetic construct
  misc_feature 1..20: note = Description of Artificial Sequence: Syntheticoligonucleotide
  source 1..20: mol_type = other DNA
aggactcgcgcgagtcctcg

SEQ ID NO: 12318 - DNA, 20 bp, synthetic construct
  misc_feature 1..20: note = Description of Artificial Sequence: Syntheticoligonucleotide
  source 1..20: mol_type = other DNA
tggactcgcgcgagtccacg

SEQ ID NO: 12319 - DNA, 20 bp, synthetic construct
  misc_feature 1..20: note = Description of Artificial Sequence: Syntheticoligonucleotide
  source 1..20: mol_type = other DNA
ccgactcgcgcgagtcggtg

SEQ ID NO: 12320 - DNA, 20 bp, synthetic construct
  misc_feature 1..20: note = Description of Artificial Sequence: Syntheticoligonucleotide
  source 1..20: mol_type = other DNA
ccgactcgcgcgagtcggag

SEQ ID NO: 12321 - DNA, 20 bp, synthetic construct
  misc_feature 1..20: note = Description of Artificial Sequence: Syntheticoligonucleotide
  source 1..20: mol_type = other DNA
gggactcgcgcgagtcccgc

SEQ ID NO: 12322 - DNA, 20 bp, synthetic construct
  misc_feature 1..20: note = Description of Artificial Sequence: Syntheticoligonucleotide
  source 1..20: mol_type = other DNA
gggactcgcgcgagtccctc

SEQ ID NO: 12323 - DNA, 20 bp, synthetic construct
  misc_feature 1..20: note = Description of Artificial Sequence: Syntheticoligonucleotide
  source 1..20: mol_type = other DNA
gggactcgcgcgagtcccac

SEQ ID NO: 12324 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactcacgtgagtcnnnn

SEQ ID NO: 12325 - DNA, 20 bp, synthetic construct
  misc_feature 1..20: note = Description of Artificial Sequence: Syntheticoligonucleotide
  source 1..20: mol_type = other DNA
cggactcacgtgagtccgcc

SEQ ID NO: 12326 - DNA, 20 bp, synthetic construct
  misc_feature 1..20: note = Description of Artificial Sequence: Syntheticoligonucleotide
  source 1..20: mol_type = other DNA
cggactcacgtgagtccgct

SEQ ID NO: 12327 - DNA, 20 bp, synthetic construct
  misc_feature 1..20: note = Description of Artificial Sequence: Syntheticoligonucleotide
  source 1..20: mol_type = other DNA
cggactcacgtgagtccgtc

SEQ ID NO: 12328 - DNA, 20 bp, synthetic construct
  misc_feature 1..20: note = Description of Artificial Sequence: Syntheticoligonucleotide
  source 1..20: mol_type = other DNA
aggactcacgtgagtcctcc

SEQ ID NO: 12329 - DNA, 20 bp, synthetic construct
  misc_feature 1..20: note = Description of Artificial Sequence: Syntheticoligonucleotide
  source 1..20: mol_type = other DNA
cagactcacgtgagtctgcc

SEQ ID NO: 12330 - DNA, 20 bp, synthetic construct
  misc_feature 1..20: note = Description of Artificial Sequence: Syntheticoligonucleotide
  source 1..20: mol_type = other DNA
cggactcacgtgagtccgca

SEQ ID NO: 12331 - DNA, 20 bp, synthetic construct
  misc_feature 1..20: note = Description of Artificial Sequence: Syntheticoligonucleotide
  source 1..20: mol_type = other DNA
cggactcacgtgagtccgac

SEQ ID NO: 12332 - DNA, 20 bp, synthetic construct
  misc_feature 1..20: note = Description of Artificial Sequence: Syntheticoligonucleotide
  source 1..20: mol_type = other DNA
tggactcacgtgagtccacc

SEQ ID NO: 12333 - DNA, 20 bp, synthetic construct
  misc_feature 1..20: note = Description of Artificial Sequence: Syntheticoligonucleotide
  source 1..20: mol_type = other DNA
ctgactcacgtgagtcagcc

SEQ ID NO: 12334 - DNA, 20 bp, synthetic construct
  misc_feature 1..20: note = Description of Artificial Sequence: Syntheticoligonucleotide
  source 1..20: mol_type = other DNA
ccgactcacgtgagtcgggc

SEQ ID NO: 12335 - DNA, 20 bp, synthetic construct
  misc_feature 1..20: note = Description of Artificial Sequence: Syntheticoligonucleotide
  source 1..20: mol_type = other DNA
ccgactcacgtgagtcgggt

SEQ ID NO: 12336 - DNA, 20 bp, synthetic construct
  misc_feature 1..20: note = Description of Artificial Sequence: Syntheticoligonucleotide
  source 1..20: mol_type = other DNA
ccgactcacgtgagtcggtc

SEQ ID NO: 12337 - DNA, 20 bp, synthetic construct
  misc_feature 1..20: note = Description of Artificial Sequence: Syntheticoligonucleotide
  source 1..20: mol_type = other DNA
acgactcacgtgagtcgtgc

SEQ ID NO: 12338 - DNA, 20 bp, synthetic construct
  misc_feature 1..20: note = Description of Artificial Sequence: Syntheticoligonucleotide
  source 1..20: mol_type = other DNA
cagactcacgtgagtctggc

SEQ ID NO: 12339 - DNA, 20 bp, synthetic construct
  misc_feature 1..20: note = Description of Artificial Sequence: Syntheticoligonucleotide
  source 1..20: mol_type = other DNA
ccgactcacgtgagtcggga

SEQ ID NO: 12340 - DNA, 20 bp, synthetic construct
  misc_feature 1..20: note = Description of Artificial Sequence: Syntheticoligonucleotide
  source 1..20: mol_type = other DNA
ccgactcacgtgagtcggac

SEQ ID NO: 12341 - DNA, 20 bp, synthetic construct
  misc_feature 1..20: note = Description of Artificial Sequence: Syntheticoligonucleotide
  source 1..20: mol_type = other DNA
ctgactcacgtgagtcaggc

SEQ ID NO: 12342 - DNA, 20 bp, synthetic construct
  misc_feature 1..20: note = Description of Artificial Sequence: Syntheticoligonucleotide
  source 1..20: mol_type = other DNA
gcgactcacgtgagtcgccc

SEQ ID NO: 12343 - DNA, 20 bp, synthetic construct
  misc_feature 1..20: note = Description of Artificial Sequence: Syntheticoligonucleotide
  source 1..20: mol_type = other DNA
gcgactcacgtgagtcgcct

SEQ ID NO: 12344 - DNA, 20 bp, synthetic construct
  misc_feature 1..20: note = Description of Artificial Sequence: Syntheticoligonucleotide
  source 1..20: mol_type = other DNA
gcgactcacgtgagtcgctc

SEQ ID NO: 12345 - DNA, 20 bp, synthetic construct
  misc_feature 1..20: note = Description of Artificial Sequence: Syntheticoligonucleotide
  source 1..20: mol_type = other DNA
acgactcacgtgagtcgtcc

SEQ ID NO: 12346 - DNA, 20 bp, synthetic construct
  misc_feature 1..20: note = Description of Artificial Sequence: Syntheticoligonucleotide
  source 1..20: mol_type = other DNA
gagactcacgtgagtctccc

SEQ ID NO: 12347 - DNA, 20 bp, synthetic construct
  misc_feature 1..20: note = Description of Artificial Sequence: Syntheticoligonucleotide
  source 1..20: mol_type = other DNA
gcgactcacgtgagtcgcca

SEQ ID NO: 12348 - DNA, 20 bp, synthetic construct
  misc_feature 1..20: note = Description of Artificial Sequence: Syntheticoligonucleotide
  source 1..20: mol_type = other DNA
gcgactcacgtgagtcgcac

SEQ ID NO: 12349 - DNA, 20 bp, synthetic construct
  misc_feature 1..20: note = Description of Artificial Sequence: Syntheticoligonucleotide
  source 1..20: mol_type = other DNA
gtgactcacgtgagtcaccc

SEQ ID NO: 12350 - DNA, 20 bp, synthetic construct
  misc_feature 1..20: note = Description of Artificial Sequence: Syntheticoligonucleotide
  source 1..20: mol_type = other DNA
gggactcacgtgagtcccgt

SEQ ID NO: 12351 - DNA, 20 bp, synthetic construct
  misc_feature 1..20: note = Description of Artificial Sequence: Syntheticoligonucleotide
  source 1..20: mol_type = other DNA
gggactcacgtgagtccctg

SEQ ID NO: 12352 - DNA, 20 bp, synthetic construct
  misc_feature 1..20: note = Description of Artificial Sequence: Syntheticoligonucleotide
  source 1..20: mol_type = other DNA
aggactcacgtgagtcctgg

SEQ ID NO: 12353 - DNA, 20 bp, synthetic construct
  misc_feature 1..20: note = Description of Artificial Sequence: Syntheticoligonucleotide
  source 1..20: mol_type = other DNA
gagactcacgtgagtctcgg

SEQ ID NO: 12354 - DNA, 20 bp, synthetic construct
  misc_feature 1..20: note = Description of Artificial Sequence: Syntheticoligonucleotide
  source 1..20: mol_type = other DNA
gggactcacgtgagtcccga

SEQ ID NO: 12355 - DNA, 20 bp, synthetic construct
  misc_feature 1..20: note = Description of Artificial Sequence: Syntheticoligonucleotide
  source 1..20: mol_type = other DNA
gggactcacgtgagtcccag

SEQ ID NO: 12356 - DNA, 20 bp, synthetic construct
  misc_feature 1..20: note = Description of Artificial Sequence: Syntheticoligonucleotide
  source 1..20: mol_type = other DNA
tggactcacgtgagtccagg

SEQ ID NO: 12357 - DNA, 20 bp, synthetic construct
  misc_feature 1..20: note = Description of Artificial Sequence: Syntheticoligonucleotide
  source 1..20: mol_type = other DNA
gtgactcacgtgagtcacgg

SEQ ID NO: 12358 - DNA, 20 bp, synthetic construct
  misc_feature 1..20: note = Description of Artificial Sequence: Syntheticoligonucleotide
  source 1..20: mol_type = other DNA
gcgactcacgtgagtcgccg

SEQ ID NO: 12359 - DNA, 20 bp, synthetic construct
  misc_feature 1..20: note = Description of Artificial Sequence: Syntheticoligonucleotide
  source 1..20: mol_type = other DNA
gcgactcacgtgagtcgctg

SEQ ID NO: 12360 - DNA, 20 bp, synthetic construct
  misc_feature 1..20: note = Description of Artificial Sequence: Syntheticoligonucleotide
  source 1..20: mol_type = other DNA
acgactcacgtgagtcgtcg

SEQ ID NO: 12361 - DNA, 20 bp, synthetic construct
  misc_feature 1..20: note = Description of Artificial Sequence: Syntheticoligonucleotide
  source 1..20: mol_type = other DNA
gagactcacgtgagtctccg

SEQ ID NO: 12362 - DNA, 20 bp, synthetic construct
  misc_feature 1..20: note = Description of Artificial Sequence: Syntheticoligonucleotide
  source 1..20: mol_type = other DNA
gcgactcacgtgagtcgcag

SEQ ID NO: 12363 - DNA, 20 bp, synthetic construct
  misc_feature 1..20: note = Description of Artificial Sequence: Syntheticoligonucleotide
  source 1..20: mol_type = other DNA
gtgactcacgtgagtcaccg

SEQ ID NO: 12364 - DNA, 20 bp, synthetic construct
  misc_feature 1..20: note = Description of Artificial Sequence: Syntheticoligonucleotide
  source 1..20: mol_type = other DNA
cggactcacgtgagtccgtg

SEQ ID NO: 12365 - DNA, 20 bp, synthetic construct
  misc_feature 1..20: note = Description of Artificial Sequence: Syntheticoligonucleotide
  source 1..20: mol_type = other DNA
cagactcacgtgagtctggg

SEQ ID NO: 12366 - DNA, 20 bp, synthetic construct
  misc_feature 1..20: note = Description of Artificial Sequence: Syntheticoligonucleotide
  source 1..20: mol_type = other DNA
cggactcacgtgagtccgag

SEQ ID NO: 12367 - DNA, 20 bp, synthetic construct
  misc_feature 1..20: note = Description of Artificial Sequence: Syntheticoligonucleotide
  source 1..20: mol_type = other DNA
ctgactcacgtgagtcaggg

SEQ ID NO: 12368 - DNA, 20 bp, synthetic construct
  misc_feature 1..20: note = Description of Artificial Sequence: Syntheticoligonucleotide
  source 1..20: mol_type = other DNA
acgactcacgtgagtcgtgg

SEQ ID NO: 12369 - DNA, 20 bp, synthetic construct
  misc_feature 1..20: note = Description of Artificial Sequence: Syntheticoligonucleotide
  source 1..20: mol_type = other DNA
ccgactcacgtgagtcggct

SEQ ID NO: 12370 - DNA, 20 bp, synthetic construct
  misc_feature 1..20: note = Description of Artificial Sequence: Syntheticoligonucleotide
  source 1..20: mol_type = other DNA
ccgactcacgtgagtcggca

SEQ ID NO: 12371 - DNA, 20 bp, synthetic construct
  misc_feature 1..20: note = Description of Artificial Sequence: Syntheticoligonucleotide
  source 1..20: mol_type = other DNA
gagactcacgtgagtctcgc

SEQ ID NO: 12372 - DNA, 20 bp, synthetic construct
  misc_feature 1..20: note = Description of Artificial Sequence: Syntheticoligonucleotide
  source 1..20: mol_type = other DNA
gtgactcacgtgagtcacgc

SEQ ID NO: 12373 - DNA, 20 bp, synthetic construct
  misc_feature 1..20: note = Description of Artificial Sequence: Syntheticoligonucleotide
  source 1..20: mol_type = other DNA
aggactcacgtgagtcctgc

SEQ ID NO: 12374 - DNA, 20 bp, synthetic construct
  misc_feature 1..20: note = Description of Artificial Sequence: Syntheticoligonucleotide
  source 1..20: mol_type = other DNA
tggactcacgtgagtccagc

SEQ ID NO: 12375 - DNA, 20 bp, synthetic construct
  misc_feature 1..20: note = Description of Artificial Sequence: Syntheticoligonucleotide
  source 1..20: mol_type = other DNA
aggactcacgtgagtcctcg

SEQ ID NO: 12376 - DNA, 20 bp, synthetic construct
  misc_feature 1..20: note = Description of Artificial Sequence: Syntheticoligonucleotide
  source 1..20: mol_type = other DNA
tggactcacgtgagtccacg

SEQ ID NO: 12377 - DNA, 20 bp, synthetic construct
  misc_feature 1..20: note = Description of Artificial Sequence: Syntheticoligonucleotide
  source 1..20: mol_type = other DNA
ccgactcacgtgagtcggtg

SEQ ID NO: 12378 - DNA, 20 bp, synthetic construct
  misc_feature 1..20: note = Description of Artificial Sequence: Syntheticoligonucleotide
  source 1..20: mol_type = other DNA
ccgactcacgtgagtcggag

SEQ ID NO: 12379 - DNA, 20 bp, synthetic construct
  misc_feature 1..20: note = Description of Artificial Sequence: Syntheticoligonucleotide
  source 1..20: mol_type = other DNA
gggactcacgtgagtcccgc

SEQ ID NO: 12380 - DNA, 20 bp, synthetic construct
  misc_feature 1..20: note = Description of Artificial Sequence: Syntheticoligonucleotide
  source 1..20: mol_type = other DNA
gggactcacgtgagtccctc

SEQ ID NO: 12381 - DNA, 20 bp, synthetic construct
  misc_feature 1..20: note = Description of Artificial Sequence: Syntheticoligonucleotide
  source 1..20: mol_type = other DNA
gggactcacgtgagtcccac

SEQ ID NO: 12382 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactcggccgagtcnnnn

SEQ ID NO: 12383 - DNA, 20 bp, synthetic construct
  misc_feature 1..20: note = Description of Artificial Sequence: Syntheticoligonucleotide
  source 1..20: mol_type = other DNA
cggactcggccgagtccgcc

SEQ ID NO: 12384 - DNA, 20 bp, synthetic construct
  misc_feature 1..20: note = Description of Artificial Sequence: Syntheticoligonucleotide
  source 1..20: mol_type = other DNA
cggactcggccgagtccgct

SEQ ID NO: 12385 - DNA, 20 bp, synthetic construct
  misc_feature 1..20: note = Description of Artificial Sequence: Syntheticoligonucleotide
  source 1..20: mol_type = other DNA
cggactcggccgagtccgtc

SEQ ID NO: 12386 - DNA, 20 bp, synthetic construct
  misc_feature 1..20: note = Description of Artificial Sequence: Syntheticoligonucleotide
  source 1..20: mol_type = other DNA
aggactcggccgagtcctcc

SEQ ID NO: 12387 - DNA, 20 bp, synthetic construct
  misc_feature 1..20: note = Description of Artificial Sequence: Syntheticoligonucleotide
  source 1..20: mol_type = other DNA
cagactcggccgagtctgcc

SEQ ID NO: 12388 - DNA, 20 bp, synthetic construct
  misc_feature 1..20: note = Description of Artificial Sequence: Syntheticoligonucleotide
  source 1..20: mol_type = other DNA
cggactcggccgagtccgca

SEQ ID NO: 12389 - DNA, 20 bp, synthetic construct
  misc_feature 1..20: note = Description of Artificial Sequence: Syntheticoligonucleotide
  source 1..20: mol_type = other DNA
cggactcggccgagtccgac

SEQ ID NO: 12390 - DNA, 20 bp, synthetic construct
  misc_feature 1..20: note = Description of Artificial Sequence: Syntheticoligonucleotide
  source 1..20: mol_type = other DNA
tggactcggccgagtccacc

SEQ ID NO: 12391 - DNA, 20 bp, synthetic construct
  misc_feature 1..20: note = Description of Artificial Sequence: Syntheticoligonucleotide
  source 1..20: mol_type = other DNA
ctgactcggccgagtcagcc

SEQ ID NO: 12392 - DNA, 20 bp, synthetic construct
  misc_feature 1..20: note = Description of Artificial Sequence: Syntheticoligonucleotide
  source 1..20: mol_type = other DNA
ccgactcggccgagtcgggc

SEQ ID NO: 12393 - DNA, 20 bp, synthetic construct
  misc_feature 1..20: note = Description of Artificial Sequence: Syntheticoligonucleotide
  source 1..20: mol_type = other DNA
ccgactcggccgagtcgggt

SEQ ID NO: 12394 - DNA, 20 bp, synthetic construct
  misc_feature 1..20: note = Description of Artificial Sequence: Syntheticoligonucleotide
  source 1..20: mol_type = other DNA
ccgactcggccgagtcggtc

SEQ ID NO: 12395 - DNA, 20 bp, synthetic construct
  misc_feature 1..20: note = Description of Artificial Sequence: Syntheticoligonucleotide
  source 1..20: mol_type = other DNA
acgactcggccgagtcgtgc

SEQ ID NO: 12396 - DNA, 20 bp, synthetic construct
  misc_feature 1..20: note = Description of Artificial Sequence: Syntheticoligonucleotide
  source 1..20: mol_type = other DNA
cagactcggccgagtctggc

SEQ ID NO: 12397 - DNA, 20 bp, synthetic construct
  misc_feature 1..20: note = Description of Artificial Sequence: Syntheticoligonucleotide
  source 1..20: mol_type = other DNA
ccgactcggccgagtcggga

SEQ ID NO: 12398 - DNA, 20 bp, synthetic construct
  misc_feature 1..20: note = Description of Artificial Sequence: Syntheticoligonucleotide
  source 1..20: mol_type = other DNA
ccgactcggccgagtcggac

SEQ ID NO: 12399 - DNA, 20 bp, synthetic construct
  misc_feature 1..20: note = Description of Artificial Sequence: Syntheticoligonucleotide
  source 1..20: mol_type = other DNA
ctgactcggccgagtcaggc

SEQ ID NO: 12400 - DNA, 20 bp, synthetic construct
  misc_feature 1..20: note = Description of Artificial Sequence: Syntheticoligonucleotide
  source 1..20: mol_type = other DNA
gcgactcggccgagtcgccc

SEQ ID NO: 12401 - DNA, 20 bp, synthetic construct
  misc_feature 1..20: note = Description of Artificial Sequence: Syntheticoligonucleotide
  source 1..20: mol_type = other DNA
gcgactcggccgagtcgcct

SEQ ID NO: 12402 - DNA, 20 bp, synthetic construct
  misc_feature 1..20: note = Description of Artificial Sequence: Syntheticoligonucleotide
  source 1..20: mol_type = other DNA
gcgactcggccgagtcgctc

SEQ ID NO: 12403 - DNA, 20 bp, synthetic construct
  misc_feature 1..20: note = Description of Artificial Sequence: Syntheticoligonucleotide
  source 1..20: mol_type = other DNA
acgactcggccgagtcgtcc

SEQ ID NO: 12404 - DNA, 20 bp, synthetic construct
  misc_feature 1..20: note = Description of Artificial Sequence: Syntheticoligonucleotide
  source 1..20: mol_type = other DNA
gagactcggccgagtctccc

SEQ ID NO: 12405 - DNA, 20 bp, synthetic construct
  misc_feature 1..20: note = Description of Artificial Sequence: Syntheticoligonucleotide
  source 1..20: mol_type = other DNA
gcgactcggccgagtcgcca

SEQ ID NO: 12406 - DNA, 20 bp, synthetic construct
  misc_feature 1..20: note = Description of Artificial Sequence: Syntheticoligonucleotide
  source 1..20: mol_type = other DNA
gcgactcggccgagtcgcac

SEQ ID NO: 12407 - DNA, 20 bp, synthetic construct
  misc_feature 1..20: note = Description of Artificial Sequence: Syntheticoligonucleotide
  source 1..20: mol_type = other DNA
gtgactcggccgagtcaccc

SEQ ID NO: 12408 - DNA, 20 bp, synthetic construct
  misc_feature 1..20: note = Description of Artificial Sequence: Syntheticoligonucleotide
  source 1..20: mol_type = other DNA
gggactcggccgagtcccgt

SEQ ID NO: 12409 - DNA, 20 bp, synthetic construct
  misc_feature 1..20: note = Description of Artificial Sequence: Syntheticoligonucleotide
  source 1..20: mol_type = other DNA
gggactcggccgagtccctg

SEQ ID NO: 12410 - DNA, 20 bp, synthetic construct
  misc_feature 1..20: note = Description of Artificial Sequence: Syntheticoligonucleotide
  source 1..20: mol_type = other DNA
aggactcggccgagtcctgg

SEQ ID NO: 12411 - DNA, 20 bp, synthetic construct
  misc_feature 1..20: note = Description of Artificial Sequence: Syntheticoligonucleotide
  source 1..20: mol_type = other DNA
gagactcggccgagtctcgg

SEQ ID NO: 12412 - DNA, 20 bp, synthetic construct
  misc_feature 1..20: note = Description of Artificial Sequence: Syntheticoligonucleotide
  source 1..20: mol_type = other DNA
gggactcggccgagtcccga

SEQ ID NO: 12413 - DNA, 20 bp, synthetic construct
  misc_feature 1..20: note = Description of Artificial Sequence: Syntheticoligonucleotide
  source 1..20: mol_type = other DNA
gggactcggccgagtcccag

SEQ ID NO: 12414 - DNA, 20 bp, synthetic construct
  misc_feature 1..20: note = Description of Artificial Sequence: Syntheticoligonucleotide
  source 1..20: mol_type = other DNA
tggactcggccgagtccagg

SEQ ID NO: 12415 - DNA, 20 bp, synthetic construct
  misc_feature 1..20: note = Description of Artificial Sequence: Syntheticoligonucleotide
  source 1..20: mol_type = other DNA
gtgactcggccgagtcacgg

SEQ ID NO: 12416 - DNA, 20 bp, synthetic construct
  misc_feature 1..20: note = Description of Artificial Sequence: Syntheticoligonucleotide
  source 1..20: mol_type = other DNA
gcgactcggccgagtcgccg

SEQ ID NO: 12417 - DNA, 20 bp, synthetic construct
  misc_feature 1..20: note = Description of Artificial Sequence: Syntheticoligonucleotide
  source 1..20: mol_type = other DNA
gcgactcggccgagtcgctg

SEQ ID NO: 12418 - DNA, 20 bp, synthetic construct
  misc_feature 1..20: note = Description of Artificial Sequence: Syntheticoligonucleotide
  source 1..20: mol_type = other DNA
acgactcggccgagtcgtcg

SEQ ID NO: 12419 - DNA, 20 bp, synthetic construct
  misc_feature 1..20: note = Description of Artificial Sequence: Syntheticoligonucleotide
  source 1..20: mol_type = other DNA
gagactcggccgagtctccg

SEQ ID NO: 12420 - DNA, 20 bp, synthetic construct
  misc_feature 1..20: note = Description of Artificial Sequence: Syntheticoligonucleotide
  source 1..20: mol_type = other DNA
gcgactcggccgagtcgcag

SEQ ID NO: 12421 - DNA, 20 bp, synthetic construct
  misc_feature 1..20: note = Description of Artificial Sequence: Syntheticoligonucleotide
  source 1..20: mol_type = other DNA
gtgactcggccgagtcaccg

SEQ ID NO: 12422 - DNA, 20 bp, synthetic construct
  misc_feature 1..20: note = Description of Artificial Sequence: Syntheticoligonucleotide
  source 1..20: mol_type = other DNA
cggactcggccgagtccgtg

SEQ ID NO: 12423 - DNA, 20 bp, synthetic construct
  misc_feature 1..20: note = Description of Artificial Sequence: Syntheticoligonucleotide
  source 1..20: mol_type = other DNA
cagactcggccgagtctggg

SEQ ID NO: 12424 - DNA, 20 bp, synthetic construct
  misc_feature 1..20: note = Description of Artificial Sequence: Syntheticoligonucleotide
  source 1..20: mol_type = other DNA
cggactcggccgagtccgag

SEQ ID NO: 12425 - DNA, 20 bp, synthetic construct
  misc_feature 1..20: note = Description of Artificial Sequence: Syntheticoligonucleotide
  source 1..20: mol_type = other DNA
ctgactcggccgagtcaggg

SEQ ID NO: 12426 - DNA, 20 bp, synthetic construct
  misc_feature 1..20: note = Description of Artificial Sequence: Syntheticoligonucleotide
  source 1..20: mol_type = other DNA
acgactcggccgagtcgtgg

SEQ ID NO: 12427 - DNA, 20 bp, synthetic construct
  misc_feature 1..20: note = Description of Artificial Sequence: Syntheticoligonucleotide
  source 1..20: mol_type = other DNA
ccgactcggccgagtcggct

SEQ ID NO: 12428 - DNA, 20 bp, synthetic construct
  misc_feature 1..20: note = Description of Artificial Sequence: Syntheticoligonucleotide
  source 1..20: mol_type = other DNA
ccgactcggccgagtcggca

SEQ ID NO: 12429 - DNA, 20 bp, synthetic construct
  misc_feature 1..20: note = Description of Artificial Sequence: Syntheticoligonucleotide
  source 1..20: mol_type = other DNA
gagactcggccgagtctcgc

SEQ ID NO: 12430 - DNA, 20 bp, synthetic construct
  misc_feature 1..20: note = Description of Artificial Sequence: Syntheticoligonucleotide
  source 1..20: mol_type = other DNA
gtgactcggccgagtcacgc

SEQ ID NO: 12431 - DNA, 20 bp, synthetic construct
  misc_feature 1..20: note = Description of Artificial Sequence: Syntheticoligonucleotide
  source 1..20: mol_type = other DNA
aggactcggccgagtcctgc

SEQ ID NO: 12432 - DNA, 20 bp, synthetic construct
  misc_feature 1..20: note = Description of Artificial Sequence: Syntheticoligonucleotide
  source 1..20: mol_type = other DNA
tggactcggccgagtccagc

SEQ ID NO: 12433 - DNA, 20 bp, synthetic construct
  misc_feature 1..20: note = Description of Artificial Sequence: Syntheticoligonucleotide
  source 1..20: mol_type = other DNA
aggactcggccgagtcctcg

SEQ ID NO: 12434 - DNA, 20 bp, synthetic construct
  misc_feature 1..20: note = Description of Artificial Sequence: Syntheticoligonucleotide
  source 1..20: mol_type = other DNA
tggactcggccgagtccacg

SEQ ID NO: 12435 - DNA, 20 bp, synthetic construct
  misc_feature 1..20: note = Description of Artificial Sequence: Syntheticoligonucleotide
  source 1..20: mol_type = other DNA
ccgactcggccgagtcggtg

SEQ ID NO: 12436 - DNA, 20 bp, synthetic construct
  misc_feature 1..20: note = Description of Artificial Sequence: Syntheticoligonucleotide
  source 1..20: mol_type = other DNA
ccgactcggccgagtcggag

SEQ ID NO: 12437 - DNA, 20 bp, synthetic construct
  misc_feature 1..20: note = Description of Artificial Sequence: Syntheticoligonucleotide
  source 1..20: mol_type = other DNA
gggactcggccgagtcccgc

SEQ ID NO: 12438 - DNA, 20 bp, synthetic construct
  misc_feature 1..20: note = Description of Artificial Sequence: Syntheticoligonucleotide
  source 1..20: mol_type = other DNA
gggactcggccgagtccctc

SEQ ID NO: 12439 - DNA, 20 bp, synthetic construct
  misc_feature 1..20: note = Description of Artificial Sequence: Syntheticoligonucleotide
  source 1..20: mol_type = other DNA
gggactcggccgagtcccac

SEQ ID NO: 12440 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactcccgggagtcnnnn

SEQ ID NO: 12441 - DNA, 20 bp, synthetic construct
  misc_feature 1..20: note = Description of Artificial Sequence: Syntheticoligonucleotide
  source 1..20: mol_type = other DNA
cggactcccgggagtccgcc

SEQ ID NO: 12442 - DNA, 20 bp, synthetic construct
  misc_feature 1..20: note = Description of Artificial Sequence: Syntheticoligonucleotide
  source 1..20: mol_type = other DNA
cggactcccgggagtccgct

SEQ ID NO: 12443 - DNA, 20 bp, synthetic construct
  misc_feature 1..20: note = Description of Artificial Sequence: Syntheticoligonucleotide
  source 1..20: mol_type = other DNA
cggactcccgggagtccgtc

SEQ ID NO: 12444 - DNA, 20 bp, synthetic construct
  misc_feature 1..20: note = Description of Artificial Sequence: Syntheticoligonucleotide
  source 1..20: mol_type = other DNA
aggactcccgggagtcctcc

SEQ ID NO: 12445 - DNA, 20 bp, synthetic construct
  misc_feature 1..20: note = Description of Artificial Sequence: Syntheticoligonucleotide
  source 1..20: mol_type = other DNA
cagactcccgggagtctgcc

SEQ ID NO: 12446 - DNA, 20 bp, synthetic construct
  misc_feature 1..20: note = Description of Artificial Sequence: Syntheticoligonucleotide
  source 1..20: mol_type = other DNA
cggactcccgggagtccgca

SEQ ID NO: 12447 - DNA, 20 bp, synthetic construct
  misc_feature 1..20: note = Description of Artificial Sequence: Syntheticoligonucleotide
  source 1..20: mol_type = other DNA
cggactcccgggagtccgac

SEQ ID NO: 12448 - DNA, 20 bp, synthetic construct
  misc_feature 1..20: note = Description of Artificial Sequence: Syntheticoligonucleotide
  source 1..20: mol_type = other DNA
tggactcccgggagtccacc

SEQ ID NO: 12449 - DNA, 20 bp, synthetic construct
  misc_feature 1..20: note = Description of Artificial Sequence: Syntheticoligonucleotide
  source 1..20: mol_type = other DNA
ctgactcccgggagtcagcc

SEQ ID NO: 12450 - DNA, 20 bp, synthetic construct
  misc_feature 1..20: note = Description of Artificial Sequence: Syntheticoligonucleotide
  source 1..20: mol_type = other DNA
ccgactcccgggagtcgggc

SEQ ID NO: 12451 - DNA, 20 bp, synthetic construct
  misc_feature 1..20: note = Description of Artificial Sequence: Syntheticoligonucleotide
  source 1..20: mol_type = other DNA
ccgactcccgggagtcgggt

SEQ ID NO: 12452 - DNA, 20 bp, synthetic construct
  misc_feature 1..20: note = Description of Artificial Sequence: Syntheticoligonucleotide
  source 1..20: mol_type = other DNA
ccgactcccgggagtcggtc

SEQ ID NO: 12453 - DNA, 20 bp, synthetic construct
  misc_feature 1..20: note = Description of Artificial Sequence: Syntheticoligonucleotide
  source 1..20: mol_type = other DNA
acgactcccgggagtcgtgc

SEQ ID NO: 12454 - DNA, 20 bp, synthetic construct
  misc_feature 1..20: note = Description of Artificial Sequence: Syntheticoligonucleotide
  source 1..20: mol_type = other DNA
cagactcccgggagtctggc

SEQ ID NO: 12455 - DNA, 20 bp, synthetic construct
  misc_feature 1..20: note = Description of Artificial Sequence: Syntheticoligonucleotide
  source 1..20: mol_type = other DNA
ccgactcccgggagtcggga

SEQ ID NO: 12456 - DNA, 20 bp, synthetic construct
  misc_feature 1..20: note = Description of Artificial Sequence: Syntheticoligonucleotide
  source 1..20: mol_type = other DNA
ccgactcccgggagtcggac

SEQ ID NO: 12457 - DNA, 20 bp, synthetic construct
  misc_feature 1..20: note = Description of Artificial Sequence: Syntheticoligonucleotide
  source 1..20: mol_type = other DNA
ctgactcccgggagtcaggc

SEQ ID NO: 12458 - DNA, 20 bp, synthetic construct
  misc_feature 1..20: note = Description of Artificial Sequence: Syntheticoligonucleotide
  source 1..20: mol_type = other DNA
gcgactcccgggagtcgccc

SEQ ID NO: 12459 - DNA, 20 bp, synthetic construct
  misc_feature 1..20: note = Description of Artificial Sequence: Syntheticoligonucleotide
  source 1..20: mol_type = other DNA
gcgactcccgggagtcgcct

SEQ ID NO: 12460 - DNA, 20 bp, synthetic construct
  misc_feature 1..20: note = Description of Artificial Sequence: Syntheticoligonucleotide
  source 1..20: mol_type = other DNA
gcgactcccgggagtcgctc

SEQ ID NO: 12461 - DNA, 20 bp, synthetic construct
  misc_feature 1..20: note = Description of Artificial Sequence: Syntheticoligonucleotide
  source 1..20: mol_type = other DNA
acgactcccgggagtcgtcc

SEQ ID NO: 12462 - DNA, 20 bp, synthetic construct
  misc_feature 1..20: note = Description of Artificial Sequence: Syntheticoligonucleotide
  source 1..20: mol_type = other DNA
gagactcccgggagtctccc

SEQ ID NO: 12463 - DNA, 20 bp, synthetic construct
  misc_feature 1..20: note = Description of Artificial Sequence: Syntheticoligonucleotide
  source 1..20: mol_type = other DNA
gcgactcccgggagtcgcca

SEQ ID NO: 12464 - DNA, 20 bp, synthetic construct
  misc_feature 1..20: note = Description of Artificial Sequence: Syntheticoligonucleotide
  source 1..20: mol_type = other DNA
gcgactcccgggagtcgcac

SEQ ID NO: 12465 - DNA, 20 bp, synthetic construct
  misc_feature 1..20: note = Description of Artificial Sequence: Syntheticoligonucleotide
  source 1..20: mol_type = other DNA
gtgactcccgggagtcaccc

SEQ ID NO: 12466 - DNA, 20 bp, synthetic construct
  misc_feature 1..20: note = Description of Artificial Sequence: Syntheticoligonucleotide
  source 1..20: mol_type = other DNA
gggactcccgggagtcccgt

SEQ ID NO: 12467 - DNA, 20 bp, synthetic construct
  misc_feature 1..20: note = Description of Artificial Sequence: Syntheticoligonucleotide
  source 1..20: mol_type = other DNA
gggactcccgggagtccctg

SEQ ID NO: 12468 - DNA, 20 bp, synthetic construct
  misc_feature 1..20: note = Description of Artificial Sequence: Syntheticoligonucleotide
  source 1..20: mol_type = other DNA
aggactcccgggagtcctgg

SEQ ID NO: 12469 - DNA, 20 bp, synthetic construct
  misc_feature 1..20: note = Description of Artificial Sequence: Syntheticoligonucleotide
  source 1..20: mol_type = other DNA
gagactcccgggagtctcgg

SEQ ID NO: 12470 - DNA, 20 bp, synthetic construct
  misc_feature 1..20: note = Description of Artificial Sequence: Syntheticoligonucleotide
  source 1..20: mol_type = other DNA
gggactcccgggagtcccga

SEQ ID NO: 12471 - DNA, 20 bp, synthetic construct
  misc_feature 1..20: note = Description of Artificial Sequence: Syntheticoligonucleotide
  source 1..20: mol_type = other DNA
gggactcccgggagtcccag

SEQ ID NO: 12472 - DNA, 20 bp, synthetic construct
  misc_feature 1..20: note = Description of Artificial Sequence: Syntheticoligonucleotide
  source 1..20: mol_type = other DNA
tggactcccgggagtccagg

SEQ ID NO: 12473 - DNA, 20 bp, synthetic construct
  misc_feature 1..20: note = Description of Artificial Sequence: Syntheticoligonucleotide
  source 1..20: mol_type = other DNA
gtgactcccgggagtcacgg

SEQ ID NO: 12474 - DNA, 20 bp, synthetic construct
  misc_feature 1..20: note = Description of Artificial Sequence: Syntheticoligonucleotide
  source 1..20: mol_type = other DNA
gcgactcccgggagtcgccg

SEQ ID NO: 12475 - DNA, 20 bp, synthetic construct
  misc_feature 1..20: note = Description of Artificial Sequence: Syntheticoligonucleotide
  source 1..20: mol_type = other DNA
gcgactcccgggagtcgctg

SEQ ID NO: 12476 - DNA, 20 bp, synthetic construct
  misc_feature 1..20: note = Description of Artificial Sequence: Syntheticoligonucleotide
  source 1..20: mol_type = other DNA
acgactcccgggagtcgtcg

SEQ ID NO: 12477 - DNA, 20 bp, synthetic construct
  misc_feature 1..20: note = Description of Artificial Sequence: Syntheticoligonucleotide
  source 1..20: mol_type = other DNA
gagactcccgggagtctccg

SEQ ID NO: 12478 - DNA, 20 bp, synthetic construct
  misc_feature 1..20: note = Description of Artificial Sequence: Syntheticoligonucleotide
  source 1..20: mol_type = other DNA
gcgactcccgggagtcgcag

SEQ ID NO: 12479 - DNA, 20 bp, synthetic construct
  misc_feature 1..20: note = Description of Artificial Sequence: Syntheticoligonucleotide
  source 1..20: mol_type = other DNA
gtgactcccgggagtcaccg

SEQ ID NO: 12480 - DNA, 20 bp, synthetic construct
  misc_feature 1..20: note = Description of Artificial Sequence: Syntheticoligonucleotide
  source 1..20: mol_type = other DNA
cggactcccgggagtccgtg

SEQ ID NO: 12481 - DNA, 20 bp, synthetic construct
  misc_feature 1..20: note = Description of Artificial Sequence: Syntheticoligonucleotide
  source 1..20: mol_type = other DNA
cagactcccgggagtctggg

SEQ ID NO: 12482 - DNA, 20 bp, synthetic construct
  misc_feature 1..20: note = Description of Artificial Sequence: Syntheticoligonucleotide
  source 1..20: mol_type = other DNA
cggactcccgggagtccgag

SEQ ID NO: 12483 - DNA, 20 bp, synthetic construct
  misc_feature 1..20: note = Description of Artificial Sequence: Syntheticoligonucleotide
  source 1..20: mol_type = other DNA
ctgactcccgggagtcaggg

SEQ ID NO: 12484 - DNA, 20 bp, synthetic construct
  misc_feature 1..20: note = Description of Artificial Sequence: Syntheticoligonucleotide
  source 1..20: mol_type = other DNA
acgactcccgggagtcgtgg

SEQ ID NO: 12485 - DNA, 20 bp, synthetic construct
  misc_feature 1..20: note = Description of Artificial Sequence: Syntheticoligonucleotide
  source 1..20: mol_type = other DNA
ccgactcccgggagtcggct

SEQ ID NO: 12486 - DNA, 20 bp, synthetic construct
  misc_feature 1..20: note = Description of Artificial Sequence: Syntheticoligonucleotide
  source 1..20: mol_type = other DNA
ccgactcccgggagtcggca

SEQ ID NO: 12487 - DNA, 20 bp, synthetic construct
  misc_feature 1..20: note = Description of Artificial Sequence: Syntheticoligonucleotide
  source 1..20: mol_type = other DNA
gagactcccgggagtctcgc

SEQ ID NO: 12488 - DNA, 20 bp, synthetic construct
  misc_feature 1..20: note = Description of Artificial Sequence: Syntheticoligonucleotide
  source 1..20: mol_type = other DNA
gtgactcccgggagtcacgc

SEQ ID NO: 12489 - DNA, 20 bp, synthetic construct
  misc_feature 1..20: note = Description of Artificial Sequence: Syntheticoligonucleotide
  source 1..20: mol_type = other DNA
aggactcccgggagtcctgc

SEQ ID NO: 12490 - DNA, 20 bp, synthetic construct
  misc_feature 1..20: note = Description of Artificial Sequence: Syntheticoligonucleotide
  source 1..20: mol_type = other DNA
tggactcccgggagtccagc

SEQ ID NO: 12491 - DNA, 20 bp, synthetic construct
  misc_feature 1..20: note = Description of Artificial Sequence: Syntheticoligonucleotide
  source 1..20: mol_type = other DNA
aggactcccgggagtcctcg

SEQ ID NO: 12492 - DNA, 20 bp, synthetic construct
  misc_feature 1..20: note = Description of Artificial Sequence: Syntheticoligonucleotide
  source 1..20: mol_type = other DNA
tggactcccgggagtccacg

SEQ ID NO: 12493 - DNA, 20 bp, synthetic construct
  misc_feature 1..20: note = Description of Artificial Sequence: Syntheticoligonucleotide
  source 1..20: mol_type = other DNA
ccgactcccgggagtcggtg

SEQ ID NO: 12494 - DNA, 20 bp, synthetic construct
  misc_feature 1..20: note = Description of Artificial Sequence: Syntheticoligonucleotide
  source 1..20: mol_type = other DNA
ccgactcccgggagtcggag

SEQ ID NO: 12495 - DNA, 20 bp, synthetic construct
  misc_feature 1..20: note = Description of Artificial Sequence: Syntheticoligonucleotide
  source 1..20: mol_type = other DNA
gggactcccgggagtcccgc

SEQ ID NO: 12496 - DNA, 20 bp, synthetic construct
  misc_feature 1..20: note = Description of Artificial Sequence: Syntheticoligonucleotide
  source 1..20: mol_type = other DNA
gggactcccgggagtccctc

SEQ ID NO: 12497 - DNA, 20 bp, synthetic construct
  misc_feature 1..20: note = Description of Artificial Sequence: Syntheticoligonucleotide
  source 1..20: mol_type = other DNA
gggactcccgggagtcccac

SEQ ID NO: 12498 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactcgtacgagtcnnnn

SEQ ID NO: 12499 - DNA, 20 bp, synthetic construct
  misc_feature 1..20: note = Description of Artificial Sequence: Syntheticoligonucleotide
  source 1..20: mol_type = other DNA
cggactcgtacgagtccgcc

SEQ ID NO: 12500 - DNA, 20 bp, synthetic construct
  misc_feature 1..20: note = Description of Artificial Sequence: Syntheticoligonucleotide
  source 1..20: mol_type = other DNA
cggactcgtacgagtccgct

SEQ ID NO: 12501 - DNA, 20 bp, synthetic construct
  misc_feature 1..20: note = Description of Artificial Sequence: Syntheticoligonucleotide
  source 1..20: mol_type = other DNA
cggactcgtacgagtccgtc

SEQ ID NO: 12502 - DNA, 20 bp, synthetic construct
  misc_feature 1..20: note = Description of Artificial Sequence: Syntheticoligonucleotide
  source 1..20: mol_type = other DNA
aggactcgtacgagtcctcc

SEQ ID NO: 12503 - DNA, 20 bp, synthetic construct
  misc_feature 1..20: note = Description of Artificial Sequence: Syntheticoligonucleotide
  source 1..20: mol_type = other DNA
cagactcgtacgagtctgcc

SEQ ID NO: 12504 - DNA, 20 bp, synthetic construct
  misc_feature 1..20: note = Description of Artificial Sequence: Syntheticoligonucleotide
  source 1..20: mol_type = other DNA
cggactcgtacgagtccgca

SEQ ID NO: 12505 - DNA, 20 bp, synthetic construct
  misc_feature 1..20: note = Description of Artificial Sequence: Syntheticoligonucleotide
  source 1..20: mol_type = other DNA
cggactcgtacgagtccgac

SEQ ID NO: 12506 - DNA, 20 bp, synthetic construct
  misc_feature 1..20: note = Description of Artificial Sequence: Syntheticoligonucleotide
  source 1..20: mol_type = other DNA
tggactcgtacgagtccacc

SEQ ID NO: 12507 - DNA, 20 bp, synthetic construct
  misc_feature 1..20: note = Description of Artificial Sequence: Syntheticoligonucleotide
  source 1..20: mol_type = other DNA
ctgactcgtacgagtcagcc

SEQ ID NO: 12508 - DNA, 20 bp, synthetic construct
  misc_feature 1..20: note = Description of Artificial Sequence: Syntheticoligonucleotide
  source 1..20: mol_type = other DNA
ccgactcgtacgagtcgggc

SEQ ID NO: 12509 - DNA, 20 bp, synthetic construct
  misc_feature 1..20: note = Description of Artificial Sequence: Syntheticoligonucleotide
  source 1..20: mol_type = other DNA
ccgactcgtacgagtcgggt

SEQ ID NO: 12510 - DNA, 20 bp, synthetic construct
  misc_feature 1..20: note = Description of Artificial Sequence: Syntheticoligonucleotide
  source 1..20: mol_type = other DNA
ccgactcgtacgagtcggtc

SEQ ID NO: 12511 - DNA, 20 bp, synthetic construct
  misc_feature 1..20: note = Description of Artificial Sequence: Syntheticoligonucleotide
  source 1..20: mol_type = other DNA
acgactcgtacgagtcgtgc

SEQ ID NO: 12512 - DNA, 20 bp, synthetic construct
  misc_feature 1..20: note = Description of Artificial Sequence: Syntheticoligonucleotide
  source 1..20: mol_type = other DNA
cagactcgtacgagtctggc

SEQ ID NO: 12513 - DNA, 20 bp, synthetic construct
  misc_feature 1..20: note = Description of Artificial Sequence: Syntheticoligonucleotide
  source 1..20: mol_type = other DNA
ccgactcgtacgagtcggga

SEQ ID NO: 12514 - DNA, 20 bp, synthetic construct
  misc_feature 1..20: note = Description of Artificial Sequence: Syntheticoligonucleotide
  source 1..20: mol_type = other DNA
ccgactcgtacgagtcggac

SEQ ID NO: 12515 - DNA, 20 bp, synthetic construct
  misc_feature 1..20: note = Description of Artificial Sequence: Syntheticoligonucleotide
  source 1..20: mol_type = other DNA
ctgactcgtacgagtcaggc

SEQ ID NO: 12516 - DNA, 20 bp, synthetic construct
  misc_feature 1..20: note = Description of Artificial Sequence: Syntheticoligonucleotide
  source 1..20: mol_type = other DNA
gcgactcgtacgagtcgccc

SEQ ID NO: 12517 - DNA, 20 bp, synthetic construct
  misc_feature 1..20: note = Description of Artificial Sequence: Syntheticoligonucleotide
  source 1..20: mol_type = other DNA
gcgactcgtacgagtcgcct

SEQ ID NO: 12518 - DNA, 20 bp, synthetic construct
  misc_feature 1..20: note = Description of Artificial Sequence: Syntheticoligonucleotide
  source 1..20: mol_type = other DNA
gcgactcgtacgagtcgctc

SEQ ID NO: 12519 - DNA, 20 bp, synthetic construct
  misc_feature 1..20: note = Description of Artificial Sequence: Syntheticoligonucleotide
  source 1..20: mol_type = other DNA
acgactcgtacgagtcgtcc

SEQ ID NO: 12520 - DNA, 20 bp, synthetic construct
  misc_feature 1..20: note = Description of Artificial Sequence: Syntheticoligonucleotide
  source 1..20: mol_type = other DNA
gagactcgtacgagtctccc

SEQ ID NO: 12521 - DNA, 20 bp, synthetic construct
  misc_feature 1..20: note = Description of Artificial Sequence: Syntheticoligonucleotide
  source 1..20: mol_type = other DNA
gcgactcgtacgagtcgcca

SEQ ID NO: 12522 - DNA, 20 bp, synthetic construct
  misc_feature 1..20: note = Description of Artificial Sequence: Syntheticoligonucleotide
  source 1..20: mol_type = other DNA
gcgactcgtacgagtcgcac

SEQ ID NO: 12523 - DNA, 20 bp, synthetic construct
  misc_feature 1..20: note = Description of Artificial Sequence: Syntheticoligonucleotide
  source 1..20: mol_type = other DNA
gtgactcgtacgagtcaccc

SEQ ID NO: 12524 - DNA, 20 bp, synthetic construct
  misc_feature 1..20: note = Description of Artificial Sequence: Syntheticoligonucleotide
  source 1..20: mol_type = other DNA
gggactcgtacgagtcccgt

SEQ ID NO: 12525 - DNA, 20 bp, synthetic construct
  misc_feature 1..20: note = Description of Artificial Sequence: Syntheticoligonucleotide
  source 1..20: mol_type = other DNA
gggactcgtacgagtccctg

SEQ ID NO: 12526 - DNA, 20 bp, synthetic construct
  misc_feature 1..20: note = Description of Artificial Sequence: Syntheticoligonucleotide
  source 1..20: mol_type = other DNA
aggactcgtacgagtcctgg

SEQ ID NO: 12527 - DNA, 20 bp, synthetic construct
  misc_feature 1..20: note = Description of Artificial Sequence: Syntheticoligonucleotide
  source 1..20: mol_type = other DNA
gagactcgtacgagtctcgg

SEQ ID NO: 12528 - DNA, 20 bp, synthetic construct
  misc_feature 1..20: note = Description of Artificial Sequence: Syntheticoligonucleotide
  source 1..20: mol_type = other DNA
gggactcgtacgagtcccga

SEQ ID NO: 12529 - DNA, 20 bp, synthetic construct
  misc_feature 1..20: note = Description of Artificial Sequence: Syntheticoligonucleotide
  source 1..20: mol_type = other DNA
gggactcgtacgagtcccag

SEQ ID NO: 12530 - DNA, 20 bp, synthetic construct
  misc_feature 1..20: note = Description of Artificial Sequence: Syntheticoligonucleotide
  source 1..20: mol_type = other DNA
tggactcgtacgagtccagg

SEQ ID NO: 12531 - DNA, 20 bp, synthetic construct
  misc_feature 1..20: note = Description of Artificial Sequence: Syntheticoligonucleotide
  source 1..20: mol_type = other DNA
gtgactcgtacgagtcacgg

SEQ ID NO: 12532 - DNA, 20 bp, synthetic construct
  misc_feature 1..20: note = Description of Artificial Sequence: Syntheticoligonucleotide
  source 1..20: mol_type = other DNA
gcgactcgtacgagtcgccg

SEQ ID NO: 12533 - DNA, 20 bp, synthetic construct
  misc_feature 1..20: note = Description of Artificial Sequence: Syntheticoligonucleotide
  source 1..20: mol_type = other DNA
gcgactcgtacgagtcgctg

SEQ ID NO: 12534 - DNA, 20 bp, synthetic construct
  misc_feature 1..20: note = Description of Artificial Sequence: Syntheticoligonucleotide
  source 1..20: mol_type = other DNA
acgactcgtacgagtcgtcg

SEQ ID NO: 12535 - DNA, 20 bp, synthetic construct
  misc_feature 1..20: note = Description of Artificial Sequence: Syntheticoligonucleotide
  source 1..20: mol_type = other DNA
gagactcgtacgagtctccg

SEQ ID NO: 12536 - DNA, 20 bp, synthetic construct
  misc_feature 1..20: note = Description of Artificial Sequence: Syntheticoligonucleotide
  source 1..20: mol_type = other DNA
gcgactcgtacgagtcgcag

SEQ ID NO: 12537 - DNA, 20 bp, synthetic construct
  misc_feature 1..20: note = Description of Artificial Sequence: Syntheticoligonucleotide
  source 1..20: mol_type = other DNA
gtgactcgtacgagtcaccg

SEQ ID NO: 12538 - DNA, 20 bp, synthetic construct
  misc_feature 1..20: note = Description of Artificial Sequence: Syntheticoligonucleotide
  source 1..20: mol_type = other DNA
cggactcgtacgagtccgtg

SEQ ID NO: 12539 - DNA, 20 bp, synthetic construct
  misc_feature 1..20: note = Description of Artificial Sequence: Syntheticoligonucleotide
  source 1..20: mol_type = other DNA
cagactcgtacgagtctggg

SEQ ID NO: 12540 - DNA, 20 bp, synthetic construct
  misc_feature 1..20: note = Description of Artificial Sequence: Syntheticoligonucleotide
  source 1..20: mol_type = other DNA
cggactcgtacgagtccgag

SEQ ID NO: 12541 - DNA, 20 bp, synthetic construct
  misc_feature 1..20: note = Description of Artificial Sequence: Syntheticoligonucleotide
  source 1..20: mol_type = other DNA
ctgactcgtacgagtcaggg

SEQ ID NO: 12542 - DNA, 20 bp, synthetic construct
  misc_feature 1..20: note = Description of Artificial Sequence: Syntheticoligonucleotide
  source 1..20: mol_type = other DNA
acgactcgtacgagtcgtgg

SEQ ID NO: 12543 - DNA, 20 bp, synthetic construct
  misc_feature 1..20: note = Description of Artificial Sequence: Syntheticoligonucleotide
  source 1..20: mol_type = other DNA
ccgactcgtacgagtcggct

SEQ ID NO: 12544 - DNA, 20 bp, synthetic construct
  misc_feature 1..20: note = Description of Artificial Sequence: Syntheticoligonucleotide
  source 1..20: mol_type = other DNA
ccgactcgtacgagtcggca

SEQ ID NO: 12545 - DNA, 20 bp, synthetic construct
  misc_feature 1..20: note = Description of Artificial Sequence: Syntheticoligonucleotide
  source 1..20: mol_type = other DNA
gagactcgtacgagtctcgc

SEQ ID NO: 12546 - DNA, 20 bp, synthetic construct
  misc_feature 1..20: note = Description of Artificial Sequence: Syntheticoligonucleotide
  source 1..20: mol_type = other DNA
gtgactcgtacgagtcacgc

SEQ ID NO: 12547 - DNA, 20 bp, synthetic construct
  misc_feature 1..20: note = Description of Artificial Sequence: Syntheticoligonucleotide
  source 1..20: mol_type = other DNA
aggactcgtacgagtcctgc

SEQ ID NO: 12548 - DNA, 20 bp, synthetic construct
  misc_feature 1..20: note = Description of Artificial Sequence: Syntheticoligonucleotide
  source 1..20: mol_type = other DNA
tggactcgtacgagtccagc

SEQ ID NO: 12549 - DNA, 20 bp, synthetic construct
  misc_feature 1..20: note = Description of Artificial Sequence: Syntheticoligonucleotide
  source 1..20: mol_type = other DNA
aggactcgtacgagtcctcg

SEQ ID NO: 12550 - DNA, 20 bp, synthetic construct
  misc_feature 1..20: note = Description of Artificial Sequence: Syntheticoligonucleotide
  source 1..20: mol_type = other DNA
tggactcgtacgagtccacg

SEQ ID NO: 12551 - DNA, 20 bp, synthetic construct
  misc_feature 1..20: note = Description of Artificial Sequence: Syntheticoligonucleotide
  source 1..20: mol_type = other DNA
ccgactcgtacgagtcggtg

SEQ ID NO: 12552 - DNA, 20 bp, synthetic construct
  misc_feature 1..20: note = Description of Artificial Sequence: Syntheticoligonucleotide
  source 1..20: mol_type = other DNA
ccgactcgtacgagtcggag

SEQ ID NO: 12553 - DNA, 20 bp, synthetic construct
  misc_feature 1..20: note = Description of Artificial Sequence: Syntheticoligonucleotide
  source 1..20: mol_type = other DNA
gggactcgtacgagtcccgc

SEQ ID NO: 12554 - DNA, 20 bp, synthetic construct
  misc_feature 1..20: note = Description of Artificial Sequence: Syntheticoligonucleotide
  source 1..20: mol_type = other DNA
gggactcgtacgagtccctc

SEQ ID NO: 12555 - DNA, 20 bp, synthetic construct
  misc_feature 1..20: note = Description of Artificial Sequence: Syntheticoligonucleotide
  source 1..20: mol_type = other DNA
gggactcgtacgagtcccac

SEQ ID NO: 12556 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactcctaggagtcnnnn

SEQ ID NO: 12557 - DNA, 20 bp, synthetic construct
  misc_feature 1..20: note = Description of Artificial Sequence: Syntheticoligonucleotide
  source 1..20: mol_type = other DNA
cggactcctaggagtccgcc

SEQ ID NO: 12558 - DNA, 20 bp, synthetic construct
  misc_feature 1..20: note = Description of Artificial Sequence: Syntheticoligonucleotide
  source 1..20: mol_type = other DNA
cggactcctaggagtccgct

SEQ ID NO: 12559 - DNA, 20 bp, synthetic construct
  misc_feature 1..20: note = Description of Artificial Sequence: Syntheticoligonucleotide
  source 1..20: mol_type = other DNA
cggactcctaggagtccgtc

SEQ ID NO: 12560 - DNA, 20 bp, synthetic construct
  misc_feature 1..20: note = Description of Artificial Sequence: Syntheticoligonucleotide
  source 1..20: mol_type = other DNA
aggactcctaggagtcctcc

SEQ ID NO: 12561 - DNA, 20 bp, synthetic construct
  misc_feature 1..20: note = Description of Artificial Sequence: Syntheticoligonucleotide
  source 1..20: mol_type = other DNA
cagactcctaggagtctgcc

SEQ ID NO: 12562 - DNA, 20 bp, synthetic construct
  misc_feature 1..20: note = Description of Artificial Sequence: Syntheticoligonucleotide
  source 1..20: mol_type = other DNA
cggactcctaggagtccgca

SEQ ID NO: 12563 - DNA, 20 bp, synthetic construct
  misc_feature 1..20: note = Description of Artificial Sequence: Syntheticoligonucleotide
  source 1..20: mol_type = other DNA
cggactcctaggagtccgac

SEQ ID NO: 12564 - DNA, 20 bp, synthetic construct
  misc_feature 1..20: note = Description of Artificial Sequence: Syntheticoligonucleotide
  source 1..20: mol_type = other DNA
tggactcctaggagtccacc

SEQ ID NO: 12565 - DNA, 20 bp, synthetic construct
  misc_feature 1..20: note = Description of Artificial Sequence: Syntheticoligonucleotide
  source 1..20: mol_type = other DNA
ctgactcctaggagtcagcc

SEQ ID NO: 12566 - DNA, 20 bp, synthetic construct
  misc_feature 1..20: note = Description of Artificial Sequence: Syntheticoligonucleotide
  source 1..20: mol_type = other DNA
ccgactcctaggagtcgggc

SEQ ID NO: 12567 - DNA, 20 bp, synthetic construct
  misc_feature 1..20: note = Description of Artificial Sequence: Syntheticoligonucleotide
  source 1..20: mol_type = other DNA
ccgactcctaggagtcgggt

SEQ ID NO: 12568 - DNA, 20 bp, synthetic construct
  misc_feature 1..20: note = Description of Artificial Sequence: Syntheticoligonucleotide
  source 1..20: mol_type = other DNA
ccgactcctaggagtcggtc

SEQ ID NO: 12569 - DNA, 20 bp, synthetic construct
  misc_feature 1..20: note = Description of Artificial Sequence: Syntheticoligonucleotide
  source 1..20: mol_type = other DNA
acgactcctaggagtcgtgc

SEQ ID NO: 12570 - DNA, 20 bp, synthetic construct
  misc_feature 1..20: note = Description of Artificial Sequence: Syntheticoligonucleotide
  source 1..20: mol_type = other DNA
cagactcctaggagtctggc

SEQ ID NO: 12571 - DNA, 20 bp, synthetic construct
  misc_feature 1..20: note = Description of Artificial Sequence: Syntheticoligonucleotide
  source 1..20: mol_type = other DNA
ccgactcctaggagtcggga

SEQ ID NO: 12572 - DNA, 20 bp, synthetic construct
  misc_feature 1..20: note = Description of Artificial Sequence: Syntheticoligonucleotide
  source 1..20: mol_type = other DNA
ccgactcctaggagtcggac

SEQ ID NO: 12573 - DNA, 20 bp, synthetic construct
  misc_feature 1..20: note = Description of Artificial Sequence: Syntheticoligonucleotide
  source 1..20: mol_type = other DNA
ctgactcctaggagtcaggc

SEQ ID NO: 12574 - DNA, 20 bp, synthetic construct
  misc_feature 1..20: note = Description of Artificial Sequence: Syntheticoligonucleotide
  source 1..20: mol_type = other DNA
gcgactcctaggagtcgccc

SEQ ID NO: 12575 - DNA, 20 bp, synthetic construct
  misc_feature 1..20: note = Description of Artificial Sequence: Syntheticoligonucleotide
  source 1..20: mol_type = other DNA
gcgactcctaggagtcgcct

SEQ ID NO: 12576 - DNA, 20 bp, synthetic construct
  misc_feature 1..20: note = Description of Artificial Sequence: Syntheticoligonucleotide
  source 1..20: mol_type = other DNA
gcgactcctaggagtcgctc

SEQ ID NO: 12577 - DNA, 20 bp, synthetic construct
  misc_feature 1..20: note = Description of Artificial Sequence: Syntheticoligonucleotide
  source 1..20: mol_type = other DNA
acgactcctaggagtcgtcc

SEQ ID NO: 12578 - DNA, 20 bp, synthetic construct
  misc_feature 1..20: note = Description of Artificial Sequence: Syntheticoligonucleotide
  source 1..20: mol_type = other DNA
gagactcctaggagtctccc

SEQ ID NO: 12579 - DNA, 20 bp, synthetic construct
  misc_feature 1..20: note = Description of Artificial Sequence: Syntheticoligonucleotide
  source 1..20: mol_type = other DNA
gcgactcctaggagtcgcca

SEQ ID NO: 12580 - DNA, 20 bp, synthetic construct
  misc_feature 1..20: note = Description of Artificial Sequence: Syntheticoligonucleotide
  source 1..20: mol_type = other DNA
gcgactcctaggagtcgcac

SEQ ID NO: 12581 - DNA, 20 bp, synthetic construct
  misc_feature 1..20: note = Description of Artificial Sequence: Syntheticoligonucleotide
  source 1..20: mol_type = other DNA
gtgactcctaggagtcaccc

SEQ ID NO: 12582 - DNA, 20 bp, synthetic construct
  misc_feature 1..20: note = Description of Artificial Sequence: Syntheticoligonucleotide
  source 1..20: mol_type = other DNA
gggactcctaggagtcccgt

SEQ ID NO: 12583 - DNA, 20 bp, synthetic construct
  misc_feature 1..20: note = Description of Artificial Sequence: Syntheticoligonucleotide
  source 1..20: mol_type = other DNA
gggactcctaggagtccctg

SEQ ID NO: 12584 - DNA, 20 bp, synthetic construct
  misc_feature 1..20: note = Description of Artificial Sequence: Syntheticoligonucleotide
  source 1..20: mol_type = other DNA
aggactcctaggagtcctgg

SEQ ID NO: 12585 - DNA, 20 bp, synthetic construct
  misc_feature 1..20: note = Description of Artificial Sequence: Syntheticoligonucleotide
  source 1..20: mol_type = other DNA
gagactcctaggagtctcgg

SEQ ID NO: 12586 - DNA, 20 bp, synthetic construct
  misc_feature 1..20: note = Description of Artificial Sequence: Syntheticoligonucleotide
  source 1..20: mol_type = other DNA
gggactcctaggagtcccga

SEQ ID NO: 12587 - DNA, 20 bp, synthetic construct
  misc_feature 1..20: note = Description of Artificial Sequence: Syntheticoligonucleotide
  source 1..20: mol_type = other DNA
gggactcctaggagtcccag

SEQ ID NO: 12588 - DNA, 20 bp, synthetic construct
  misc_feature 1..20: note = Description of Artificial Sequence: Syntheticoligonucleotide
  source 1..20: mol_type = other DNA
tggactcctaggagtccagg

SEQ ID NO: 12589 - DNA, 20 bp, synthetic construct
  misc_feature 1..20: note = Description of Artificial Sequence: Syntheticoligonucleotide
  source 1..20: mol_type = other DNA
gtgactcctaggagtcacgg

SEQ ID NO: 12590 - DNA, 20 bp, synthetic construct
  misc_feature 1..20: note = Description of Artificial Sequence: Syntheticoligonucleotide
  source 1..20: mol_type = other DNA
gcgactcctaggagtcgccg

SEQ ID NO: 12591 - DNA, 20 bp, synthetic construct
  misc_feature 1..20: note = Description of Artificial Sequence: Syntheticoligonucleotide
  source 1..20: mol_type = other DNA
gcgactcctaggagtcgctg

SEQ ID NO: 12592 - DNA, 20 bp, synthetic construct
  misc_feature 1..20: note = Description of Artificial Sequence: Syntheticoligonucleotide
  source 1..20: mol_type = other DNA
acgactcctaggagtcgtcg

SEQ ID NO: 12593 - DNA, 20 bp, synthetic construct
  misc_feature 1..20: note = Description of Artificial Sequence: Syntheticoligonucleotide
  source 1..20: mol_type = other DNA
gagactcctaggagtctccg

SEQ ID NO: 12594 - DNA, 20 bp, synthetic construct
  misc_feature 1..20: note = Description of Artificial Sequence: Syntheticoligonucleotide
  source 1..20: mol_type = other DNA
gcgactcctaggagtcgcag

SEQ ID NO: 12595 - DNA, 20 bp, synthetic construct
  misc_feature 1..20: note = Description of Artificial Sequence: Syntheticoligonucleotide
  source 1..20: mol_type = other DNA
gtgactcctaggagtcaccg

SEQ ID NO: 12596 - DNA, 20 bp, synthetic construct
  misc_feature 1..20: note = Description of Artificial Sequence: Syntheticoligonucleotide
  source 1..20: mol_type = other DNA
cggactcctaggagtccgtg

SEQ ID NO: 12597 - DNA, 20 bp, synthetic construct
  misc_feature 1..20: note = Description of Artificial Sequence: Syntheticoligonucleotide
  source 1..20: mol_type = other DNA
cagactcctaggagtctggg

SEQ ID NO: 12598 - DNA, 20 bp, synthetic construct
  misc_feature 1..20: note = Description of Artificial Sequence: Syntheticoligonucleotide
  source 1..20: mol_type = other DNA
cggactcctaggagtccgag

SEQ ID NO: 12599 - DNA, 20 bp, synthetic construct
  misc_feature 1..20: note = Description of Artificial Sequence: Syntheticoligonucleotide
  source 1..20: mol_type = other DNA
ctgactcctaggagtcaggg

SEQ ID NO: 12600 - DNA, 20 bp, synthetic construct
  misc_feature 1..20: note = Description of Artificial Sequence: Syntheticoligonucleotide
  source 1..20: mol_type = other DNA
acgactcctaggagtcgtgg

SEQ ID NO: 12601 - DNA, 20 bp, synthetic construct
  misc_feature 1..20: note = Description of Artificial Sequence: Syntheticoligonucleotide
  source 1..20: mol_type = other DNA
ccgactcctaggagtcggct

SEQ ID NO: 12602 - DNA, 20 bp, synthetic construct
  misc_feature 1..20: note = Description of Artificial Sequence: Syntheticoligonucleotide
  source 1..20: mol_type = other DNA
ccgactcctaggagtcggca

SEQ ID NO: 12603 - DNA, 20 bp, synthetic construct
  misc_feature 1..20: note = Description of Artificial Sequence: Syntheticoligonucleotide
  source 1..20: mol_type = other DNA
gagactcctaggagtctcgc

SEQ ID NO: 12604 - DNA, 20 bp, synthetic construct
  misc_feature 1..20: note = Description of Artificial Sequence: Syntheticoligonucleotide
  source 1..20: mol_type = other DNA
gtgactcctaggagtcacgc

SEQ ID NO: 12605 - DNA, 20 bp, synthetic construct
  misc_feature 1..20: note = Description of Artificial Sequence: Syntheticoligonucleotide
  source 1..20: mol_type = other DNA
aggactcctaggagtcctgc

SEQ ID NO: 12606 - DNA, 20 bp, synthetic construct
  misc_feature 1..20: note = Description of Artificial Sequence: Syntheticoligonucleotide
  source 1..20: mol_type = other DNA
tggactcctaggagtccagc

SEQ ID NO: 12607 - DNA, 20 bp, synthetic construct
  misc_feature 1..20: note = Description of Artificial Sequence: Syntheticoligonucleotide
  source 1..20: mol_type = other DNA
aggactcctaggagtcctcg

SEQ ID NO: 12608 - DNA, 20 bp, synthetic construct
  misc_feature 1..20: note = Description of Artificial Sequence: Syntheticoligonucleotide
  source 1..20: mol_type = other DNA
tggactcctaggagtccacg

SEQ ID NO: 12609 - DNA, 20 bp, synthetic construct
  misc_feature 1..20: note = Description of Artificial Sequence: Syntheticoligonucleotide
  source 1..20: mol_type = other DNA
ccgactcctaggagtcggtg

SEQ ID NO: 12610 - DNA, 20 bp, synthetic construct
  misc_feature 1..20: note = Description of Artificial Sequence: Syntheticoligonucleotide
  source 1..20: mol_type = other DNA
ccgactcctaggagtcggag

SEQ ID NO: 12611 - DNA, 20 bp, synthetic construct
  misc_feature 1..20: note = Description of Artificial Sequence: Syntheticoligonucleotide
  source 1..20: mol_type = other DNA
gggactcctaggagtcccgc

SEQ ID NO: 12612 - DNA, 20 bp, synthetic construct
  misc_feature 1..20: note = Description of Artificial Sequence: Syntheticoligonucleotide
  source 1..20: mol_type = other DNA
gggactcctaggagtccctc

SEQ ID NO: 12613 - DNA, 20 bp, synthetic construct
  misc_feature 1..20: note = Description of Artificial Sequence: Syntheticoligonucleotide
  source 1..20: mol_type = other DNA
gggactcctaggagtcccac

SEQ ID NO: 12614 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactccatggagtcnnnn

SEQ ID NO: 12615 - DNA, 20 bp, synthetic construct
  misc_feature 1..20: note = Description of Artificial Sequence: Syntheticoligonucleotide
  source 1..20: mol_type = other DNA
cggactccatggagtccgcc

SEQ ID NO: 12616 - DNA, 20 bp, synthetic construct
  misc_feature 1..20: note = Description of Artificial Sequence: Syntheticoligonucleotide
  source 1..20: mol_type = other DNA
cggactccatggagtccgct

SEQ ID NO: 12617 - DNA, 20 bp, synthetic construct
  misc_feature 1..20: note = Description of Artificial Sequence: Syntheticoligonucleotide
  source 1..20: mol_type = other DNA
cggactccatggagtccgtc

SEQ ID NO: 12618 - DNA, 20 bp, synthetic construct
  misc_feature 1..20: note = Description of Artificial Sequence: Syntheticoligonucleotide
  source 1..20: mol_type = other DNA
aggactccatggagtcctcc

SEQ ID NO: 12619 - DNA, 20 bp, synthetic construct
  misc_feature 1..20: note = Description of Artificial Sequence: Syntheticoligonucleotide
  source 1..20: mol_type = other DNA
cagactccatggagtctgcc

SEQ ID NO: 12620 - DNA, 20 bp, synthetic construct
  misc_feature 1..20: note = Description of Artificial Sequence: Syntheticoligonucleotide
  source 1..20: mol_type = other DNA
cggactccatggagtccgca

SEQ ID NO: 12621 - DNA, 20 bp, synthetic construct
  misc_feature 1..20: note = Description of Artificial Sequence: Syntheticoligonucleotide
  source 1..20: mol_type = other DNA
cggactccatggagtccgac

SEQ ID NO: 12622 - DNA, 20 bp, synthetic construct
  misc_feature 1..20: note = Description of Artificial Sequence: Syntheticoligonucleotide
  source 1..20: mol_type = other DNA
tggactccatggagtccacc

SEQ ID NO: 12623 - DNA, 20 bp, synthetic construct
  misc_feature 1..20: note = Description of Artificial Sequence: Syntheticoligonucleotide
  source 1..20: mol_type = other DNA
ctgactccatggagtcagcc

SEQ ID NO: 12624 - DNA, 20 bp, synthetic construct
  misc_feature 1..20: note = Description of Artificial Sequence: Syntheticoligonucleotide
  source 1..20: mol_type = other DNA
ccgactccatggagtcgggc

SEQ ID NO: 12625 - DNA, 20 bp, synthetic construct
  misc_feature 1..20: note = Description of Artificial Sequence: Syntheticoligonucleotide
  source 1..20: mol_type = other DNA
ccgactccatggagtcgggt

SEQ ID NO: 12626 - DNA, 20 bp, synthetic construct
  misc_feature 1..20: note = Description of Artificial Sequence: Syntheticoligonucleotide
  source 1..20: mol_type = other DNA
ccgactccatggagtcggtc

SEQ ID NO: 12627 - DNA, 20 bp, synthetic construct
  misc_feature 1..20: note = Description of Artificial Sequence: Syntheticoligonucleotide
  source 1..20: mol_type = other DNA
acgactccatggagtcgtgc

SEQ ID NO: 12628 - DNA, 20 bp, synthetic construct
  misc_feature 1..20: note = Description of Artificial Sequence: Syntheticoligonucleotide
  source 1..20: mol_type = other DNA
cagactccatggagtctggc

SEQ ID NO: 12629 - DNA, 20 bp, synthetic construct
  misc_feature 1..20: note = Description of Artificial Sequence: Syntheticoligonucleotide
  source 1..20: mol_type = other DNA
ccgactccatggagtcggga

SEQ ID NO: 12630 - DNA, 20 bp, synthetic construct
  misc_feature 1..20: note = Description of Artificial Sequence: Syntheticoligonucleotide
  source 1..20: mol_type = other DNA
ccgactccatggagtcggac

SEQ ID NO: 12631 - DNA, 20 bp, synthetic construct
  misc_feature 1..20: note = Description of Artificial Sequence: Syntheticoligonucleotide
  source 1..20: mol_type = other DNA
ctgactccatggagtcaggc

SEQ ID NO: 12632 - DNA, 20 bp, synthetic construct
  misc_feature 1..20: note = Description of Artificial Sequence: Syntheticoligonucleotide
  source 1..20: mol_type = other DNA
gcgactccatggagtcgccc

SEQ ID NO: 12633 - DNA, 20 bp, synthetic construct
  misc_feature 1..20: note = Description of Artificial Sequence: Syntheticoligonucleotide
  source 1..20: mol_type = other DNA
gcgactccatggagtcgcct

SEQ ID NO: 12634 - DNA, 20 bp, synthetic construct
  misc_feature 1..20: note = Description of Artificial Sequence: Syntheticoligonucleotide
  source 1..20: mol_type = other DNA
gcgactccatggagtcgctc

SEQ ID NO: 12635 - DNA, 20 bp, synthetic construct
  misc_feature 1..20: note = Description of Artificial Sequence: Syntheticoligonucleotide
  source 1..20: mol_type = other DNA
acgactccatggagtcgtcc

SEQ ID NO: 12636 - DNA, 20 bp, synthetic construct
  misc_feature 1..20: note = Description of Artificial Sequence: Syntheticoligonucleotide
  source 1..20: mol_type = other DNA
gagactccatggagtctccc

SEQ ID NO: 12637 - DNA, 20 bp, synthetic construct
  misc_feature 1..20: note = Description of Artificial Sequence: Syntheticoligonucleotide
  source 1..20: mol_type = other DNA
gcgactccatggagtcgcca

SEQ ID NO: 12638 - DNA, 20 bp, synthetic construct
  misc_feature 1..20: note = Description of Artificial Sequence: Syntheticoligonucleotide
  source 1..20: mol_type = other DNA
gcgactccatggagtcgcac

SEQ ID NO: 12639 - DNA, 20 bp, synthetic construct
  misc_feature 1..20: note = Description of Artificial Sequence: Syntheticoligonucleotide
  source 1..20: mol_type = other DNA
gtgactccatggagtcaccc

SEQ ID NO: 12640 - DNA, 20 bp, synthetic construct
  misc_feature 1..20: note = Description of Artificial Sequence: Syntheticoligonucleotide
  source 1..20: mol_type = other DNA
gggactccatggagtcccgt

SEQ ID NO: 12641 - DNA, 20 bp, synthetic construct
  misc_feature 1..20: note = Description of Artificial Sequence: Syntheticoligonucleotide
  source 1..20: mol_type = other DNA
gggactccatggagtccctg

SEQ ID NO: 12642 - DNA, 20 bp, synthetic construct
  misc_feature 1..20: note = Description of Artificial Sequence: Syntheticoligonucleotide
  source 1..20: mol_type = other DNA
aggactccatggagtcctgg

SEQ ID NO: 12643 - DNA, 20 bp, synthetic construct
  misc_feature 1..20: note = Description of Artificial Sequence: Syntheticoligonucleotide
  source 1..20: mol_type = other DNA
gagactccatggagtctcgg

SEQ ID NO: 12644 - DNA, 20 bp, synthetic construct
  misc_feature 1..20: note = Description of Artificial Sequence: Syntheticoligonucleotide
  source 1..20: mol_type = other DNA
gggactccatggagtcccga

SEQ ID NO: 12645 - DNA, 20 bp, synthetic construct
  misc_feature 1..20: note = Description of Artificial Sequence: Syntheticoligonucleotide
  source 1..20: mol_type = other DNA
gggactccatggagtcccag

SEQ ID NO: 12646 - DNA, 20 bp, synthetic construct
  misc_feature 1..20: note = Description of Artificial Sequence: Syntheticoligonucleotide
  source 1..20: mol_type = other DNA
tggactccatggagtccagg

SEQ ID NO: 12647 - DNA, 20 bp, synthetic construct
  misc_feature 1..20: note = Description of Artificial Sequence: Syntheticoligonucleotide
  source 1..20: mol_type = other DNA
gtgactccatggagtcacgg

SEQ ID NO: 12648 - DNA, 20 bp, synthetic construct
  misc_feature 1..20: note = Description of Artificial Sequence: Syntheticoligonucleotide
  source 1..20: mol_type = other DNA
gcgactccatggagtcgccg

SEQ ID NO: 12649 - DNA, 20 bp, synthetic construct
  misc_feature 1..20: note = Description of Artificial Sequence: Syntheticoligonucleotide
  source 1..20: mol_type = other DNA
gcgactccatggagtcgctg

SEQ ID NO: 12650 - DNA, 20 bp, synthetic construct
  misc_feature 1..20: note = Description of Artificial Sequence: Syntheticoligonucleotide
  source 1..20: mol_type = other DNA
acgactccatggagtcgtcg

SEQ ID NO: 12651 - DNA, 20 bp, synthetic construct
  misc_feature 1..20: note = Description of Artificial Sequence: Syntheticoligonucleotide
  source 1..20: mol_type = other DNA
gagactccatggagtctccg

SEQ ID NO: 12652 - DNA, 20 bp, synthetic construct
  misc_feature 1..20: note = Description of Artificial Sequence: Syntheticoligonucleotide
  source 1..20: mol_type = other DNA
gcgactccatggagtcgcag

SEQ ID NO: 12653 - DNA, 20 bp, synthetic construct
  misc_feature 1..20: note = Description of Artificial Sequence: Syntheticoligonucleotide
  source 1..20: mol_type = other DNA
gtgactccatggagtcaccg

SEQ ID NO: 12654 - DNA, 20 bp, synthetic construct
  misc_feature 1..20: note = Description of Artificial Sequence: Syntheticoligonucleotide
  source 1..20: mol_type = other DNA
cggactccatggagtccgtg

SEQ ID NO: 12655 - DNA, 20 bp, synthetic construct
  misc_feature 1..20: note = Description of Artificial Sequence: Syntheticoligonucleotide
  source 1..20: mol_type = other DNA
cagactccatggagtctggg

SEQ ID NO: 12656 - DNA, 20 bp, synthetic construct
  misc_feature 1..20: note = Description of Artificial Sequence: Syntheticoligonucleotide
  source 1..20: mol_type = other DNA
cggactccatggagtccgag

SEQ ID NO: 12657 - DNA, 20 bp, synthetic construct
  misc_feature 1..20: note = Description of Artificial Sequence: Syntheticoligonucleotide
  source 1..20: mol_type = other DNA
ctgactccatggagtcaggg

SEQ ID NO: 12658 - DNA, 20 bp, synthetic construct
  misc_feature 1..20: note = Description of Artificial Sequence: Syntheticoligonucleotide
  source 1..20: mol_type = other DNA
acgactccatggagtcgtgg

SEQ ID NO: 12659 - DNA, 20 bp, synthetic construct
  misc_feature 1..20: note = Description of Artificial Sequence: Syntheticoligonucleotide
  source 1..20: mol_type = other DNA
ccgactccatggagtcggct

SEQ ID NO: 12660 - DNA, 20 bp, synthetic construct
  misc_feature 1..20: note = Description of Artificial Sequence: Syntheticoligonucleotide
  source 1..20: mol_type = other DNA
ccgactccatggagtcggca

SEQ ID NO: 12661 - DNA, 20 bp, synthetic construct
  misc_feature 1..20: note = Description of Artificial Sequence: Syntheticoligonucleotide
  source 1..20: mol_type = other DNA
gagactccatggagtctcgc

SEQ ID NO: 12662 - DNA, 20 bp, synthetic construct
  misc_feature 1..20: note = Description of Artificial Sequence: Syntheticoligonucleotide
  source 1..20: mol_type = other DNA
gtgactccatggagtcacgc

SEQ ID NO: 12663 - DNA, 20 bp, synthetic construct
  misc_feature 1..20: note = Description of Artificial Sequence: Syntheticoligonucleotide
  source 1..20: mol_type = other DNA
aggactccatggagtcctgc

SEQ ID NO: 12664 - DNA, 20 bp, synthetic construct
  misc_feature 1..20: note = Description of Artificial Sequence: Syntheticoligonucleotide
  source 1..20: mol_type = other DNA
tggactccatggagtccagc

SEQ ID NO: 12665 - DNA, 20 bp, synthetic construct
  misc_feature 1..20: note = Description of Artificial Sequence: Syntheticoligonucleotide
  source 1..20: mol_type = other DNA
aggactccatggagtcctcg

SEQ ID NO: 12666 - DNA, 20 bp, synthetic construct
  misc_feature 1..20: note = Description of Artificial Sequence: Syntheticoligonucleotide
  source 1..20: mol_type = other DNA
tggactccatggagtccacg

SEQ ID NO: 12667 - DNA, 20 bp, synthetic construct
  misc_feature 1..20: note = Description of Artificial Sequence: Syntheticoligonucleotide
  source 1..20: mol_type = other DNA
ccgactccatggagtcggtg

SEQ ID NO: 12668 - DNA, 20 bp, synthetic construct
  misc_feature 1..20: note = Description of Artificial Sequence: Syntheticoligonucleotide
  source 1..20: mol_type = other DNA
ccgactccatggagtcggag

SEQ ID NO: 12669 - DNA, 20 bp, synthetic construct
  misc_feature 1..20: note = Description of Artificial Sequence: Syntheticoligonucleotide
  source 1..20: mol_type = other DNA
gggactccatggagtcccgc

SEQ ID NO: 12670 - DNA, 20 bp, synthetic construct
  misc_feature 1..20: note = Description of Artificial Sequence: Syntheticoligonucleotide
  source 1..20: mol_type = other DNA
gggactccatggagtccctc

SEQ ID NO: 12671 - DNA, 20 bp, synthetic construct
  misc_feature 1..20: note = Description of Artificial Sequence: Syntheticoligonucleotide
  source 1..20: mol_type = other DNA
gggactccatggagtcccac

SEQ ID NO: 12672 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactctcgagagtcnnnn

SEQ ID NO: 12673 - DNA, 20 bp, synthetic construct
  misc_feature 1..20: note = Description of Artificial Sequence: Syntheticoligonucleotide
  source 1..20: mol_type = other DNA
cggactctcgagagtccgcc

SEQ ID NO: 12674 - DNA, 20 bp, synthetic construct
  misc_feature 1..20: note = Description of Artificial Sequence: Syntheticoligonucleotide
  source 1..20: mol_type = other DNA
cggactctcgagagtccgct

SEQ ID NO: 12675 - DNA, 20 bp, synthetic construct
  misc_feature 1..20: note = Description of Artificial Sequence: Syntheticoligonucleotide
  source 1..20: mol_type = other DNA
cggactctcgagagtccgtc

SEQ ID NO: 12676 - DNA, 20 bp, synthetic construct
  misc_feature 1..20: note = Description of Artificial Sequence: Syntheticoligonucleotide
  source 1..20: mol_type = other DNA
aggactctcgagagtcctcc

SEQ ID NO: 12677 - DNA, 20 bp, synthetic construct
  misc_feature 1..20: note = Description of Artificial Sequence: Syntheticoligonucleotide
  source 1..20: mol_type = other DNA
cagactctcgagagtctgcc

SEQ ID NO: 12678 - DNA, 20 bp, synthetic construct
  misc_feature 1..20: note = Description of Artificial Sequence: Syntheticoligonucleotide
  source 1..20: mol_type = other DNA
cggactctcgagagtccgca

SEQ ID NO: 12679 - DNA, 20 bp, synthetic construct
  misc_feature 1..20: note = Description of Artificial Sequence: Syntheticoligonucleotide
  source 1..20: mol_type = other DNA
cggactctcgagagtccgac

SEQ ID NO: 12680 - DNA, 20 bp, synthetic construct
  misc_feature 1..20: note = Description of Artificial Sequence: Syntheticoligonucleotide
  source 1..20: mol_type = other DNA
tggactctcgagagtccacc

SEQ ID NO: 12681 - DNA, 20 bp, synthetic construct
  misc_feature 1..20: note = Description of Artificial Sequence: Syntheticoligonucleotide
  source 1..20: mol_type = other DNA
ctgactctcgagagtcagcc

SEQ ID NO: 12682 - DNA, 20 bp, synthetic construct
  misc_feature 1..20: note = Description of Artificial Sequence: Syntheticoligonucleotide
  source 1..20: mol_type = other DNA
ccgactctcgagagtcgggc

SEQ ID NO: 12683 - DNA, 20 bp, synthetic construct
  misc_feature 1..20: note = Description of Artificial Sequence: Syntheticoligonucleotide
  source 1..20: mol_type = other DNA
ccgactctcgagagtcgggt

SEQ ID NO: 12684 - DNA, 20 bp, synthetic construct
  misc_feature 1..20: note = Description of Artificial Sequence: Syntheticoligonucleotide
  source 1..20: mol_type = other DNA
ccgactctcgagagtcggtc

SEQ ID NO: 12685 - DNA, 20 bp, synthetic construct
  misc_feature 1..20: note = Description of Artificial Sequence: Syntheticoligonucleotide
  source 1..20: mol_type = other DNA
acgactctcgagagtcgtgc

SEQ ID NO: 12686 - DNA, 20 bp, synthetic construct
  misc_feature 1..20: note = Description of Artificial Sequence: Syntheticoligonucleotide
  source 1..20: mol_type = other DNA
cagactctcgagagtctggc

SEQ ID NO: 12687 - DNA, 20 bp, synthetic construct
  misc_feature 1..20: note = Description of Artificial Sequence: Syntheticoligonucleotide
  source 1..20: mol_type = other DNA
ccgactctcgagagtcggga

SEQ ID NO: 12688 - DNA, 20 bp, synthetic construct
  misc_feature 1..20: note = Description of Artificial Sequence: Syntheticoligonucleotide
  source 1..20: mol_type = other DNA
ccgactctcgagagtcggac

SEQ ID NO: 12689 - DNA, 20 bp, synthetic construct
  misc_feature 1..20: note = Description of Artificial Sequence: Syntheticoligonucleotide
  source 1..20: mol_type = other DNA
ctgactctcgagagtcaggc

SEQ ID NO: 12690 - DNA, 20 bp, synthetic construct
  misc_feature 1..20: note = Description of Artificial Sequence: Syntheticoligonucleotide
  source 1..20: mol_type = other DNA
gcgactctcgagagtcgccc

SEQ ID NO: 12691 - DNA, 20 bp, synthetic construct
  misc_feature 1..20: note = Description of Artificial Sequence: Syntheticoligonucleotide
  source 1..20: mol_type = other DNA
gcgactctcgagagtcgcct

SEQ ID NO: 12692 - DNA, 20 bp, synthetic construct
  misc_feature 1..20: note = Description of Artificial Sequence: Syntheticoligonucleotide
  source 1..20: mol_type = other DNA
gcgactctcgagagtcgctc

SEQ ID NO: 12693 - DNA, 20 bp, synthetic construct
  misc_feature 1..20: note = Description of Artificial Sequence: Syntheticoligonucleotide
  source 1..20: mol_type = other DNA
acgactctcgagagtcgtcc

SEQ ID NO: 12694 - DNA, 20 bp, synthetic construct
  misc_feature 1..20: note = Description of Artificial Sequence: Syntheticoligonucleotide
  source 1..20: mol_type = other DNA
gagactctcgagagtctccc

SEQ ID NO: 12695 - DNA, 20 bp, synthetic construct
  misc_feature 1..20: note = Description of Artificial Sequence: Syntheticoligonucleotide
  source 1..20: mol_type = other DNA
gcgactctcgagagtcgcca

SEQ ID NO: 12696 - DNA, 20 bp, synthetic construct
  misc_feature 1..20: note = Description of Artificial Sequence: Syntheticoligonucleotide
  source 1..20: mol_type = other DNA
gcgactctcgagagtcgcac

SEQ ID NO: 12697 - DNA, 20 bp, synthetic construct
  misc_feature 1..20: note = Description of Artificial Sequence: Syntheticoligonucleotide
  source 1..20: mol_type = other DNA
gtgactctcgagagtcaccc

SEQ ID NO: 12698 - DNA, 20 bp, synthetic construct
  misc_feature 1..20: note = Description of Artificial Sequence: Syntheticoligonucleotide
  source 1..20: mol_type = other DNA
gggactctcgagagtcccgt

SEQ ID NO: 12699 - DNA, 20 bp, synthetic construct
  misc_feature 1..20: note = Description of Artificial Sequence: Syntheticoligonucleotide
  source 1..20: mol_type = other DNA
gggactctcgagagtccctg

SEQ ID NO: 12700 - DNA, 20 bp, synthetic construct
  misc_feature 1..20: note = Description of Artificial Sequence: Syntheticoligonucleotide
  source 1..20: mol_type = other DNA
aggactctcgagagtcctgg

SEQ ID NO: 12701 - DNA, 20 bp, synthetic construct
  misc_feature 1..20: note = Description of Artificial Sequence: Syntheticoligonucleotide
  source 1..20: mol_type = other DNA
gagactctcgagagtctcgg

SEQ ID NO: 12702 - DNA, 20 bp, synthetic construct
  misc_feature 1..20: note = Description of Artificial Sequence: Syntheticoligonucleotide
  source 1..20: mol_type = other DNA
gggactctcgagagtcccga

SEQ ID NO: 12703 - DNA, 20 bp, synthetic construct
  misc_feature 1..20: note = Description of Artificial Sequence: Syntheticoligonucleotide
  source 1..20: mol_type = other DNA
gggactctcgagagtcccag

SEQ ID NO: 12704 - DNA, 20 bp, synthetic construct
  misc_feature 1..20: note = Description of Artificial Sequence: Syntheticoligonucleotide
  source 1..20: mol_type = other DNA
tggactctcgagagtccagg

SEQ ID NO: 12705 - DNA, 20 bp, synthetic construct
  misc_feature 1..20: note = Description of Artificial Sequence: Syntheticoligonucleotide
  source 1..20: mol_type = other DNA
gtgactctcgagagtcacgg

SEQ ID NO: 12706 - DNA, 20 bp, synthetic construct
  misc_feature 1..20: note = Description of Artificial Sequence: Syntheticoligonucleotide
  source 1..20: mol_type = other DNA
gcgactctcgagagtcgccg

SEQ ID NO: 12707 - DNA, 20 bp, synthetic construct
  misc_feature 1..20: note = Description of Artificial Sequence: Syntheticoligonucleotide
  source 1..20: mol_type = other DNA
gcgactctcgagagtcgctg

SEQ ID NO: 12708 - DNA, 20 bp, synthetic construct
  misc_feature 1..20: note = Description of Artificial Sequence: Syntheticoligonucleotide
  source 1..20: mol_type = other DNA
acgactctcgagagtcgtcg

SEQ ID NO: 12709 - DNA, 20 bp, synthetic construct
  misc_feature 1..20: note = Description of Artificial Sequence: Syntheticoligonucleotide
  source 1..20: mol_type = other DNA
gagactctcgagagtctccg

SEQ ID NO: 12710 - DNA, 20 bp, synthetic construct
  misc_feature 1..20: note = Description of Artificial Sequence: Syntheticoligonucleotide
  source 1..20: mol_type = other DNA
gcgactctcgagagtcgcag

SEQ ID NO: 12711 - DNA, 20 bp, synthetic construct
  misc_feature 1..20: note = Description of Artificial Sequence: Syntheticoligonucleotide
  source 1..20: mol_type = other DNA
gtgactctcgagagtcaccg

SEQ ID NO: 12712 - DNA, 20 bp, synthetic construct
  misc_feature 1..20: note = Description of Artificial Sequence: Syntheticoligonucleotide
  source 1..20: mol_type = other DNA
cggactctcgagagtccgtg

SEQ ID NO: 12713 - DNA, 20 bp, synthetic construct
  misc_feature 1..20: note = Description of Artificial Sequence: Syntheticoligonucleotide
  source 1..20: mol_type = other DNA
cagactctcgagagtctggg

SEQ ID NO: 12714 - DNA, 20 bp, synthetic construct
  misc_feature 1..20: note = Description of Artificial Sequence: Syntheticoligonucleotide
  source 1..20: mol_type = other DNA
cggactctcgagagtccgag

SEQ ID NO: 12715 - DNA, 20 bp, synthetic construct
  misc_feature 1..20: note = Description of Artificial Sequence: Syntheticoligonucleotide
  source 1..20: mol_type = other DNA
ctgactctcgagagtcaggg

SEQ ID NO: 12716 - DNA, 20 bp, synthetic construct
  misc_feature 1..20: note = Description of Artificial Sequence: Syntheticoligonucleotide
  source 1..20: mol_type = other DNA
acgactctcgagagtcgtgg

SEQ ID NO: 12717 - DNA, 20 bp, synthetic construct
  misc_feature 1..20: note = Description of Artificial Sequence: Syntheticoligonucleotide
  source 1..20: mol_type = other DNA
ccgactctcgagagtcggct

SEQ ID NO: 12718 - DNA, 20 bp, synthetic construct
  misc_feature 1..20: note = Description of Artificial Sequence: Syntheticoligonucleotide
  source 1..20: mol_type = other DNA
ccgactctcgagagtcggca

SEQ ID NO: 12719 - DNA, 20 bp, synthetic construct
  misc_feature 1..20: note = Description of Artificial Sequence: Syntheticoligonucleotide
  source 1..20: mol_type = other DNA
gagactctcgagagtctcgc

SEQ ID NO: 12720 - DNA, 20 bp, synthetic construct
  misc_feature 1..20: note = Description of Artificial Sequence: Syntheticoligonucleotide
  source 1..20: mol_type = other DNA
gtgactctcgagagtcacgc

SEQ ID NO: 12721 - DNA, 20 bp, synthetic construct
  misc_feature 1..20: note = Description of Artificial Sequence: Syntheticoligonucleotide
  source 1..20: mol_type = other DNA
aggactctcgagagtcctgc

SEQ ID NO: 12722 - DNA, 20 bp, synthetic construct
  misc_feature 1..20: note = Description of Artificial Sequence: Syntheticoligonucleotide
  source 1..20: mol_type = other DNA
tggactctcgagagtccagc

SEQ ID NO: 12723 - DNA, 20 bp, synthetic construct
  misc_feature 1..20: note = Description of Artificial Sequence: Syntheticoligonucleotide
  source 1..20: mol_type = other DNA
aggactctcgagagtcctcg

SEQ ID NO: 12724 - DNA, 20 bp, synthetic construct
  misc_feature 1..20: note = Description of Artificial Sequence: Syntheticoligonucleotide
  source 1..20: mol_type = other DNA
tggactctcgagagtccacg

SEQ ID NO: 12725 - DNA, 20 bp, synthetic construct
  misc_feature 1..20: note = Description of Artificial Sequence: Syntheticoligonucleotide
  source 1..20: mol_type = other DNA
ccgactctcgagagtcggtg

SEQ ID NO: 12726 - DNA, 20 bp, synthetic construct
  misc_feature 1..20: note = Description of Artificial Sequence: Syntheticoligonucleotide
  source 1..20: mol_type = other DNA
ccgactctcgagagtcggag

SEQ ID NO: 12727 - DNA, 20 bp, synthetic construct
  misc_feature 1..20: note = Description of Artificial Sequence: Syntheticoligonucleotide
  source 1..20: mol_type = other DNA
gggactctcgagagtcccgc

SEQ ID NO: 12728 - DNA, 20 bp, synthetic construct
  misc_feature 1..20: note = Description of Artificial Sequence: Syntheticoligonucleotide
  source 1..20: mol_type = other DNA
gggactctcgagagtccctc

SEQ ID NO: 12729 - DNA, 20 bp, synthetic construct
  misc_feature 1..20: note = Description of Artificial Sequence: Syntheticoligonucleotide
  source 1..20: mol_type = other DNA
gggactctcgagagtcccac

SEQ ID NO: 12730 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactcagctgagtcnnnn

SEQ ID NO: 12731 - DNA, 20 bp, synthetic construct
  misc_feature 1..20: note = Description of Artificial Sequence: Syntheticoligonucleotide
  source 1..20: mol_type = other DNA
cggactcagctgagtccgcc

SEQ ID NO: 12732 - DNA, 20 bp, synthetic construct
  misc_feature 1..20: note = Description of Artificial Sequence: Syntheticoligonucleotide
  source 1..20: mol_type = other DNA
cggactcagctgagtccgct

SEQ ID NO: 12733 - DNA, 20 bp, synthetic construct
  misc_feature 1..20: note = Description of Artificial Sequence: Syntheticoligonucleotide
  source 1..20: mol_type = other DNA
cggactcagctgagtccgtc

SEQ ID NO: 12734 - DNA, 20 bp, synthetic construct
  misc_feature 1..20: note = Description of Artificial Sequence: Syntheticoligonucleotide
  source 1..20: mol_type = other DNA
aggactcagctgagtcctcc

SEQ ID NO: 12735 - DNA, 20 bp, synthetic construct
  misc_feature 1..20: note = Description of Artificial Sequence: Syntheticoligonucleotide
  source 1..20: mol_type = other DNA
cagactcagctgagtctgcc

SEQ ID NO: 12736 - DNA, 20 bp, synthetic construct
  misc_feature 1..20: note = Description of Artificial Sequence: Syntheticoligonucleotide
  source 1..20: mol_type = other DNA
cggactcagctgagtccgca

SEQ ID NO: 12737 - DNA, 20 bp, synthetic construct
  misc_feature 1..20: note = Description of Artificial Sequence: Syntheticoligonucleotide
  source 1..20: mol_type = other DNA
cggactcagctgagtccgac

SEQ ID NO: 12738 - DNA, 20 bp, synthetic construct
  misc_feature 1..20: note = Description of Artificial Sequence: Syntheticoligonucleotide
  source 1..20: mol_type = other DNA
tggactcagctgagtccacc

SEQ ID NO: 12739 - DNA, 20 bp, synthetic construct
  misc_feature 1..20: note = Description of Artificial Sequence: Syntheticoligonucleotide
  source 1..20: mol_type = other DNA
ctgactcagctgagtcagcc

SEQ ID NO: 12740 - DNA, 20 bp, synthetic construct
  misc_feature 1..20: note = Description of Artificial Sequence: Syntheticoligonucleotide
  source 1..20: mol_type = other DNA
ccgactcagctgagtcgggc

SEQ ID NO: 12741 - DNA, 20 bp, synthetic construct
  misc_feature 1..20: note = Description of Artificial Sequence: Syntheticoligonucleotide
  source 1..20: mol_type = other DNA
ccgactcagctgagtcgggt

SEQ ID NO: 12742 - DNA, 20 bp, synthetic construct
  misc_feature 1..20: note = Description of Artificial Sequence: Syntheticoligonucleotide
  source 1..20: mol_type = other DNA
ccgactcagctgagtcggtc

SEQ ID NO: 12743 - DNA, 20 bp, synthetic construct
  misc_feature 1..20: note = Description of Artificial Sequence: Syntheticoligonucleotide
  source 1..20: mol_type = other DNA
acgactcagctgagtcgtgc

SEQ ID NO: 12744 - DNA, 20 bp, synthetic construct
  misc_feature 1..20: note = Description of Artificial Sequence: Syntheticoligonucleotide
  source 1..20: mol_type = other DNA
cagactcagctgagtctggc

SEQ ID NO: 12745 - DNA, 20 bp, synthetic construct
  misc_feature 1..20: note = Description of Artificial Sequence: Syntheticoligonucleotide
  source 1..20: mol_type = other DNA
ccgactcagctgagtcggga

SEQ ID NO: 12746 - DNA, 20 bp, synthetic construct
  misc_feature 1..20: note = Description of Artificial Sequence: Syntheticoligonucleotide
  source 1..20: mol_type = other DNA
ccgactcagctgagtcggac

SEQ ID NO: 12747 - DNA, 20 bp, synthetic construct
  misc_feature 1..20: note = Description of Artificial Sequence: Syntheticoligonucleotide
  source 1..20: mol_type = other DNA
ctgactcagctgagtcaggc

SEQ ID NO: 12748 - DNA, 20 bp, synthetic construct
  misc_feature 1..20: note = Description of Artificial Sequence: Syntheticoligonucleotide
  source 1..20: mol_type = other DNA
gcgactcagctgagtcgccc

SEQ ID NO: 12749 - DNA, 20 bp, synthetic construct
  misc_feature 1..20: note = Description of Artificial Sequence: Syntheticoligonucleotide
  source 1..20: mol_type = other DNA
gcgactcagctgagtcgcct

SEQ ID NO: 12750 - DNA, 20 bp, synthetic construct
  misc_feature 1..20: note = Description of Artificial Sequence: Syntheticoligonucleotide
  source 1..20: mol_type = other DNA
gcgactcagctgagtcgctc

SEQ ID NO: 12751 - DNA, 20 bp, synthetic construct
  misc_feature 1..20: note = Description of Artificial Sequence: Syntheticoligonucleotide
  source 1..20: mol_type = other DNA
acgactcagctgagtcgtcc

SEQ ID NO: 12752 - DNA, 20 bp, synthetic construct
  misc_feature 1..20: note = Description of Artificial Sequence: Syntheticoligonucleotide
  source 1..20: mol_type = other DNA
gagactcagctgagtctccc

SEQ ID NO: 12753 - DNA, 20 bp, synthetic construct
  misc_feature 1..20: note = Description of Artificial Sequence: Syntheticoligonucleotide
  source 1..20: mol_type = other DNA
gcgactcagctgagtcgcca

SEQ ID NO: 12754 - DNA, 20 bp, synthetic construct
  misc_feature 1..20: note = Description of Artificial Sequence: Syntheticoligonucleotide
  source 1..20: mol_type = other DNA
gcgactcagctgagtcgcac

SEQ ID NO: 12755 - DNA, 20 bp, synthetic construct
  misc_feature 1..20: note = Description of Artificial Sequence: Syntheticoligonucleotide
  source 1..20: mol_type = other DNA
gtgactcagctgagtcaccc

SEQ ID NO: 12756 - DNA, 20 bp, synthetic construct
  misc_feature 1..20: note = Description of Artificial Sequence: Syntheticoligonucleotide
  source 1..20: mol_type = other DNA
gggactcagctgagtcccgt

SEQ ID NO: 12757 - DNA, 20 bp, synthetic construct
  misc_feature 1..20: note = Description of Artificial Sequence: Syntheticoligonucleotide
  source 1..20: mol_type = other DNA
gggactcagctgagtccctg

SEQ ID NO: 12758 - DNA, 20 bp, synthetic construct
  misc_feature 1..20: note = Description of Artificial Sequence: Syntheticoligonucleotide
  source 1..20: mol_type = other DNA
aggactcagctgagtcctgg

SEQ ID NO: 12759 - DNA, 20 bp, synthetic construct
  misc_feature 1..20: note = Description of Artificial Sequence: Syntheticoligonucleotide
  source 1..20: mol_type = other DNA
gagactcagctgagtctcgg

SEQ ID NO: 12760 - DNA, 20 bp, synthetic construct
  misc_feature 1..20: note = Description of Artificial Sequence: Syntheticoligonucleotide
  source 1..20: mol_type = other DNA
gggactcagctgagtcccga

SEQ ID NO: 12761 - DNA, 20 bp, synthetic construct
  misc_feature 1..20: note = Description of Artificial Sequence: Syntheticoligonucleotide
  source 1..20: mol_type = other DNA
gggactcagctgagtcccag

SEQ ID NO: 12762 - DNA, 20 bp, synthetic construct
  misc_feature 1..20: note = Description of Artificial Sequence: Syntheticoligonucleotide
  source 1..20: mol_type = other DNA
tggactcagctgagtccagg

SEQ ID NO: 12763 - DNA, 20 bp, synthetic construct
  misc_feature 1..20: note = Description of Artificial Sequence: Syntheticoligonucleotide
  source 1..20: mol_type = other DNA
gtgactcagctgagtcacgg

SEQ ID NO: 12764 - DNA, 20 bp, synthetic construct
  misc_feature 1..20: note = Description of Artificial Sequence: Syntheticoligonucleotide
  source 1..20: mol_type = other DNA
gcgactcagctgagtcgccg

SEQ ID NO: 12765 - DNA, 20 bp, synthetic construct
  misc_feature 1..20: note = Description of Artificial Sequence: Syntheticoligonucleotide
  source 1..20: mol_type = other DNA
gcgactcagctgagtcgctg

SEQ ID NO: 12766 - DNA, 20 bp, synthetic construct
  misc_feature 1..20: note = Description of Artificial Sequence: Syntheticoligonucleotide
  source 1..20: mol_type = other DNA
acgactcagctgagtcgtcg

SEQ ID NO: 12767 - DNA, 20 bp, synthetic construct
  misc_feature 1..20: note = Description of Artificial Sequence: Syntheticoligonucleotide
  source 1..20: mol_type = other DNA
gagactcagctgagtctccg

SEQ ID NO: 12768 - DNA, 20 bp, synthetic construct
  misc_feature 1..20: note = Description of Artificial Sequence: Syntheticoligonucleotide
  source 1..20: mol_type = other DNA
gcgactcagctgagtcgcag

SEQ ID NO: 12769 - DNA, 20 bp, synthetic construct
  misc_feature 1..20: note = Description of Artificial Sequence: Syntheticoligonucleotide
  source 1..20: mol_type = other DNA
gtgactcagctgagtcaccg

SEQ ID NO: 12770 - DNA, 20 bp, synthetic construct
  misc_feature 1..20: note = Description of Artificial Sequence: Syntheticoligonucleotide
  source 1..20: mol_type = other DNA
cggactcagctgagtccgtg

SEQ ID NO: 12771 - DNA, 20 bp, synthetic construct
  misc_feature 1..20: note = Description of Artificial Sequence: Syntheticoligonucleotide
  source 1..20: mol_type = other DNA
cagactcagctgagtctggg

SEQ ID NO: 12772 - DNA, 20 bp, synthetic construct
  misc_feature 1..20: note = Description of Artificial Sequence: Syntheticoligonucleotide
  source 1..20: mol_type = other DNA
cggactcagctgagtccgag

SEQ ID NO: 12773 - DNA, 20 bp, synthetic construct
  misc_feature 1..20: note = Description of Artificial Sequence: Syntheticoligonucleotide
  source 1..20: mol_type = other DNA
ctgactcagctgagtcaggg

SEQ ID NO: 12774 - DNA, 20 bp, synthetic construct
  misc_feature 1..20: note = Description of Artificial Sequence: Syntheticoligonucleotide
  source 1..20: mol_type = other DNA
acgactcagctgagtcgtgg

SEQ ID NO: 12775 - DNA, 20 bp, synthetic construct
  misc_feature 1..20: note = Description of Artificial Sequence: Syntheticoligonucleotide
  source 1..20: mol_type = other DNA
ccgactcagctgagtcggct

SEQ ID NO: 12776 - DNA, 20 bp, synthetic construct
  misc_feature 1..20: note = Description of Artificial Sequence: Syntheticoligonucleotide
  source 1..20: mol_type = other DNA
ccgactcagctgagtcggca

SEQ ID NO: 12777 - DNA, 20 bp, synthetic construct
  misc_feature 1..20: note = Description of Artificial Sequence: Syntheticoligonucleotide
  source 1..20: mol_type = other DNA
gagactcagctgagtctcgc

SEQ ID NO: 12778 - DNA, 20 bp, synthetic construct
  misc_feature 1..20: note = Description of Artificial Sequence: Syntheticoligonucleotide
  source 1..20: mol_type = other DNA
gtgactcagctgagtcacgc

SEQ ID NO: 12779 - DNA, 20 bp, synthetic construct
  misc_feature 1..20: note = Description of Artificial Sequence: Syntheticoligonucleotide
  source 1..20: mol_type = other DNA
aggactcagctgagtcctgc

SEQ ID NO: 12780 - DNA, 20 bp, synthetic construct
  misc_feature 1..20: note = Description of Artificial Sequence: Syntheticoligonucleotide
  source 1..20: mol_type = other DNA
tggactcagctgagtccagc

SEQ ID NO: 12781 - DNA, 20 bp, synthetic construct
  misc_feature 1..20: note = Description of Artificial Sequence: Syntheticoligonucleotide
  source 1..20: mol_type = other DNA
aggactcagctgagtcctcg

SEQ ID NO: 12782 - DNA, 20 bp, synthetic construct
  misc_feature 1..20: note = Description of Artificial Sequence: Syntheticoligonucleotide
  source 1..20: mol_type = other DNA
tggactcagctgagtccacg

SEQ ID NO: 12783 - DNA, 20 bp, synthetic construct
  misc_feature 1..20: note = Description of Artificial Sequence: Syntheticoligonucleotide
  source 1..20: mol_type = other DNA
ccgactcagctgagtcggtg

SEQ ID NO: 12784 - DNA, 20 bp, synthetic construct
  misc_feature 1..20: note = Description of Artificial Sequence: Syntheticoligonucleotide
  source 1..20: mol_type = other DNA
ccgactcagctgagtcggag

SEQ ID NO: 12785 - DNA, 20 bp, synthetic construct
  misc_feature 1..20: note = Description of Artificial Sequence: Syntheticoligonucleotide
  source 1..20: mol_type = other DNA
gggactcagctgagtcccgc

SEQ ID NO: 12786 - DNA, 20 bp, synthetic construct
  misc_feature 1..20: note = Description of Artificial Sequence: Syntheticoligonucleotide
  source 1..20: mol_type = other DNA
gggactcagctgagtccctc

SEQ ID NO: 12787 - DNA, 20 bp, synthetic construct
  misc_feature 1..20: note = Description of Artificial Sequence: Syntheticoligonucleotide
  source 1..20: mol_type = other DNA
gggactcagctgagtcccac

SEQ ID NO: 12788 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactcaattgagtcnnnn

SEQ ID NO: 12789 - DNA, 20 bp, synthetic construct
  misc_feature 1..20: note = Description of Artificial Sequence: Syntheticoligonucleotide
  source 1..20: mol_type = other DNA
cggactcaattgagtccgcc

SEQ ID NO: 12790 - DNA, 20 bp, synthetic construct
  misc_feature 1..20: note = Description of Artificial Sequence: Syntheticoligonucleotide
  source 1..20: mol_type = other DNA
cggactcaattgagtccgct

SEQ ID NO: 12791 - DNA, 20 bp, synthetic construct
  misc_feature 1..20: note = Description of Artificial Sequence: Syntheticoligonucleotide
  source 1..20: mol_type = other DNA
cggactcaattgagtccgtc

SEQ ID NO: 12792 - DNA, 20 bp, synthetic construct
  misc_feature 1..20: note = Description of Artificial Sequence: Syntheticoligonucleotide
  source 1..20: mol_type = other DNA
aggactcaattgagtcctcc

SEQ ID NO: 12793 - DNA, 20 bp, synthetic construct
  misc_feature 1..20: note = Description of Artificial Sequence: Syntheticoligonucleotide
  source 1..20: mol_type = other DNA
cagactcaattgagtctgcc

SEQ ID NO: 12794 - DNA, 20 bp, synthetic construct
  misc_feature 1..20: note = Description of Artificial Sequence: Syntheticoligonucleotide
  source 1..20: mol_type = other DNA
cggactcaattgagtccgca

SEQ ID NO: 12795 - DNA, 20 bp, synthetic construct
  misc_feature 1..20: note = Description of Artificial Sequence: Syntheticoligonucleotide
  source 1..20: mol_type = other DNA
cggactcaattgagtccgac

SEQ ID NO: 12796 - DNA, 20 bp, synthetic construct
  misc_feature 1..20: note = Description of Artificial Sequence: Syntheticoligonucleotide
  source 1..20: mol_type = other DNA
tggactcaattgagtccacc

SEQ ID NO: 12797 - DNA, 20 bp, synthetic construct
  misc_feature 1..20: note = Description of Artificial Sequence: Syntheticoligonucleotide
  source 1..20: mol_type = other DNA
ctgactcaattgagtcagcc

SEQ ID NO: 12798 - DNA, 20 bp, synthetic construct
  misc_feature 1..20: note = Description of Artificial Sequence: Syntheticoligonucleotide
  source 1..20: mol_type = other DNA
ccgactcaattgagtcgggc

SEQ ID NO: 12799 - DNA, 20 bp, synthetic construct
  misc_feature 1..20: note = Description of Artificial Sequence: Syntheticoligonucleotide
  source 1..20: mol_type = other DNA
ccgactcaattgagtcgggt

SEQ ID NO: 12800 - DNA, 20 bp, synthetic construct
  misc_feature 1..20: note = Description of Artificial Sequence: Syntheticoligonucleotide
  source 1..20: mol_type = other DNA
ccgactcaattgagtcggtc

SEQ ID NO: 12801 - DNA, 20 bp, synthetic construct
  misc_feature 1..20: note = Description of Artificial Sequence: Syntheticoligonucleotide
  source 1..20: mol_type = other DNA
acgactcaattgagtcgtgc

SEQ ID NO: 12802 - DNA, 20 bp, synthetic construct
  misc_feature 1..20: note = Description of Artificial Sequence: Syntheticoligonucleotide
  source 1..20: mol_type = other DNA
cagactcaattgagtctggc

SEQ ID NO: 12803 - DNA, 20 bp, synthetic construct
  misc_feature 1..20: note = Description of Artificial Sequence: Syntheticoligonucleotide
  source 1..20: mol_type = other DNA
ccgactcaattgagtcggga

SEQ ID NO: 12804 - DNA, 20 bp, synthetic construct
  misc_feature 1..20: note = Description of Artificial Sequence: Syntheticoligonucleotide
  source 1..20: mol_type = other DNA
ccgactcaattgagtcggac

SEQ ID NO: 12805 - DNA, 20 bp, synthetic construct
  misc_feature 1..20: note = Description of Artificial Sequence: Syntheticoligonucleotide
  source 1..20: mol_type = other DNA
ctgactcaattgagtcaggc

SEQ ID NO: 12806 - DNA, 20 bp, synthetic construct
  misc_feature 1..20: note = Description of Artificial Sequence: Syntheticoligonucleotide
  source 1..20: mol_type = other DNA
gcgactcaattgagtcgccc

SEQ ID NO: 12807 - DNA, 20 bp, synthetic construct
  misc_feature 1..20: note = Description of Artificial Sequence: Syntheticoligonucleotide
  source 1..20: mol_type = other DNA
gcgactcaattgagtcgcct

SEQ ID NO: 12808 - DNA, 20 bp, synthetic construct
  misc_feature 1..20: note = Description of Artificial Sequence: Syntheticoligonucleotide
  source 1..20: mol_type = other DNA
gcgactcaattgagtcgctc

SEQ ID NO: 12809 - DNA, 20 bp, synthetic construct
  misc_feature 1..20: note = Description of Artificial Sequence: Syntheticoligonucleotide
  source 1..20: mol_type = other DNA
acgactcaattgagtcgtcc

SEQ ID NO: 12810 - DNA, 20 bp, synthetic construct
  misc_feature 1..20: note = Description of Artificial Sequence: Syntheticoligonucleotide
  source 1..20: mol_type = other DNA
gagactcaattgagtctccc

SEQ ID NO: 12811 - DNA, 20 bp, synthetic construct
  misc_feature 1..20: note = Description of Artificial Sequence: Syntheticoligonucleotide
  source 1..20: mol_type = other DNA
gcgactcaattgagtcgcca

SEQ ID NO: 12812 - DNA, 20 bp, synthetic construct
  misc_feature 1..20: note = Description of Artificial Sequence: Syntheticoligonucleotide
  source 1..20: mol_type = other DNA
gcgactcaattgagtcgcac

SEQ ID NO: 12813 - DNA, 20 bp, synthetic construct
  misc_feature 1..20: note = Description of Artificial Sequence: Syntheticoligonucleotide
  source 1..20: mol_type = other DNA
gtgactcaattgagtcaccc

SEQ ID NO: 12814 - DNA, 20 bp, synthetic construct
  misc_feature 1..20: note = Description of Artificial Sequence: Syntheticoligonucleotide
  source 1..20: mol_type = other DNA
gggactcaattgagtcccgt

SEQ ID NO: 12815 - DNA, 20 bp, synthetic construct
  misc_feature 1..20: note = Description of Artificial Sequence: Syntheticoligonucleotide
  source 1..20: mol_type = other DNA
gggactcaattgagtccctg

SEQ ID NO: 12816 - DNA, 20 bp, synthetic construct
  misc_feature 1..20: note = Description of Artificial Sequence: Syntheticoligonucleotide
  source 1..20: mol_type = other DNA
aggactcaattgagtcctgg

SEQ ID NO: 12817 - DNA, 20 bp, synthetic construct
  misc_feature 1..20: note = Description of Artificial Sequence: Syntheticoligonucleotide
  source 1..20: mol_type = other DNA
gagactcaattgagtctcgg

SEQ ID NO: 12818 - DNA, 20 bp, synthetic construct
  misc_feature 1..20: note = Description of Artificial Sequence: Syntheticoligonucleotide
  source 1..20: mol_type = other DNA
gggactcaattgagtcccga

SEQ ID NO: 12819 - DNA, 20 bp, synthetic construct
  misc_feature 1..20: note = Description of Artificial Sequence: Syntheticoligonucleotide
  source 1..20: mol_type = other DNA
gggactcaattgagtcccag

SEQ ID NO: 12820 - DNA, 20 bp, synthetic construct
  misc_feature 1..20: note = Description of Artificial Sequence: Syntheticoligonucleotide
  source 1..20: mol_type = other DNA
tggactcaattgagtccagg

SEQ ID NO: 12821 - DNA, 20 bp, synthetic construct
  misc_feature 1..20: note = Description of Artificial Sequence: Syntheticoligonucleotide
  source 1..20: mol_type = other DNA
gtgactcaattgagtcacgg

SEQ ID NO: 12822 - DNA, 20 bp, synthetic construct
  misc_feature 1..20: note = Description of Artificial Sequence: Syntheticoligonucleotide
  source 1..20: mol_type = other DNA
gcgactcaattgagtcgccg

SEQ ID NO: 12823 - DNA, 20 bp, synthetic construct
  misc_feature 1..20: note = Description of Artificial Sequence: Syntheticoligonucleotide
  source 1..20: mol_type = other DNA
gcgactcaattgagtcgctg

SEQ ID NO: 12824 - DNA, 20 bp, synthetic construct
  misc_feature 1..20: note = Description of Artificial Sequence: Syntheticoligonucleotide
  source 1..20: mol_type = other DNA
acgactcaattgagtcgtcg

SEQ ID NO: 12825 - DNA, 20 bp, synthetic construct
  misc_feature 1..20: note = Description of Artificial Sequence: Syntheticoligonucleotide
  source 1..20: mol_type = other DNA
gagactcaattgagtctccg

SEQ ID NO: 12826 - DNA, 20 bp, synthetic construct
  misc_feature 1..20: note = Description of Artificial Sequence: Syntheticoligonucleotide
  source 1..20: mol_type = other DNA
gcgactcaattgagtcgcag

SEQ ID NO: 12827 - DNA, 20 bp, synthetic construct
  misc_feature 1..20: note = Description of Artificial Sequence: Syntheticoligonucleotide
  source 1..20: mol_type = other DNA
gtgactcaattgagtcaccg

SEQ ID NO: 12828 - DNA, 20 bp, synthetic construct
  misc_feature 1..20: note = Description of Artificial Sequence: Syntheticoligonucleotide
  source 1..20: mol_type = other DNA
cggactcaattgagtccgtg

SEQ ID NO: 12829 - DNA, 20 bp, synthetic construct
  misc_feature 1..20: note = Description of Artificial Sequence: Syntheticoligonucleotide
  source 1..20: mol_type = other DNA
cagactcaattgagtctggg

SEQ ID NO: 12830 - DNA, 20 bp, synthetic construct
  misc_feature 1..20: note = Description of Artificial Sequence: Syntheticoligonucleotide
  source 1..20: mol_type = other DNA
cggactcaattgagtccgag

SEQ ID NO: 12831 - DNA, 20 bp, synthetic construct
  misc_feature 1..20: note = Description of Artificial Sequence: Syntheticoligonucleotide
  source 1..20: mol_type = other DNA
ctgactcaattgagtcaggg

SEQ ID NO: 12832 - DNA, 20 bp, synthetic construct
  misc_feature 1..20: note = Description of Artificial Sequence: Syntheticoligonucleotide
  source 1..20: mol_type = other DNA
acgactcaattgagtcgtgg

SEQ ID NO: 12833 - DNA, 20 bp, synthetic construct
  misc_feature 1..20: note = Description of Artificial Sequence: Syntheticoligonucleotide
  source 1..20: mol_type = other DNA
ccgactcaattgagtcggct

SEQ ID NO: 12834 - DNA, 20 bp, synthetic construct
  misc_feature 1..20: note = Description of Artificial Sequence: Syntheticoligonucleotide
  source 1..20: mol_type = other DNA
ccgactcaattgagtcggca

SEQ ID NO: 12835 - DNA, 20 bp, synthetic construct
  misc_feature 1..20: note = Description of Artificial Sequence: Syntheticoligonucleotide
  source 1..20: mol_type = other DNA
gagactcaattgagtctcgc

SEQ ID NO: 12836 - DNA, 20 bp, synthetic construct
  misc_feature 1..20: note = Description of Artificial Sequence: Syntheticoligonucleotide
  source 1..20: mol_type = other DNA
gtgactcaattgagtcacgc

SEQ ID NO: 12837 - DNA, 20 bp, synthetic construct
  misc_feature 1..20: note = Description of Artificial Sequence: Syntheticoligonucleotide
  source 1..20: mol_type = other DNA
aggactcaattgagtcctgc

SEQ ID NO: 12838 - DNA, 20 bp, synthetic construct
  misc_feature 1..20: note = Description of Artificial Sequence: Syntheticoligonucleotide
  source 1..20: mol_type = other DNA
tggactcaattgagtccagc

SEQ ID NO: 12839 - DNA, 20 bp, synthetic construct
  misc_feature 1..20: note = Description of Artificial Sequence: Syntheticoligonucleotide
  source 1..20: mol_type = other DNA
aggactcaattgagtcctcg

SEQ ID NO: 12840 - DNA, 20 bp, synthetic construct
  misc_feature 1..20: note = Description of Artificial Sequence: Syntheticoligonucleotide
  source 1..20: mol_type = other DNA
tggactcaattgagtccacg

SEQ ID NO: 12841 - DNA, 20 bp, synthetic construct
  misc_feature 1..20: note = Description of Artificial Sequence: Syntheticoligonucleotide
  source 1..20: mol_type = other DNA
ccgactcaattgagtcggtg

SEQ ID NO: 12842 - DNA, 20 bp, synthetic construct
  misc_feature 1..20: note = Description of Artificial Sequence: Syntheticoligonucleotide
  source 1..20: mol_type = other DNA
ccgactcaattgagtcggag

SEQ ID NO: 12843 - DNA, 20 bp, synthetic construct
  misc_feature 1..20: note = Description of Artificial Sequence: Syntheticoligonucleotide
  source 1..20: mol_type = other DNA
gggactcaattgagtcccgc

SEQ ID NO: 12844 - DNA, 20 bp, synthetic construct
  misc_feature 1..20: note = Description of Artificial Sequence: Syntheticoligonucleotide
  source 1..20: mol_type = other DNA
gggactcaattgagtccctc

SEQ ID NO: 12845 - DNA, 20 bp, synthetic construct
  misc_feature 1..20: note = Description of Artificial Sequence: Syntheticoligonucleotide
  source 1..20: mol_type = other DNA
gggactcaattgagtcccac

SEQ ID NO: 12846 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactctatagagtcnnnn

SEQ ID NO: 12847 - DNA, 20 bp, synthetic construct
  misc_feature 1..20: note = Description of Artificial Sequence: Syntheticoligonucleotide
  source 1..20: mol_type = other DNA
cggactctatagagtccgcc

SEQ ID NO: 12848 - DNA, 20 bp, synthetic construct
  misc_feature 1..20: note = Description of Artificial Sequence: Syntheticoligonucleotide
  source 1..20: mol_type = other DNA
cggactctatagagtccgct

SEQ ID NO: 12849 - DNA, 20 bp, synthetic construct
  misc_feature 1..20: note = Description of Artificial Sequence: Syntheticoligonucleotide
  source 1..20: mol_type = other DNA
cggactctatagagtccgtc

SEQ ID NO: 12850 - DNA, 20 bp, synthetic construct
  misc_feature 1..20: note = Description of Artificial Sequence: Syntheticoligonucleotide
  source 1..20: mol_type = other DNA
aggactctatagagtcctcc

SEQ ID NO: 12851 - DNA, 20 bp, synthetic construct
  misc_feature 1..20: note = Description of Artificial Sequence: Syntheticoligonucleotide
  source 1..20: mol_type = other DNA
cagactctatagagtctgcc

SEQ ID NO: 12852 - DNA, 20 bp, synthetic construct
  misc_feature 1..20: note = Description of Artificial Sequence: Syntheticoligonucleotide
  source 1..20: mol_type = other DNA
cggactctatagagtccgca

SEQ ID NO: 12853 - DNA, 20 bp, synthetic construct
  misc_feature 1..20: note = Description of Artificial Sequence: Syntheticoligonucleotide
  source 1..20: mol_type = other DNA
cggactctatagagtccgac

SEQ ID NO: 12854 - DNA, 20 bp, synthetic construct
  misc_feature 1..20: note = Description of Artificial Sequence: Syntheticoligonucleotide
  source 1..20: mol_type = other DNA
tggactctatagagtccacc

SEQ ID NO: 12855 - DNA, 20 bp, synthetic construct
  misc_feature 1..20: note = Description of Artificial Sequence: Syntheticoligonucleotide
  source 1..20: mol_type = other DNA
ctgactctatagagtcagcc

SEQ ID NO: 12856 - DNA, 20 bp, synthetic construct
  misc_feature 1..20: note = Description of Artificial Sequence: Syntheticoligonucleotide
  source 1..20: mol_type = other DNA
ccgactctatagagtcgggc

SEQ ID NO: 12857 - DNA, 20 bp, synthetic construct
  misc_feature 1..20: note = Description of Artificial Sequence: Syntheticoligonucleotide
  source 1..20: mol_type = other DNA
ccgactctatagagtcgggt

SEQ ID NO: 12858 - DNA, 20 bp, synthetic construct
  misc_feature 1..20: note = Description of Artificial Sequence: Syntheticoligonucleotide
  source 1..20: mol_type = other DNA
ccgactctatagagtcggtc

SEQ ID NO: 12859 - DNA, 20 bp, synthetic construct
  misc_feature 1..20: note = Description of Artificial Sequence: Syntheticoligonucleotide
  source 1..20: mol_type = other DNA
acgactctatagagtcgtgc

SEQ ID NO: 12860 - DNA, 20 bp, synthetic construct
  misc_feature 1..20: note = Description of Artificial Sequence: Syntheticoligonucleotide
  source 1..20: mol_type = other DNA
cagactctatagagtctggc

SEQ ID NO: 12861 - DNA, 20 bp, synthetic construct
  misc_feature 1..20: note = Description of Artificial Sequence: Syntheticoligonucleotide
  source 1..20: mol_type = other DNA
ccgactctatagagtcggga

SEQ ID NO: 12862 - DNA, 20 bp, synthetic construct
  misc_feature 1..20: note = Description of Artificial Sequence: Syntheticoligonucleotide
  source 1..20: mol_type = other DNA
ccgactctatagagtcggac

SEQ ID NO: 12863 - DNA, 20 bp, synthetic construct
  misc_feature 1..20: note = Description of Artificial Sequence: Syntheticoligonucleotide
  source 1..20: mol_type = other DNA
ctgactctatagagtcaggc

SEQ ID NO: 12864 - DNA, 20 bp, synthetic construct
  misc_feature 1..20: note = Description of Artificial Sequence: Syntheticoligonucleotide
  source 1..20: mol_type = other DNA
gcgactctatagagtcgccc

SEQ ID NO: 12865 - DNA, 20 bp, synthetic construct
  misc_feature 1..20: note = Description of Artificial Sequence: Syntheticoligonucleotide
  source 1..20: mol_type = other DNA
gcgactctatagagtcgcct

SEQ ID NO: 12866 - DNA, 20 bp, synthetic construct
  misc_feature 1..20: note = Description of Artificial Sequence: Syntheticoligonucleotide
  source 1..20: mol_type = other DNA
gcgactctatagagtcgctc

SEQ ID NO: 12867 - DNA, 20 bp, synthetic construct
  misc_feature 1..20: note = Description of Artificial Sequence: Syntheticoligonucleotide
  source 1..20: mol_type = other DNA
acgactctatagagtcgtcc

SEQ ID NO: 12868 - DNA, 20 bp, synthetic construct
  misc_feature 1..20: note = Description of Artificial Sequence: Syntheticoligonucleotide
  source 1..20: mol_type = other DNA
gagactctatagagtctccc

SEQ ID NO: 12869 - DNA, 20 bp, synthetic construct
  misc_feature 1..20: note = Description of Artificial Sequence: Syntheticoligonucleotide
  source 1..20: mol_type = other DNA
gcgactctatagagtcgcca

SEQ ID NO: 12870 - DNA, 20 bp, synthetic construct
  misc_feature 1..20: note = Description of Artificial Sequence: Syntheticoligonucleotide
  source 1..20: mol_type = other DNA
gcgactctatagagtcgcac

SEQ ID NO: 12871 - DNA, 20 bp, synthetic construct
  misc_feature 1..20: note = Description of Artificial Sequence: Syntheticoligonucleotide
  source 1..20: mol_type = other DNA
gtgactctatagagtcaccc

SEQ ID NO: 12872 - DNA, 20 bp, synthetic construct
  misc_feature 1..20: note = Description of Artificial Sequence: Syntheticoligonucleotide
  source 1..20: mol_type = other DNA
gggactctatagagtcccgt

SEQ ID NO: 12873 - DNA, 20 bp, synthetic construct
  misc_feature 1..20: note = Description of Artificial Sequence: Syntheticoligonucleotide
  source 1..20: mol_type = other DNA
gggactctatagagtccctg

SEQ ID NO: 12874 - DNA, 20 bp, synthetic construct
  misc_feature 1..20: note = Description of Artificial Sequence: Syntheticoligonucleotide
  source 1..20: mol_type = other DNA
aggactctatagagtcctgg

SEQ ID NO: 12875 - DNA, 20 bp, synthetic construct
  misc_feature 1..20: note = Description of Artificial Sequence: Syntheticoligonucleotide
  source 1..20: mol_type = other DNA
gagactctatagagtctcgg

SEQ ID NO: 12876 - DNA, 20 bp, synthetic construct
  misc_feature 1..20: note = Description of Artificial Sequence: Syntheticoligonucleotide
  source 1..20: mol_type = other DNA
gggactctatagagtcccga

SEQ ID NO: 12877 - DNA, 20 bp, synthetic construct
  misc_feature 1..20: note = Description of Artificial Sequence: Syntheticoligonucleotide
  source 1..20: mol_type = other DNA
gggactctatagagtcccag

SEQ ID NO: 12878 - DNA, 20 bp, synthetic construct
  misc_feature 1..20: note = Description of Artificial Sequence: Syntheticoligonucleotide
  source 1..20: mol_type = other DNA
tggactctatagagtccagg

SEQ ID NO: 12879 - DNA, 20 bp, synthetic construct
  misc_feature 1..20: note = Description of Artificial Sequence: Syntheticoligonucleotide
  source 1..20: mol_type = other DNA
gtgactctatagagtcacgg

SEQ ID NO: 12880 - DNA, 20 bp, synthetic construct
  misc_feature 1..20: note = Description of Artificial Sequence: Syntheticoligonucleotide
  source 1..20: mol_type = other DNA
gcgactctatagagtcgccg

SEQ ID NO: 12881 - DNA, 20 bp, synthetic construct
  misc_feature 1..20: note = Description of Artificial Sequence: Syntheticoligonucleotide
  source 1..20: mol_type = other DNA
gcgactctatagagtcgctg

SEQ ID NO: 12882 - DNA, 20 bp, synthetic construct
  misc_feature 1..20: note = Description of Artificial Sequence: Syntheticoligonucleotide
  source 1..20: mol_type = other DNA
acgactctatagagtcgtcg

SEQ ID NO: 12883 - DNA, 20 bp, synthetic construct
  misc_feature 1..20: note = Description of Artificial Sequence: Syntheticoligonucleotide
  source 1..20: mol_type = other DNA
gagactctatagagtctccg

SEQ ID NO: 12884 - DNA, 20 bp, synthetic construct
  misc_feature 1..20: note = Description of Artificial Sequence: Syntheticoligonucleotide
  source 1..20: mol_type = other DNA
gcgactctatagagtcgcag

SEQ ID NO: 12885 - DNA, 20 bp, synthetic construct
  misc_feature 1..20: note = Description of Artificial Sequence: Syntheticoligonucleotide
  source 1..20: mol_type = other DNA
gtgactctatagagtcaccg

SEQ ID NO: 12886 - DNA, 20 bp, synthetic construct
  misc_feature 1..20: note = Description of Artificial Sequence: Syntheticoligonucleotide
  source 1..20: mol_type = other DNA
cggactctatagagtccgtg

SEQ ID NO: 12887 - DNA, 20 bp, synthetic construct
  misc_feature 1..20: note = Description of Artificial Sequence: Syntheticoligonucleotide
  source 1..20: mol_type = other DNA
cagactctatagagtctggg

SEQ ID NO: 12888 - DNA, 20 bp, synthetic construct
  misc_feature 1..20: note = Description of Artificial Sequence: Syntheticoligonucleotide
  source 1..20: mol_type = other DNA
cggactctatagagtccgag

SEQ ID NO: 12889 - DNA, 20 bp, synthetic construct
  misc_feature 1..20: note = Description of Artificial Sequence: Syntheticoligonucleotide
  source 1..20: mol_type = other DNA
ctgactctatagagtcaggg

SEQ ID NO: 12890 - DNA, 20 bp, synthetic construct
  misc_feature 1..20: note = Description of Artificial Sequence: Syntheticoligonucleotide
  source 1..20: mol_type = other DNA
acgactctatagagtcgtgg

SEQ ID NO: 12891 - DNA, 20 bp, synthetic construct
  misc_feature 1..20: note = Description of Artificial Sequence: Syntheticoligonucleotide
  source 1..20: mol_type = other DNA
ccgactctatagagtcggct

SEQ ID NO: 12892 - DNA, 20 bp, synthetic construct
  misc_feature 1..20: note = Description of Artificial Sequence: Syntheticoligonucleotide
  source 1..20: mol_type = other DNA
ccgactctatagagtcggca

SEQ ID NO: 12893 - DNA, 20 bp, synthetic construct
  misc_feature 1..20: note = Description of Artificial Sequence: Syntheticoligonucleotide
  source 1..20: mol_type = other DNA
gagactctatagagtctcgc

SEQ ID NO: 12894 - DNA, 20 bp, synthetic construct
  misc_feature 1..20: note = Description of Artificial Sequence: Syntheticoligonucleotide
  source 1..20: mol_type = other DNA
gtgactctatagagtcacgc

SEQ ID NO: 12895 - DNA, 20 bp, synthetic construct
  misc_feature 1..20: note = Description of Artificial Sequence: Syntheticoligonucleotide
  source 1..20: mol_type = other DNA
aggactctatagagtcctgc

SEQ ID NO: 12896 - DNA, 20 bp, synthetic construct
  misc_feature 1..20: note = Description of Artificial Sequence: Syntheticoligonucleotide
  source 1..20: mol_type = other DNA
tggactctatagagtccagc

SEQ ID NO: 12897 - DNA, 20 bp, synthetic construct
  misc_feature 1..20: note = Description of Artificial Sequence: Syntheticoligonucleotide
  source 1..20: mol_type = other DNA
aggactctatagagtcctcg

SEQ ID NO: 12898 - DNA, 20 bp, synthetic construct
  misc_feature 1..20: note = Description of Artificial Sequence: Syntheticoligonucleotide
  source 1..20: mol_type = other DNA
tggactctatagagtccacg

SEQ ID NO: 12899 - DNA, 20 bp, synthetic construct
  misc_feature 1..20: note = Description of Artificial Sequence: Syntheticoligonucleotide
  source 1..20: mol_type = other DNA
ccgactctatagagtcggtg

SEQ ID NO: 12900 - DNA, 20 bp, synthetic construct
  misc_feature 1..20: note = Description of Artificial Sequence: Syntheticoligonucleotide
  source 1..20: mol_type = other DNA
ccgactctatagagtcggag

SEQ ID NO: 12901 - DNA, 20 bp, synthetic construct
  misc_feature 1..20: note = Description of Artificial Sequence: Syntheticoligonucleotide
  source 1..20: mol_type = other DNA
gggactctatagagtcccgc

SEQ ID NO: 12902 - DNA, 20 bp, synthetic construct
  misc_feature 1..20: note = Description of Artificial Sequence: Syntheticoligonucleotide
  source 1..20: mol_type = other DNA
gggactctatagagtccctc

SEQ ID NO: 12903 - DNA, 20 bp, synthetic construct
  misc_feature 1..20: note = Description of Artificial Sequence: Syntheticoligonucleotide
  source 1..20: mol_type = other DNA
gggactctatagagtcccac

SEQ ID NO: 12904 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactcatatgagtcnnnn

SEQ ID NO: 12905 - DNA, 20 bp, synthetic construct
  misc_feature 1..20: note = Description of Artificial Sequence: Syntheticoligonucleotide
  source 1..20: mol_type = other DNA
cggactcatatgagtccgcc

SEQ ID NO: 12906 - DNA, 20 bp, synthetic construct
  misc_feature 1..20: note = Description of Artificial Sequence: Syntheticoligonucleotide
  source 1..20: mol_type = other DNA
cggactcatatgagtccgct

SEQ ID NO: 12907 - DNA, 20 bp, synthetic construct
  misc_feature 1..20: note = Description of Artificial Sequence: Syntheticoligonucleotide
  source 1..20: mol_type = other DNA
cggactcatatgagtccgtc

SEQ ID NO: 12908 - DNA, 20 bp, synthetic construct
  misc_feature 1..20: note = Description of Artificial Sequence: Syntheticoligonucleotide
  source 1..20: mol_type = other DNA
aggactcatatgagtcctcc

SEQ ID NO: 12909 - DNA, 20 bp, synthetic construct
  misc_feature 1..20: note = Description of Artificial Sequence: Syntheticoligonucleotide
  source 1..20: mol_type = other DNA
cagactcatatgagtctgcc

SEQ ID NO: 12910 - DNA, 20 bp, synthetic construct
  misc_feature 1..20: note = Description of Artificial Sequence: Syntheticoligonucleotide
  source 1..20: mol_type = other DNA
cggactcatatgagtccgca

SEQ ID NO: 12911 - DNA, 20 bp, synthetic construct
  misc_feature 1..20: note = Description of Artificial Sequence: Syntheticoligonucleotide
  source 1..20: mol_type = other DNA
cggactcatatgagtccgac

SEQ ID NO: 12912 - DNA, 20 bp, synthetic construct
  misc_feature 1..20: note = Description of Artificial Sequence: Syntheticoligonucleotide
  source 1..20: mol_type = other DNA
tggactcatatgagtccacc

SEQ ID NO: 12913 - DNA, 20 bp, synthetic construct
  misc_feature 1..20: note = Description of Artificial Sequence: Syntheticoligonucleotide
  source 1..20: mol_type = other DNA
ctgactcatatgagtcagcc

SEQ ID NO: 12914 - DNA, 20 bp, synthetic construct
  misc_feature 1..20: note = Description of Artificial Sequence: Syntheticoligonucleotide
  source 1..20: mol_type = other DNA
ccgactcatatgagtcgggc

SEQ ID NO: 12915 - DNA, 20 bp, synthetic construct
  misc_feature 1..20: note = Description of Artificial Sequence: Syntheticoligonucleotide
  source 1..20: mol_type = other DNA
ccgactcatatgagtcgggt

SEQ ID NO: 12916 - DNA, 20 bp, synthetic construct
  misc_feature 1..20: note = Description of Artificial Sequence: Syntheticoligonucleotide
  source 1..20: mol_type = other DNA
ccgactcatatgagtcggtc

SEQ ID NO: 12917 - DNA, 20 bp, synthetic construct
  misc_feature 1..20: note = Description of Artificial Sequence: Syntheticoligonucleotide
  source 1..20: mol_type = other DNA
acgactcatatgagtcgtgc

SEQ ID NO: 12918 - DNA, 20 bp, synthetic construct
  misc_feature 1..20: note = Description of Artificial Sequence: Syntheticoligonucleotide
  source 1..20: mol_type = other DNA
cagactcatatgagtctggc

SEQ ID NO: 12919 - DNA, 20 bp, synthetic construct
  misc_feature 1..20: note = Description of Artificial Sequence: Syntheticoligonucleotide
  source 1..20: mol_type = other DNA
ccgactcatatgagtcggga

SEQ ID NO: 12920 - DNA, 20 bp, synthetic construct
  misc_feature 1..20: note = Description of Artificial Sequence: Syntheticoligonucleotide
  source 1..20: mol_type = other DNA
ccgactcatatgagtcggac

SEQ ID NO: 12921 - DNA, 20 bp, synthetic construct
  misc_feature 1..20: note = Description of Artificial Sequence: Syntheticoligonucleotide
  source 1..20: mol_type = other DNA
ctgactcatatgagtcaggc

SEQ ID NO: 12922 - DNA, 20 bp, synthetic construct
  misc_feature 1..20: note = Description of Artificial Sequence: Syntheticoligonucleotide
  source 1..20: mol_type = other DNA
gcgactcatatgagtcgccc

SEQ ID NO: 12923 - DNA, 20 bp, synthetic construct
  misc_feature 1..20: note = Description of Artificial Sequence: Syntheticoligonucleotide
  source 1..20: mol_type = other DNA
gcgactcatatgagtcgcct

SEQ ID NO: 12924 - DNA, 20 bp, synthetic construct
  misc_feature 1..20: note = Description of Artificial Sequence: Syntheticoligonucleotide
  source 1..20: mol_type = other DNA
gcgactcatatgagtcgctc

SEQ ID NO: 12925 - DNA, 20 bp, synthetic construct
  misc_feature 1..20: note = Description of Artificial Sequence: Syntheticoligonucleotide
  source 1..20: mol_type = other DNA
acgactcatatgagtcgtcc

SEQ ID NO: 12926 - DNA, 20 bp, synthetic construct
  misc_feature 1..20: note = Description of Artificial Sequence: Syntheticoligonucleotide
  source 1..20: mol_type = other DNA
gagactcatatgagtctccc

SEQ ID NO: 12927 - DNA, 20 bp, synthetic construct
  misc_feature 1..20: note = Description of Artificial Sequence: Syntheticoligonucleotide
  source 1..20: mol_type = other DNA
gcgactcatatgagtcgcca

SEQ ID NO: 12928 - DNA, 20 bp, synthetic construct
  misc_feature 1..20: note = Description of Artificial Sequence: Syntheticoligonucleotide
  source 1..20: mol_type = other DNA
gcgactcatatgagtcgcac

SEQ ID NO: 12929 - DNA, 20 bp, synthetic construct
  misc_feature 1..20: note = Description of Artificial Sequence: Syntheticoligonucleotide
  source 1..20: mol_type = other DNA
gtgactcatatgagtcaccc

SEQ ID NO: 12930 - DNA, 20 bp, synthetic construct
  misc_feature 1..20: note = Description of Artificial Sequence: Syntheticoligonucleotide
  source 1..20: mol_type = other DNA
gggactcatatgagtcccgt

SEQ ID NO: 12931 - DNA, 20 bp, synthetic construct
  misc_feature 1..20: note = Description of Artificial Sequence: Syntheticoligonucleotide
  source 1..20: mol_type = other DNA
gggactcatatgagtccctg

SEQ ID NO: 12932 - DNA, 20 bp, synthetic construct
  misc_feature 1..20: note = Description of Artificial Sequence: Syntheticoligonucleotide
  source 1..20: mol_type = other DNA
aggactcatatgagtcctgg

SEQ ID NO: 12933 - DNA, 20 bp, synthetic construct
  misc_feature 1..20: note = Description of Artificial Sequence: Syntheticoligonucleotide
  source 1..20: mol_type = other DNA
gagactcatatgagtctcgg

SEQ ID NO: 12934 - DNA, 20 bp, synthetic construct
  misc_feature 1..20: note = Description of Artificial Sequence: Syntheticoligonucleotide
  source 1..20: mol_type = other DNA
gggactcatatgagtcccga

SEQ ID NO: 12935 - DNA, 20 bp, synthetic construct
  misc_feature 1..20: note = Description of Artificial Sequence: Syntheticoligonucleotide
  source 1..20: mol_type = other DNA
gggactcatatgagtcccag

SEQ ID NO: 12936 - DNA, 20 bp, synthetic construct
  misc_feature 1..20: note = Description of Artificial Sequence: Syntheticoligonucleotide
  source 1..20: mol_type = other DNA
tggactcatatgagtccagg

SEQ ID NO: 12937 - DNA, 20 bp, synthetic construct
  misc_feature 1..20: note = Description of Artificial Sequence: Syntheticoligonucleotide
  source 1..20: mol_type = other DNA
gtgactcatatgagtcacgg

SEQ ID NO: 12938 - DNA, 20 bp, synthetic construct
  misc_feature 1..20: note = Description of Artificial Sequence: Syntheticoligonucleotide
  source 1..20: mol_type = other DNA
gcgactcatatgagtcgccg

SEQ ID NO: 12939 - DNA, 20 bp, synthetic construct
  misc_feature 1..20: note = Description of Artificial Sequence: Syntheticoligonucleotide
  source 1..20: mol_type = other DNA
gcgactcatatgagtcgctg

SEQ ID NO: 12940 - DNA, 20 bp, synthetic construct
  misc_feature 1..20: note = Description of Artificial Sequence: Syntheticoligonucleotide
  source 1..20: mol_type = other DNA
acgactcatatgagtcgtcg

SEQ ID NO: 12941 - DNA, 20 bp, synthetic construct
  misc_feature 1..20: note = Description of Artificial Sequence: Syntheticoligonucleotide
  source 1..20: mol_type = other DNA
gagactcatatgagtctccg

SEQ ID NO: 12942 - DNA, 20 bp, synthetic construct
  misc_feature 1..20: note = Description of Artificial Sequence: Syntheticoligonucleotide
  source 1..20: mol_type = other DNA
gcgactcatatgagtcgcag

SEQ ID NO: 12943 - DNA, 20 bp, synthetic construct
  misc_feature 1..20: note = Description of Artificial Sequence: Syntheticoligonucleotide
  source 1..20: mol_type = other DNA
gtgactcatatgagtcaccg

SEQ ID NO: 12944 - DNA, 20 bp, synthetic construct
  misc_feature 1..20: note = Description of Artificial Sequence: Syntheticoligonucleotide
  source 1..20: mol_type = other DNA
cggactcatatgagtccgtg

SEQ ID NO: 12945 - DNA, 20 bp, synthetic construct
  misc_feature 1..20: note = Description of Artificial Sequence: Syntheticoligonucleotide
  source 1..20: mol_type = other DNA
cagactcatatgagtctggg

SEQ ID NO: 12946 - DNA, 20 bp, synthetic construct
  misc_feature 1..20: note = Description of Artificial Sequence: Syntheticoligonucleotide
  source 1..20: mol_type = other DNA
cggactcatatgagtccgag

SEQ ID NO: 12947 - DNA, 20 bp, synthetic construct
  misc_feature 1..20: note = Description of Artificial Sequence: Syntheticoligonucleotide
  source 1..20: mol_type = other DNA
ctgactcatatgagtcaggg

SEQ ID NO: 12948 - DNA, 20 bp, synthetic construct
  misc_feature 1..20: note = Description of Artificial Sequence: Syntheticoligonucleotide
  source 1..20: mol_type = other DNA
acgactcatatgagtcgtgg

SEQ ID NO: 12949 - DNA, 20 bp, synthetic construct
  misc_feature 1..20: note = Description of Artificial Sequence: Syntheticoligonucleotide
  source 1..20: mol_type = other DNA
ccgactcatatgagtcggct

SEQ ID NO: 12950 - DNA, 20 bp, synthetic construct
  misc_feature 1..20: note = Description of Artificial Sequence: Syntheticoligonucleotide
  source 1..20: mol_type = other DNA
ccgactcatatgagtcggca

SEQ ID NO: 12951 - DNA, 20 bp, synthetic construct
  misc_feature 1..20: note = Description of Artificial Sequence: Syntheticoligonucleotide
  source 1..20: mol_type = other DNA
gagactcatatgagtctcgc

SEQ ID NO: 12952 - DNA, 20 bp, synthetic construct
  misc_feature 1..20: note = Description of Artificial Sequence: Syntheticoligonucleotide
  source 1..20: mol_type = other DNA
gtgactcatatgagtcacgc

SEQ ID NO: 12953 - DNA, 20 bp, synthetic construct
  misc_feature 1..20: note = Description of Artificial Sequence: Syntheticoligonucleotide
  source 1..20: mol_type = other DNA
aggactcatatgagtcctgc

SEQ ID NO: 12954 - DNA, 20 bp, synthetic construct
  misc_feature 1..20: note = Description of Artificial Sequence: Syntheticoligonucleotide
  source 1..20: mol_type = other DNA
tggactcatatgagtccagc

SEQ ID NO: 12955 - DNA, 20 bp, synthetic construct
  misc_feature 1..20: note = Description of Artificial Sequence: Syntheticoligonucleotide
  source 1..20: mol_type = other DNA
aggactcatatgagtcctcg

SEQ ID NO: 12956 - DNA, 20 bp, synthetic construct
  misc_feature 1..20: note = Description of Artificial Sequence: Syntheticoligonucleotide
  source 1..20: mol_type = other DNA
tggactcatatgagtccacg

SEQ ID NO: 12957 - DNA, 20 bp, synthetic construct
  misc_feature 1..20: note = Description of Artificial Sequence: Syntheticoligonucleotide
  source 1..20: mol_type = other DNA
ccgactcatatgagtcggtg

SEQ ID NO: 12958 - DNA, 20 bp, synthetic construct
  misc_feature 1..20: note = Description of Artificial Sequence: Syntheticoligonucleotide
  source 1..20: mol_type = other DNA
ccgactcatatgagtcggag

SEQ ID NO: 12959 - DNA, 20 bp, synthetic construct
  misc_feature 1..20: note = Description of Artificial Sequence: Syntheticoligonucleotide
  source 1..20: mol_type = other DNA
gggactcatatgagtcccgc

SEQ ID NO: 12960 - DNA, 20 bp, synthetic construct
  misc_feature 1..20: note = Description of Artificial Sequence: Syntheticoligonucleotide
  source 1..20: mol_type = other DNA
gggactcatatgagtccctc

SEQ ID NO: 12961 - DNA, 20 bp, synthetic construct
  misc_feature 1..20: note = Description of Artificial Sequence: Syntheticoligonucleotide
  source 1..20: mol_type = other DNA
gggactcatatgagtcccac

SEQ ID NO: 12962 - DNA, 20 bp, synthetic construct
  misc_feature 1..20: note = Description of Artificial Sequence: Syntheticoligonucleotide
  misc_difference 1..2: note = a, c, t, or g
  misc_difference 17..20: note = a, c, t, or g
  source 1..20: mol_type = other DNA
nngactcttaagagtcnnnn

SEQ ID NO: 12963 - DNA, 20 bp, synthetic construct
  misc_feature 1..20: note = Description of Artificial Sequence: Syntheticoligonucleotide
  source 1..20: mol_type = other DNA
cggactcttaagagtccgcc

SEQ ID NO: 12964 - DNA, 20 bp, synthetic construct
  misc_feature 1..20: note = Description of Artificial Sequence: Syntheticoligonucleotide
  source 1..20: mol_type = other DNA
cggactcttaagagtccgct

SEQ ID NO: 12965 - DNA, 20 bp, synthetic construct
  misc_feature 1..20: note = Description of Artificial Sequence: Syntheticoligonucleotide
  source 1..20: mol_type = other DNA
cggactcttaagagtccgtc

SEQ ID NO: 12966 - DNA, 20 bp, synthetic construct
  misc_feature 1..20: note = Description of Artificial Sequence: Syntheticoligonucleotide
  source 1..20: mol_type = other DNA
aggactcttaagagtcctcc

SEQ ID NO: 12967 - DNA, 20 bp, synthetic construct
  misc_feature 1..20: note = Description of Artificial Sequence: Syntheticoligonucleotide
  source 1..20: mol_type = other DNA
cagactcttaagagtctgcc

SEQ ID NO: 12968 - DNA, 20 bp, synthetic construct
  misc_feature 1..20: note = Description of Artificial Sequence: Syntheticoligonucleotide
  source 1..20: mol_type = other DNA
cggactcttaagagtccgca

SEQ ID NO: 12969 - DNA, 20 bp, synthetic construct
  misc_feature 1..20: note = Description of Artificial Sequence: Syntheticoligonucleotide
  source 1..20: mol_type = other DNA
cggactcttaagagtccgac

SEQ ID NO: 12970 - DNA, 20 bp, synthetic construct
  misc_feature 1..20: note = Description of Artificial Sequence: Syntheticoligonucleotide
  source 1..20: mol_type = other DNA
tggactcttaagagtccacc

SEQ ID NO: 12971 - DNA, 20 bp, synthetic construct
  misc_feature 1..20: note = Description of Artificial Sequence: Syntheticoligonucleotide
  source 1..20: mol_type = other DNA
ctgactcttaagagtcagcc

SEQ ID NO: 12972 - DNA, 20 bp, synthetic construct
  misc_feature 1..20: note = Description of Artificial Sequence: Syntheticoligonucleotide
  source 1..20: mol_type = other DNA
ccgactcttaagagtcgggc

SEQ ID NO: 12973 - DNA, 20 bp, synthetic construct
  misc_feature 1..20: note = Description of Artificial Sequence: Syntheticoligonucleotide
  source 1..20: mol_type = other DNA
ccgactcttaagagtcgggt

SEQ ID NO: 12974 - DNA, 20 bp, synthetic construct
  misc_feature 1..20: note = Description of Artificial Sequence: Syntheticoligonucleotide
  source 1..20: mol_type = other DNA
ccgactcttaagagtcggtc

SEQ ID NO: 12975 - DNA, 20 bp, synthetic construct
  misc_feature 1..20: note = Description of Artificial Sequence: Syntheticoligonucleotide
  source 1..20: mol_type = other DNA
acgactcttaagagtcgtgc

SEQ ID NO: 12976 - DNA, 20 bp, synthetic construct
  misc_feature 1..20: note = Description of Artificial Sequence: Syntheticoligonucleotide
  source 1..20: mol_type = other DNA
cagactcttaagagtctggc

SEQ ID NO: 12977 - DNA, 20 bp, synthetic construct
  misc_feature 1..20: note = Description of Artificial Sequence: Syntheticoligonucleotide
  source 1..20: mol_type = other DNA
ccgactcttaagagtcggga

SEQ ID NO: 12978 - DNA, 20 bp, synthetic construct
  misc_feature 1..20: note = Description of Artificial Sequence: Syntheticoligonucleotide
  source 1..20: mol_type = other DNA
ccgactcttaagagtcggac

SEQ ID NO: 12979 - DNA, 20 bp, synthetic construct
  misc_feature 1..20: note = Description of Artificial Sequence: Syntheticoligonucleotide
  source 1..20: mol_type = other DNA
ctgactcttaagagtcaggc

SEQ ID NO: 12980 - DNA, 20 bp, synthetic construct
  misc_feature 1..20: note = Description of Artificial Sequence: Syntheticoligonucleotide
  source 1..20: mol_type = other DNA
gcgactcttaagagtcgccc

SEQ ID NO: 12981 - DNA, 20 bp, synthetic construct
  misc_feature 1..20: note = Description of Artificial Sequence: Syntheticoligonucleotide
  source 1..20: mol_type = other DNA
gcgactcttaagagtcgcct

SEQ ID NO: 12982 - DNA, 20 bp, synthetic construct
  misc_feature 1..20: note = Description of Artificial Sequence: Syntheticoligonucleotide
  source 1..20: mol_type = other DNA
gcgactcttaagagtcgctc

SEQ ID NO: 12983 - DNA, 20 bp, synthetic construct
  misc_feature 1..20: note = Description of Artificial Sequence: Syntheticoligonucleotide
  source 1..20: mol_type = other DNA
acgactcttaagagtcgtcc

SEQ ID NO: 12984 - DNA, 20 bp, synthetic construct
  misc_feature 1..20: note = Description of Artificial Sequence: Syntheticoligonucleotide
  source 1..20: mol_type = other DNA
gagactcttaagagtctccc

SEQ ID NO: 12985 - DNA, 20 bp, synthetic construct
  misc_feature 1..20: note = Description of Artificial Sequence: Syntheticoligonucleotide
  source 1..20: mol_type = other DNA
gcgactcttaagagtcgcca

SEQ ID NO: 12986 - DNA, 20 bp, synthetic construct
  misc_feature 1..20: note = Description of Artificial Sequence: Syntheticoligonucleotide
  source 1..20: mol_type = other DNA
gcgactcttaagagtcgcac

SEQ ID NO: 12987 - DNA, 20 bp, synthetic construct
  misc_feature 1..20: note = Description of Artificial Sequence: Syntheticoligonucleotide
  source 1..20: mol_type = other DNA
gtgactcttaagagtcaccc

SEQ ID NO: 12988 - DNA, 20 bp, synthetic construct
  misc_feature 1..20: note = Description of Artificial Sequence: Syntheticoligonucleotide
  source 1..20: mol_type = other DNA
gggactcttaagagtcccgt

SEQ ID NO: 12989 - DNA, 20 bp, synthetic construct
  misc_feature 1..20: note = Description of Artificial Sequence: Syntheticoligonucleotide
  source 1..20: mol_type = other DNA
gggactcttaagagtccctg

SEQ ID NO: 12990 - DNA, 20 bp, synthetic construct
  misc_feature 1..20: note = Description of Artificial Sequence: Syntheticoligonucleotide
  source 1..20: mol_type = other DNA
aggactcttaagagtcctgg

SEQ ID NO: 12991 - DNA, 20 bp, synthetic construct
  misc_feature 1..20: note = Description of Artificial Sequence: Syntheticoligonucleotide
  source 1..20: mol_type = other DNA
gagactcttaagagtctcgg

SEQ ID NO: 12992 - DNA, 20 bp, synthetic construct
  misc_feature 1..20: note = Description of Artificial Sequence: Syntheticoligonucleotide
  source 1..20: mol_type = other DNA
gggactcttaagagtcccga

SEQ ID NO: 12993 - DNA, 20 bp, synthetic construct
  misc_feature 1..20: note = Description of Artificial Sequence: Syntheticoligonucleotide
  source 1..20: mol_type = other DNA
gggactcttaagagtcccag

SEQ ID NO: 12994 - DNA, 20 bp, synthetic construct
  misc_feature 1..20: note = Description of Artificial Sequence: Syntheticoligonucleotide
  source 1..20: mol_type = other DNA
tggactcttaagagtccagg

SEQ ID NO: 12995 - DNA, 20 bp, synthetic construct
  misc_feature 1..20: note = Description of Artificial Sequence: Syntheticoligonucleotide
  source 1..20: mol_type = other DNA
gtgactcttaagagtcacgg

SEQ ID NO: 12996 - DNA, 20 bp, synthetic construct
  misc_feature 1..20: note = Description of Artificial Sequence: Syntheticoligonucleotide
  source 1..20: mol_type = other DNA
gcgactcttaagagtcgccg

SEQ ID NO: 12997 - DNA, 20 bp, synthetic construct
  misc_feature 1..20: note = Description of Artificial Sequence: Syntheticoligonucleotide
  source 1..20: mol_type = other DNA
gcgactcttaagagtcgctg

SEQ ID NO: 12998 - DNA, 20 bp, synthetic construct
  misc_feature 1..20: note = Description of Artificial Sequence: Syntheticoligonucleotide
  source 1..20: mol_type = other DNA
acgactcttaagagtcgtcg

SEQ ID NO: 12999 - DNA, 20 bp, synthetic construct
  misc_feature 1..20: note = Description of Artificial Sequence: Syntheticoligonucleotide
  source 1..20: mol_type = other DNA
gagactcttaagagtctccg

SEQ ID NO: 13000 - DNA, 20 bp, synthetic construct
  misc_feature 1..20: note = Description of Artificial Sequence: Syntheticoligonucleotide
  source 1..20: mol_type = other DNA
gcgactcttaagagtcgcag

SEQ ID NO: 13001 - DNA, 20 bp, synthetic construct
  misc_feature 1..20: note = Description of Artificial Sequence: Syntheticoligonucleotide
  source 1..20: mol_type = other DNA
gtgactcttaagagtcaccg

SEQ ID NO: 13002 - DNA, 20 bp, synthetic construct
  misc_feature 1..20: note = Description of Artificial Sequence: Syntheticoligonucleotide
  source 1..20: mol_type = other DNA
cggactcttaagagtccgtg

SEQ ID NO: 13003 - DNA, 20 bp, synthetic construct
  misc_feature 1..20: note = Description of Artificial Sequence: Syntheticoligonucleotide
  source 1..20: mol_type = other DNA
cagactcttaagagtctggg

SEQ ID NO: 13004 - DNA, 20 bp, synthetic construct
  misc_feature 1..20: note = Description of Artificial Sequence: Syntheticoligonucleotide
  source 1..20: mol_type = other DNA
cggactcttaagagtccgag

SEQ ID NO: 13005 - DNA, 20 bp, synthetic construct
  misc_feature 1..20: note = Description of Artificial Sequence: Syntheticoligonucleotide
  source 1..20: mol_type = other DNA
ctgactcttaagagtcaggg

SEQ ID NO: 13006 - DNA, 20 bp, synthetic construct
  misc_feature 1..20: note = Description of Artificial Sequence: Syntheticoligonucleotide
  source 1..20: mol_type = other DNA
acgactcttaagagtcgtgg

SEQ ID NO: 13007 - DNA, 20 bp, synthetic construct
  misc_feature 1..20: note = Description of Artificial Sequence: Syntheticoligonucleotide
  source 1..20: mol_type = other DNA
ccgactcttaagagtcggct

SEQ ID NO: 13008 - DNA, 20 bp, synthetic construct
  misc_feature 1..20: note = Description of Artificial Sequence: Syntheticoligonucleotide
  source 1..20: mol_type = other DNA
ccgactcttaagagtcggca

SEQ ID NO: 13009 - DNA, 20 bp, synthetic construct
  misc_feature 1..20: note = Description of Artificial Sequence: Syntheticoligonucleotide
  source 1..20: mol_type = other DNA
gagactcttaagagtctcgc

SEQ ID NO: 13010 - DNA, 20 bp, synthetic construct
  misc_feature 1..20: note = Description of Artificial Sequence: Syntheticoligonucleotide
  source 1..20: mol_type = other DNA
gtgactcttaagagtcacgc

SEQ ID NO: 13011 - DNA, 20 bp, synthetic construct
  misc_feature 1..20: note = Description of Artificial Sequence: Syntheticoligonucleotide
  source 1..20: mol_type = other DNA
aggactcttaagagtcctgc

SEQ ID NO: 13012 - DNA, 20 bp, synthetic construct
  misc_feature 1..20: note = Description of Artificial Sequence: Syntheticoligonucleotide
  source 1..20: mol_type = other DNA
tggactcttaagagtccagc

SEQ ID NO: 13013 - DNA, 20 bp, synthetic construct
  misc_feature 1..20: note = Description of Artificial Sequence: Syntheticoligonucleotide
  source 1..20: mol_type = other DNA
aggactcttaagagtcctcg

SEQ ID NO: 13014 - DNA, 20 bp, synthetic construct
  misc_feature 1..20: note = Description of Artificial Sequence: Syntheticoligonucleotide
  source 1..20: mol_type = other DNA
tggactcttaagagtccacg

SEQ ID NO: 13015 - DNA, 20 bp, synthetic construct
  misc_feature 1..20: note = Description of Artificial Sequence: Syntheticoligonucleotide
  source 1..20: mol_type = other DNA
ccgactcttaagagtcggtg

SEQ ID NO: 13016 - DNA, 20 bp, synthetic construct
  misc_feature 1..20: note = Description of Artificial Sequence: Syntheticoligonucleotide
  source 1..20: mol_type = other DNA
ccgactcttaagagtcggag

SEQ ID NO: 13017 - DNA, 20 bp, synthetic construct
  misc_feature 1..20: note = Description of Artificial Sequence: Syntheticoligonucleotide
  source 1..20: mol_type = other DNA
gggactcttaagagtcccgc

SEQ ID NO: 13018 - DNA, 20 bp, synthetic construct
  misc_feature 1..20: note = Description of Artificial Sequence: Syntheticoligonucleotide
  source 1..20: mol_type = other DNA
gggactcttaagagtccctc

SEQ ID NO: 13019 - DNA, 20 bp, synthetic construct
  misc_feature 1..20: note = Description of Artificial Sequence: Syntheticoligonucleotide
  source 1..20: mol_type = other DNA
gggactcttaagagtcccac

SEQ ID NO: 13020 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactccgcggagtcnnnn

SEQ ID NO: 13021 - DNA, 19 bp, synthetic construct
  misc_feature 1..19: note = Description of Artificial Sequence: Syntheticoligonucleotide
  source 1..19: mol_type = other DNA
ggactccgcggagtccgcc

SEQ ID NO: 13022 - DNA, 19 bp, synthetic construct
  misc_feature 1..19: note = Description of Artificial Sequence: Syntheticoligonucleotide
  source 1..19: mol_type = other DNA
ggactccgcggagtccgct

SEQ ID NO: 13023 - DNA, 19 bp, synthetic construct
  misc_feature 1..19: note = Description of Artificial Sequence: Syntheticoligonucleotide
  source 1..19: mol_type = other DNA
ggactccgcggagtccgtc

SEQ ID NO: 13024 - DNA, 19 bp, synthetic construct
  misc_feature 1..19: note = Description of Artificial Sequence: Syntheticoligonucleotide
  source 1..19: mol_type = other DNA
ggactccgcggagtcctcc

SEQ ID NO: 13025 - DNA, 19 bp, synthetic construct
  misc_feature 1..19: note = Description of Artificial Sequence: Syntheticoligonucleotide
  source 1..19: mol_type = other DNA
agactccgcggagtctgcc

SEQ ID NO: 13026 - DNA, 19 bp, synthetic construct
  misc_feature 1..19: note = Description of Artificial Sequence: Syntheticoligonucleotide
  source 1..19: mol_type = other DNA
ggactccgcggagtccgca

SEQ ID NO: 13027 - DNA, 19 bp, synthetic construct
  misc_feature 1..19: note = Description of Artificial Sequence: Syntheticoligonucleotide
  source 1..19: mol_type = other DNA
ggactccgcggagtccgac

SEQ ID NO: 13028 - DNA, 19 bp, synthetic construct
  misc_feature 1..19: note = Description of Artificial Sequence: Syntheticoligonucleotide
  source 1..19: mol_type = other DNA
ggactccgcggagtccacc

SEQ ID NO: 13029 - DNA, 19 bp, synthetic construct
  misc_feature 1..19: note = Description of Artificial Sequence: Syntheticoligonucleotide
  source 1..19: mol_type = other DNA
tgactccgcggagtcagcc

SEQ ID NO: 13030 - DNA, 19 bp, synthetic construct
  misc_feature 1..19: note = Description of Artificial Sequence: Syntheticoligonucleotide
  source 1..19: mol_type = other DNA
cgactccgcggagtcgggc

SEQ ID NO: 13031 - DNA, 19 bp, synthetic construct
  misc_feature 1..19: note = Description of Artificial Sequence: Syntheticoligonucleotide
  source 1..19: mol_type = other DNA
cgactccgcggagtcgggt

SEQ ID NO: 13032 - DNA, 19 bp, synthetic construct
  misc_feature 1..19: note = Description of Artificial Sequence: Syntheticoligonucleotide
  source 1..19: mol_type = other DNA
cgactccgcggagtcggtc

SEQ ID NO: 13033 - DNA, 19 bp, synthetic construct
  misc_feature 1..19: note = Description of Artificial Sequence: Syntheticoligonucleotide
  source 1..19: mol_type = other DNA
cgactccgcggagtcgtgc

SEQ ID NO: 13034 - DNA, 19 bp, synthetic construct
  misc_feature 1..19: note = Description of Artificial Sequence: Syntheticoligonucleotide
  source 1..19: mol_type = other DNA
agactccgcggagtctggc

SEQ ID NO: 13035 - DNA, 19 bp, synthetic construct
  misc_feature 1..19: note = Description of Artificial Sequence: Syntheticoligonucleotide
  source 1..19: mol_type = other DNA
cgactccgcggagtcggga

SEQ ID NO: 13036 - DNA, 19 bp, synthetic construct
  misc_feature 1..19: note = Description of Artificial Sequence: Syntheticoligonucleotide
  source 1..19: mol_type = other DNA
cgactccgcggagtcggac

SEQ ID NO: 13037 - DNA, 19 bp, synthetic construct
  misc_feature 1..19: note = Description of Artificial Sequence: Syntheticoligonucleotide
  source 1..19: mol_type = other DNA
tgactccgcggagtcaggc

SEQ ID NO: 13038 - DNA, 19 bp, synthetic construct
  misc_feature 1..19: note = Description of Artificial Sequence: Syntheticoligonucleotide
  source 1..19: mol_type = other DNA
cgactccgcggagtcgccc

SEQ ID NO: 13039 - DNA, 19 bp, synthetic construct
  misc_feature 1..19: note = Description of Artificial Sequence: Syntheticoligonucleotide
  source 1..19: mol_type = other DNA
cgactccgcggagtcgcct

SEQ ID NO: 13040 - DNA, 19 bp, synthetic construct
  misc_feature 1..19: note = Description of Artificial Sequence: Syntheticoligonucleotide
  source 1..19: mol_type = other DNA
cgactccgcggagtcgctc

SEQ ID NO: 13041 - DNA, 19 bp, synthetic construct
  misc_feature 1..19: note = Description of Artificial Sequence: Syntheticoligonucleotide
  source 1..19: mol_type = other DNA
cgactccgcggagtcgtcc

SEQ ID NO: 13042 - DNA, 19 bp, synthetic construct
  misc_feature 1..19: note = Description of Artificial Sequence: Syntheticoligonucleotide
  source 1..19: mol_type = other DNA
agactccgcggagtctccc

SEQ ID NO: 13043 - DNA, 19 bp, synthetic construct
  misc_feature 1..19: note = Description of Artificial Sequence: Syntheticoligonucleotide
  source 1..19: mol_type = other DNA
cgactccgcggagtcgcca

SEQ ID NO: 13044 - DNA, 19 bp, synthetic construct
  misc_feature 1..19: note = Description of Artificial Sequence: Syntheticoligonucleotide
  source 1..19: mol_type = other DNA
cgactccgcggagtcgcac

SEQ ID NO: 13045 - DNA, 19 bp, synthetic construct
  misc_feature 1..19: note = Description of Artificial Sequence: Syntheticoligonucleotide
  source 1..19: mol_type = other DNA
tgactccgcggagtcaccc

SEQ ID NO: 13046 - DNA, 19 bp, synthetic construct
  misc_feature 1..19: note = Description of Artificial Sequence: Syntheticoligonucleotide
  source 1..19: mol_type = other DNA
ggactccgcggagtcccgt

SEQ ID NO: 13047 - DNA, 19 bp, synthetic construct
  misc_feature 1..19: note = Description of Artificial Sequence: Syntheticoligonucleotide
  source 1..19: mol_type = other DNA
ggactccgcggagtccctg

SEQ ID NO: 13048 - DNA, 19 bp, synthetic construct
  misc_feature 1..19: note = Description of Artificial Sequence: Syntheticoligonucleotide
  source 1..19: mol_type = other DNA
ggactccgcggagtcctgg

SEQ ID NO: 13049 - DNA, 19 bp, synthetic construct
  misc_feature 1..19: note = Description of Artificial Sequence: Syntheticoligonucleotide
  source 1..19: mol_type = other DNA
agactccgcggagtctcgg

SEQ ID NO: 13050 - DNA, 19 bp, synthetic construct
  misc_feature 1..19: note = Description of Artificial Sequence: Syntheticoligonucleotide
  source 1..19: mol_type = other DNA
ggactccgcggagtcccga

SEQ ID NO: 13051 - DNA, 19 bp, synthetic construct
  misc_feature 1..19: note = Description of Artificial Sequence: Syntheticoligonucleotide
  source 1..19: mol_type = other DNA
ggactccgcggagtcccag

SEQ ID NO: 13052 - DNA, 19 bp, synthetic construct
  misc_feature 1..19: note = Description of Artificial Sequence: Syntheticoligonucleotide
  source 1..19: mol_type = other DNA
ggactccgcggagtccagg

SEQ ID NO: 13053 - DNA, 19 bp, synthetic construct
  misc_feature 1..19: note = Description of Artificial Sequence: Syntheticoligonucleotide
  source 1..19: mol_type = other DNA
tgactccgcggagtcacgg

SEQ ID NO: 13054 - DNA, 19 bp, synthetic construct
  misc_feature 1..19: note = Description of Artificial Sequence: Syntheticoligonucleotide
  source 1..19: mol_type = other DNA
cgactccgcggagtcgccg

SEQ ID NO: 13055 - DNA, 19 bp, synthetic construct
  misc_feature 1..19: note = Description of Artificial Sequence: Syntheticoligonucleotide
  source 1..19: mol_type = other DNA
cgactccgcggagtcgctg

SEQ ID NO: 13056 - DNA, 19 bp, synthetic construct
  misc_feature 1..19: note = Description of Artificial Sequence: Syntheticoligonucleotide
  source 1..19: mol_type = other DNA
cgactccgcggagtcgtcg

SEQ ID NO: 13057 - DNA, 19 bp, synthetic construct
  misc_feature 1..19: note = Description of Artificial Sequence: Syntheticoligonucleotide
  source 1..19: mol_type = other DNA
agactccgcggagtctccg

SEQ ID NO: 13058 - DNA, 19 bp, synthetic construct
  misc_feature 1..19: note = Description of Artificial Sequence: Syntheticoligonucleotide
  source 1..19: mol_type = other DNA
cgactccgcggagtcgcag

SEQ ID NO: 13059 - DNA, 19 bp, synthetic construct
  misc_feature 1..19: note = Description of Artificial Sequence: Syntheticoligonucleotide
  source 1..19: mol_type = other DNA
tgactccgcggagtcaccg

SEQ ID NO: 13060 - DNA, 19 bp, synthetic construct
  misc_feature 1..19: note = Description of Artificial Sequence: Syntheticoligonucleotide
  source 1..19: mol_type = other DNA
ggactccgcggagtccgtg

SEQ ID NO: 13061 - DNA, 19 bp, synthetic construct
  misc_feature 1..19: note = Description of Artificial Sequence: Syntheticoligonucleotide
  source 1..19: mol_type = other DNA
agactccgcggagtctggg

SEQ ID NO: 13062 - DNA, 19 bp, synthetic construct
  misc_feature 1..19: note = Description of Artificial Sequence: Syntheticoligonucleotide
  source 1..19: mol_type = other DNA
ggactccgcggagtccgag

SEQ ID NO: 13063 - DNA, 19 bp, synthetic construct
  misc_feature 1..19: note = Description of Artificial Sequence: Syntheticoligonucleotide
  source 1..19: mol_type = other DNA
tgactccgcggagtcaggg

SEQ ID NO: 13064 - DNA, 19 bp, synthetic construct
  misc_feature 1..19: note = Description of Artificial Sequence: Syntheticoligonucleotide
  source 1..19: mol_type = other DNA
cgactccgcggagtcgtgg

SEQ ID NO: 13065 - DNA, 19 bp, synthetic construct
  misc_feature 1..19: note = Description of Artificial Sequence: Syntheticoligonucleotide
  source 1..19: mol_type = other DNA
cgactccgcggagtcggct

SEQ ID NO: 13066 - DNA, 19 bp, synthetic construct
  misc_feature 1..19: note = Description of Artificial Sequence: Syntheticoligonucleotide
  source 1..19: mol_type = other DNA
cgactccgcggagtcggca

SEQ ID NO: 13067 - DNA, 19 bp, synthetic construct
  misc_feature 1..19: note = Description of Artificial Sequence: Syntheticoligonucleotide
  source 1..19: mol_type = other DNA
agactccgcggagtctcgc

SEQ ID NO: 13068 - DNA, 19 bp, synthetic construct
  misc_feature 1..19: note = Description of Artificial Sequence: Syntheticoligonucleotide
  source 1..19: mol_type = other DNA
tgactccgcggagtcacgc

SEQ ID NO: 13069 - DNA, 19 bp, synthetic construct
  misc_feature 1..19: note = Description of Artificial Sequence: Syntheticoligonucleotide
  source 1..19: mol_type = other DNA
ggactccgcggagtcctgc

SEQ ID NO: 13070 - DNA, 19 bp, synthetic construct
  misc_feature 1..19: note = Description of Artificial Sequence: Syntheticoligonucleotide
  source 1..19: mol_type = other DNA
ggactccgcggagtccagc

SEQ ID NO: 13071 - DNA, 19 bp, synthetic construct
  misc_feature 1..19: note = Description of Artificial Sequence: Syntheticoligonucleotide
  source 1..19: mol_type = other DNA
ggactccgcggagtcctcg

SEQ ID NO: 13072 - DNA, 19 bp, synthetic construct
  misc_feature 1..19: note = Description of Artificial Sequence: Syntheticoligonucleotide
  source 1..19: mol_type = other DNA
ggactccgcggagtccacg

SEQ ID NO: 13073 - DNA, 19 bp, synthetic construct
  misc_feature 1..19: note = Description of Artificial Sequence: Syntheticoligonucleotide
  source 1..19: mol_type = other DNA
cgactccgcggagtcggtg

SEQ ID NO: 13074 - DNA, 19 bp, synthetic construct
  misc_feature 1..19: note = Description of Artificial Sequence: Syntheticoligonucleotide
  source 1..19: mol_type = other DNA
cgactccgcggagtcggag

SEQ ID NO: 13075 - DNA, 19 bp, synthetic construct
  misc_feature 1..19: note = Description of Artificial Sequence: Syntheticoligonucleotide
  source 1..19: mol_type = other DNA
ggactccgcggagtcccgc

SEQ ID NO: 13076 - DNA, 19 bp, synthetic construct
  misc_feature 1..19: note = Description of Artificial Sequence: Syntheticoligonucleotide
  source 1..19: mol_type = other DNA
ggactccgcggagtccctc

SEQ ID NO: 13077 - DNA, 19 bp, synthetic construct
  misc_feature 1..19: note = Description of Artificial Sequence: Syntheticoligonucleotide
  source 1..19: mol_type = other DNA
ggactccgcggagtcccac

SEQ ID NO: 13078 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactctgcagagtcnnnn

SEQ ID NO: 13079 - DNA, 19 bp, synthetic construct
  misc_feature 1..19: note = Description of Artificial Sequence: Syntheticoligonucleotide
  source 1..19: mol_type = other DNA
ggactctgcagagtccgcc

SEQ ID NO: 13080 - DNA, 19 bp, synthetic construct
  misc_feature 1..19: note = Description of Artificial Sequence: Syntheticoligonucleotide
  source 1..19: mol_type = other DNA
ggactctgcagagtccgct

SEQ ID NO: 13081 - DNA, 19 bp, synthetic construct
  misc_feature 1..19: note = Description of Artificial Sequence: Syntheticoligonucleotide
  source 1..19: mol_type = other DNA
ggactctgcagagtccgtc

SEQ ID NO: 13082 - DNA, 19 bp, synthetic construct
  misc_feature 1..19: note = Description of Artificial Sequence: Syntheticoligonucleotide
  source 1..19: mol_type = other DNA
ggactctgcagagtcctcc

SEQ ID NO: 13083 - DNA, 19 bp, synthetic construct
  misc_feature 1..19: note = Description of Artificial Sequence: Syntheticoligonucleotide
  source 1..19: mol_type = other DNA
agactctgcagagtctgcc

SEQ ID NO: 13084 - DNA, 19 bp, synthetic construct
  misc_feature 1..19: note = Description of Artificial Sequence: Syntheticoligonucleotide
  source 1..19: mol_type = other DNA
ggactctgcagagtccgca

SEQ ID NO: 13085 - DNA, 19 bp, synthetic construct
  misc_feature 1..19: note = Description of Artificial Sequence: Syntheticoligonucleotide
  source 1..19: mol_type = other DNA
ggactctgcagagtccgac

SEQ ID NO: 13086 - DNA, 19 bp, synthetic construct
  misc_feature 1..19: note = Description of Artificial Sequence: Syntheticoligonucleotide
  source 1..19: mol_type = other DNA
ggactctgcagagtccacc

SEQ ID NO: 13087 - DNA, 19 bp, synthetic construct
  misc_feature 1..19: note = Description of Artificial Sequence: Syntheticoligonucleotide
  source 1..19: mol_type = other DNA
tgactctgcagagtcagcc

SEQ ID NO: 13088 - DNA, 19 bp, synthetic construct
  misc_feature 1..19: note = Description of Artificial Sequence: Syntheticoligonucleotide
  source 1..19: mol_type = other DNA
cgactctgcagagtcgggc

SEQ ID NO: 13089 - DNA, 19 bp, synthetic construct
  misc_feature 1..19: note = Description of Artificial Sequence: Syntheticoligonucleotide
  source 1..19: mol_type = other DNA
cgactctgcagagtcgggt

SEQ ID NO: 13090 - DNA, 19 bp, synthetic construct
  misc_feature 1..19: note = Description of Artificial Sequence: Syntheticoligonucleotide
  source 1..19: mol_type = other DNA
cgactctgcagagtcggtc

SEQ ID NO: 13091 - DNA, 19 bp, synthetic construct
  misc_feature 1..19: note = Description of Artificial Sequence: Syntheticoligonucleotide
  source 1..19: mol_type = other DNA
cgactctgcagagtcgtgc

SEQ ID NO: 13092 - DNA, 19 bp, synthetic construct
  misc_feature 1..19: note = Description of Artificial Sequence: Syntheticoligonucleotide
  source 1..19: mol_type = other DNA
agactctgcagagtctggc

SEQ ID NO: 13093 - DNA, 19 bp, synthetic construct
  misc_feature 1..19: note = Description of Artificial Sequence: Syntheticoligonucleotide
  source 1..19: mol_type = other DNA
cgactctgcagagtcggga

SEQ ID NO: 13094 - DNA, 19 bp, synthetic construct
  misc_feature 1..19: note = Description of Artificial Sequence: Syntheticoligonucleotide
  source 1..19: mol_type = other DNA
cgactctgcagagtcggac

SEQ ID NO: 13095 - DNA, 19 bp, synthetic construct
  misc_feature 1..19: note = Description of Artificial Sequence: Syntheticoligonucleotide
  source 1..19: mol_type = other DNA
tgactctgcagagtcaggc

SEQ ID NO: 13096 - DNA, 19 bp, synthetic construct
  misc_feature 1..19: note = Description of Artificial Sequence: Syntheticoligonucleotide
  source 1..19: mol_type = other DNA
cgactctgcagagtcgccc

SEQ ID NO: 13097 - DNA, 19 bp, synthetic construct
  misc_feature 1..19: note = Description of Artificial Sequence: Syntheticoligonucleotide
  source 1..19: mol_type = other DNA
cgactctgcagagtcgcct

SEQ ID NO: 13098 - DNA, 19 bp, synthetic construct
  misc_feature 1..19: note = Description of Artificial Sequence: Syntheticoligonucleotide
  source 1..19: mol_type = other DNA
cgactctgcagagtcgctc

SEQ ID NO: 13099 - DNA, 19 bp, synthetic construct
  misc_feature 1..19: note = Description of Artificial Sequence: Syntheticoligonucleotide
  source 1..19: mol_type = other DNA
cgactctgcagagtcgtcc

SEQ ID NO: 13100 - DNA, 19 bp, synthetic construct
  misc_feature 1..19: note = Description of Artificial Sequence: Syntheticoligonucleotide
  source 1..19: mol_type = other DNA
agactctgcagagtctccc

SEQ ID NO: 13101 - DNA, 19 bp, synthetic construct
  misc_feature 1..19: note = Description of Artificial Sequence: Syntheticoligonucleotide
  source 1..19: mol_type = other DNA
cgactctgcagagtcgcca

SEQ ID NO: 13102 - DNA, 19 bp, synthetic construct
  misc_feature 1..19: note = Description of Artificial Sequence: Syntheticoligonucleotide
  source 1..19: mol_type = other DNA
cgactctgcagagtcgcac

SEQ ID NO: 13103 - DNA, 19 bp, synthetic construct
  misc_feature 1..19: note = Description of Artificial Sequence: Syntheticoligonucleotide
  source 1..19: mol_type = other DNA
tgactctgcagagtcaccc

SEQ ID NO: 13104 - DNA, 19 bp, synthetic construct
  misc_feature 1..19: note = Description of Artificial Sequence: Syntheticoligonucleotide
  source 1..19: mol_type = other DNA
ggactctgcagagtcccgt

SEQ ID NO: 13105 - DNA, 19 bp, synthetic construct
  misc_feature 1..19: note = Description of Artificial Sequence: Syntheticoligonucleotide
  source 1..19: mol_type = other DNA
ggactctgcagagtccctg

SEQ ID NO: 13106 - DNA, 19 bp, synthetic construct
  misc_feature 1..19: note = Description of Artificial Sequence: Syntheticoligonucleotide
  source 1..19: mol_type = other DNA
ggactctgcagagtcctgg

SEQ ID NO: 13107 - DNA, 19 bp, synthetic construct
  misc_feature 1..19: note = Description of Artificial Sequence: Syntheticoligonucleotide
  source 1..19: mol_type = other DNA
agactctgcagagtctcgg

SEQ ID NO: 13108 - DNA, 19 bp, synthetic construct
  misc_feature 1..19: note = Description of Artificial Sequence: Syntheticoligonucleotide
  source 1..19: mol_type = other DNA
ggactctgcagagtcccga

SEQ ID NO: 13109 - DNA, 19 bp, synthetic construct
  misc_feature 1..19: note = Description of Artificial Sequence: Syntheticoligonucleotide
  source 1..19: mol_type = other DNA
ggactctgcagagtcccag

SEQ ID NO: 13110 - DNA, 19 bp, synthetic construct
  misc_feature 1..19: note = Description of Artificial Sequence: Syntheticoligonucleotide
  source 1..19: mol_type = other DNA
ggactctgcagagtccagg

SEQ ID NO: 13111 - DNA, 19 bp, synthetic construct
  misc_feature 1..19: note = Description of Artificial Sequence: Syntheticoligonucleotide
  source 1..19: mol_type = other DNA
tgactctgcagagtcacgg

SEQ ID NO: 13112 - DNA, 19 bp, synthetic construct
  misc_feature 1..19: note = Description of Artificial Sequence: Syntheticoligonucleotide
  source 1..19: mol_type = other DNA
cgactctgcagagtcgccg

SEQ ID NO: 13113 - DNA, 19 bp, synthetic construct
  misc_feature 1..19: note = Description of Artificial Sequence: Syntheticoligonucleotide
  source 1..19: mol_type = other DNA
cgactctgcagagtcgctg

SEQ ID NO: 13114 - DNA, 19 bp, synthetic construct
  misc_feature 1..19: note = Description of Artificial Sequence: Syntheticoligonucleotide
  source 1..19: mol_type = other DNA
cgactctgcagagtcgtcg

SEQ ID NO: 13115 - DNA, 19 bp, synthetic construct
  misc_feature 1..19: note = Description of Artificial Sequence: Syntheticoligonucleotide
  source 1..19: mol_type = other DNA
agactctgcagagtctccg

SEQ ID NO: 13116 - DNA, 19 bp, synthetic construct
  misc_feature 1..19: note = Description of Artificial Sequence: Syntheticoligonucleotide
  source 1..19: mol_type = other DNA
cgactctgcagagtcgcag

SEQ ID NO: 13117 - DNA, 19 bp, synthetic construct
  misc_feature 1..19: note = Description of Artificial Sequence: Syntheticoligonucleotide
  source 1..19: mol_type = other DNA
tgactctgcagagtcaccg

SEQ ID NO: 13118 - DNA, 19 bp, synthetic construct
  misc_feature 1..19: note = Description of Artificial Sequence: Syntheticoligonucleotide
  source 1..19: mol_type = other DNA
ggactctgcagagtccgtg

SEQ ID NO: 13119 - DNA, 19 bp, synthetic construct
  misc_feature 1..19: note = Description of Artificial Sequence: Syntheticoligonucleotide
  source 1..19: mol_type = other DNA
agactctgcagagtctggg

SEQ ID NO: 13120 - DNA, 19 bp, synthetic construct
  misc_feature 1..19: note = Description of Artificial Sequence: Syntheticoligonucleotide
  source 1..19: mol_type = other DNA
ggactctgcagagtccgag

SEQ ID NO: 13121 - DNA, 19 bp, synthetic construct
  misc_feature 1..19: note = Description of Artificial Sequence: Syntheticoligonucleotide
  source 1..19: mol_type = other DNA
tgactctgcagagtcaggg

SEQ ID NO: 13122 - DNA, 19 bp, synthetic construct
  misc_feature 1..19: note = Description of Artificial Sequence: Syntheticoligonucleotide
  source 1..19: mol_type = other DNA
cgactctgcagagtcgtgg

SEQ ID NO: 13123 - DNA, 19 bp, synthetic construct
  misc_feature 1..19: note = Description of Artificial Sequence: Syntheticoligonucleotide
  source 1..19: mol_type = other DNA
cgactctgcagagtcggct

SEQ ID NO: 13124 - DNA, 19 bp, synthetic construct
  misc_feature 1..19: note = Description of Artificial Sequence: Syntheticoligonucleotide
  source 1..19: mol_type = other DNA
cgactctgcagagtcggca

SEQ ID NO: 13125 - DNA, 19 bp, synthetic construct
  misc_feature 1..19: note = Description of Artificial Sequence: Syntheticoligonucleotide
  source 1..19: mol_type = other DNA
agactctgcagagtctcgc

SEQ ID NO: 13126 - DNA, 19 bp, synthetic construct
  misc_feature 1..19: note = Description of Artificial Sequence: Syntheticoligonucleotide
  source 1..19: mol_type = other DNA
tgactctgcagagtcacgc

SEQ ID NO: 13127 - DNA, 19 bp, synthetic construct
  misc_feature 1..19: note = Description of Artificial Sequence: Syntheticoligonucleotide
  source 1..19: mol_type = other DNA
ggactctgcagagtcctgc

SEQ ID NO: 13128 - DNA, 19 bp, synthetic construct
  misc_feature 1..19: note = Description of Artificial Sequence: Syntheticoligonucleotide
  source 1..19: mol_type = other DNA
ggactctgcagagtccagc

SEQ ID NO: 13129 - DNA, 19 bp, synthetic construct
  misc_feature 1..19: note = Description of Artificial Sequence: Syntheticoligonucleotide
  source 1..19: mol_type = other DNA
ggactctgcagagtcctcg

SEQ ID NO: 13130 - DNA, 19 bp, synthetic construct
  misc_feature 1..19: note = Description of Artificial Sequence: Syntheticoligonucleotide
  source 1..19: mol_type = other DNA
ggactctgcagagtccacg

SEQ ID NO: 13131 - DNA, 19 bp, synthetic construct
  misc_feature 1..19: note = Description of Artificial Sequence: Syntheticoligonucleotide
  source 1..19: mol_type = other DNA
cgactctgcagagtcggtg

SEQ ID NO: 13132 - DNA, 19 bp, synthetic construct
  misc_feature 1..19: note = Description of Artificial Sequence: Syntheticoligonucleotide
  source 1..19: mol_type = other DNA
cgactctgcagagtcggag

SEQ ID NO: 13133 - DNA, 19 bp, synthetic construct
  misc_feature 1..19: note = Description of Artificial Sequence: Syntheticoligonucleotide
  source 1..19: mol_type = other DNA
ggactctgcagagtcccgc

SEQ ID NO: 13134 - DNA, 19 bp, synthetic construct
  misc_feature 1..19: note = Description of Artificial Sequence: Syntheticoligonucleotide
  source 1..19: mol_type = other DNA
ggactctgcagagtccctc

SEQ ID NO: 13135 - DNA, 19 bp, synthetic construct
  misc_feature 1..19: note = Description of Artificial Sequence: Syntheticoligonucleotide
  source 1..19: mol_type = other DNA
ggactctgcagagtcccac

SEQ ID NO: 13136 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactcgcgcgagtcnnnn

SEQ ID NO: 13137 - DNA, 19 bp, synthetic construct
  misc_feature 1..19: note = Description of Artificial Sequence: Syntheticoligonucleotide
  source 1..19: mol_type = other DNA
ggactcgcgcgagtccgcc

SEQ ID NO: 13138 - DNA, 19 bp, synthetic construct
  misc_feature 1..19: note = Description of Artificial Sequence: Syntheticoligonucleotide
  source 1..19: mol_type = other DNA
ggactcgcgcgagtccgct

SEQ ID NO: 13139 - DNA, 19 bp, synthetic construct
  misc_feature 1..19: note = Description of Artificial Sequence: Syntheticoligonucleotide
  source 1..19: mol_type = other DNA
ggactcgcgcgagtccgtc

SEQ ID NO: 13140 - DNA, 19 bp, synthetic construct
  misc_feature 1..19: note = Description of Artificial Sequence: Syntheticoligonucleotide
  source 1..19: mol_type = other DNA
ggactcgcgcgagtcctcc

SEQ ID NO: 13141 - DNA, 19 bp, synthetic construct
  misc_feature 1..19: note = Description of Artificial Sequence: Syntheticoligonucleotide
  source 1..19: mol_type = other DNA
agactcgcgcgagtctgcc

SEQ ID NO: 13142 - DNA, 19 bp, synthetic construct
  misc_feature 1..19: note = Description of Artificial Sequence: Syntheticoligonucleotide
  source 1..19: mol_type = other DNA
ggactcgcgcgagtccgca

SEQ ID NO: 13143 - DNA, 19 bp, synthetic construct
  misc_feature 1..19: note = Description of Artificial Sequence: Syntheticoligonucleotide
  source 1..19: mol_type = other DNA
ggactcgcgcgagtccgac

SEQ ID NO: 13144 - DNA, 19 bp, synthetic construct
  misc_feature 1..19: note = Description of Artificial Sequence: Syntheticoligonucleotide
  source 1..19: mol_type = other DNA
ggactcgcgcgagtccacc

SEQ ID NO: 13145 - DNA, 19 bp, synthetic construct
  misc_feature 1..19: note = Description of Artificial Sequence: Syntheticoligonucleotide
  source 1..19: mol_type = other DNA
tgactcgcgcgagtcagcc

SEQ ID NO: 13146 - DNA, 19 bp, synthetic construct
  misc_feature 1..19: note = Description of Artificial Sequence: Syntheticoligonucleotide
  source 1..19: mol_type = other DNA
cgactcgcgcgagtcgggc

SEQ ID NO: 13147 - DNA, 19 bp, synthetic construct
  misc_feature 1..19: note = Description of Artificial Sequence: Syntheticoligonucleotide
  source 1..19: mol_type = other DNA
cgactcgcgcgagtcgggt

SEQ ID NO: 13148 - DNA, 19 bp, synthetic construct
  misc_feature 1..19: note = Description of Artificial Sequence: Syntheticoligonucleotide
  source 1..19: mol_type = other DNA
cgactcgcgcgagtcggtc

SEQ ID NO: 13149 - DNA, 19 bp, synthetic construct
  misc_feature 1..19: note = Description of Artificial Sequence: Syntheticoligonucleotide
  source 1..19: mol_type = other DNA
cgactcgcgcgagtcgtgc

SEQ ID NO: 13150 - DNA, 19 bp, synthetic construct
  misc_feature 1..19: note = Description of Artificial Sequence: Syntheticoligonucleotide
  source 1..19: mol_type = other DNA
agactcgcgcgagtctggc

SEQ ID NO: 13151 - DNA, 19 bp, synthetic construct
  misc_feature 1..19: note = Description of Artificial Sequence: Syntheticoligonucleotide
  source 1..19: mol_type = other DNA
cgactcgcgcgagtcggga

SEQ ID NO: 13152 - DNA, 19 bp, synthetic construct
  misc_feature 1..19: note = Description of Artificial Sequence: Syntheticoligonucleotide
  source 1..19: mol_type = other DNA
cgactcgcgcgagtcggac

SEQ ID NO: 13153 - DNA, 19 bp, synthetic construct
  misc_feature 1..19: note = Description of Artificial Sequence: Syntheticoligonucleotide
  source 1..19: mol_type = other DNA
tgactcgcgcgagtcaggc

SEQ ID NO: 13154 - DNA, 19 bp, synthetic construct
  misc_feature 1..19: note = Description of Artificial Sequence: Syntheticoligonucleotide
  source 1..19: mol_type = other DNA
cgactcgcgcgagtcgccc

SEQ ID NO: 13155 - DNA, 19 bp, synthetic construct
  misc_feature 1..19: note = Description of Artificial Sequence: Syntheticoligonucleotide
  source 1..19: mol_type = other DNA
cgactcgcgcgagtcgcct

SEQ ID NO: 13156 - DNA, 19 bp, synthetic construct
  misc_feature 1..19: note = Description of Artificial Sequence: Syntheticoligonucleotide
  source 1..19: mol_type = other DNA
cgactcgcgcgagtcgctc

SEQ ID NO: 13157 - DNA, 19 bp, synthetic construct
  misc_feature 1..19: note = Description of Artificial Sequence: Syntheticoligonucleotide
  source 1..19: mol_type = other DNA
cgactcgcgcgagtcgtcc

SEQ ID NO: 13158 - DNA, 19 bp, synthetic construct
  misc_feature 1..19: note = Description of Artificial Sequence: Syntheticoligonucleotide
  source 1..19: mol_type = other DNA
agactcgcgcgagtctccc

SEQ ID NO: 13159 - DNA, 19 bp, synthetic construct
  misc_feature 1..19: note = Description of Artificial Sequence: Syntheticoligonucleotide
  source 1..19: mol_type = other DNA
cgactcgcgcgagtcgcca

SEQ ID NO: 13160 - DNA, 19 bp, synthetic construct
  misc_feature 1..19: note = Description of Artificial Sequence: Syntheticoligonucleotide
  source 1..19: mol_type = other DNA
cgactcgcgcgagtcgcac

SEQ ID NO: 13161 - DNA, 19 bp, synthetic construct
  misc_feature 1..19: note = Description of Artificial Sequence: Syntheticoligonucleotide
  source 1..19: mol_type = other DNA
tgactcgcgcgagtcaccc

SEQ ID NO: 13162 - DNA, 19 bp, synthetic construct
  misc_feature 1..19: note = Description of Artificial Sequence: Syntheticoligonucleotide
  source 1..19: mol_type = other DNA
ggactcgcgcgagtcccgt

SEQ ID NO: 13163 - DNA, 19 bp, synthetic construct
  misc_feature 1..19: note = Description of Artificial Sequence: Syntheticoligonucleotide
  source 1..19: mol_type = other DNA
ggactcgcgcgagtccctg

SEQ ID NO: 13164 - DNA, 19 bp, synthetic construct
  misc_feature 1..19: note = Description of Artificial Sequence: Syntheticoligonucleotide
  source 1..19: mol_type = other DNA
ggactcgcgcgagtcctgg

SEQ ID NO: 13165 - DNA, 19 bp, synthetic construct
  misc_feature 1..19: note = Description of Artificial Sequence: Syntheticoligonucleotide
  source 1..19: mol_type = other DNA
agactcgcgcgagtctcgg

SEQ ID NO: 13166 - DNA, 19 bp, synthetic construct
  misc_feature 1..19: note = Description of Artificial Sequence: Syntheticoligonucleotide
  source 1..19: mol_type = other DNA
ggactcgcgcgagtcccga

SEQ ID NO: 13167 - DNA, 19 bp, synthetic construct
  misc_feature 1..19: note = Description of Artificial Sequence: Syntheticoligonucleotide
  source 1..19: mol_type = other DNA
ggactcgcgcgagtcccag

SEQ ID NO: 13168 - DNA, 19 bp, synthetic construct
  misc_feature 1..19: note = Description of Artificial Sequence: Syntheticoligonucleotide
  source 1..19: mol_type = other DNA
ggactcgcgcgagtccagg

SEQ ID NO: 13169 - DNA, 19 bp, synthetic construct
  misc_feature 1..19: note = Description of Artificial Sequence: Syntheticoligonucleotide
  source 1..19: mol_type = other DNA
tgactcgcgcgagtcacgg

SEQ ID NO: 13170 - DNA, 19 bp, synthetic construct
  misc_feature 1..19: note = Description of Artificial Sequence: Syntheticoligonucleotide
  source 1..19: mol_type = other DNA
cgactcgcgcgagtcgccg

SEQ ID NO: 13171 - DNA, 19 bp, synthetic construct
  misc_feature 1..19: note = Description of Artificial Sequence: Syntheticoligonucleotide
  source 1..19: mol_type = other DNA
cgactcgcgcgagtcgctg

SEQ ID NO: 13172 - DNA, 19 bp, synthetic construct
  misc_feature 1..19: note = Description of Artificial Sequence: Syntheticoligonucleotide
  source 1..19: mol_type = other DNA
cgactcgcgcgagtcgtcg

SEQ ID NO: 13173 - DNA, 19 bp, synthetic construct
  misc_feature 1..19: note = Description of Artificial Sequence: Syntheticoligonucleotide
  source 1..19: mol_type = other DNA
agactcgcgcgagtctccg

SEQ ID NO: 13174 - DNA, 19 bp, synthetic construct
  misc_feature 1..19: note = Description of Artificial Sequence: Syntheticoligonucleotide
  source 1..19: mol_type = other DNA
cgactcgcgcgagtcgcag

SEQ ID NO: 13175 - DNA, 19 bp, synthetic construct
  misc_feature 1..19: note = Description of Artificial Sequence: Syntheticoligonucleotide
  source 1..19: mol_type = other DNA
tgactcgcgcgagtcaccg

SEQ ID NO: 13176 - DNA, 19 bp, synthetic construct
  misc_feature 1..19: note = Description of Artificial Sequence: Syntheticoligonucleotide
  source 1..19: mol_type = other DNA
ggactcgcgcgagtccgtg

SEQ ID NO: 13177 - DNA, 19 bp, synthetic construct
  misc_feature 1..19: note = Description of Artificial Sequence: Syntheticoligonucleotide
  source 1..19: mol_type = other DNA
agactcgcgcgagtctggg

SEQ ID NO: 13178 - DNA, 19 bp, synthetic construct
  misc_feature 1..19: note = Description of Artificial Sequence: Syntheticoligonucleotide
  source 1..19: mol_type = other DNA
ggactcgcgcgagtccgag

SEQ ID NO: 13179 - DNA, 19 bp, synthetic construct
  misc_feature 1..19: note = Description of Artificial Sequence: Syntheticoligonucleotide
  source 1..19: mol_type = other DNA
tgactcgcgcgagtcaggg

SEQ ID NO: 13180 - DNA, 19 bp, synthetic construct
  misc_feature 1..19: note = Description of Artificial Sequence: Syntheticoligonucleotide
  source 1..19: mol_type = other DNA
cgactcgcgcgagtcgtgg

SEQ ID NO: 13181 - DNA, 19 bp, synthetic construct
  misc_feature 1..19: note = Description of Artificial Sequence: Syntheticoligonucleotide
  source 1..19: mol_type = other DNA
cgactcgcgcgagtcggct

SEQ ID NO: 13182 - DNA, 19 bp, synthetic construct
  misc_feature 1..19: note = Description of Artificial Sequence: Syntheticoligonucleotide
  source 1..19: mol_type = other DNA
cgactcgcgcgagtcggca

SEQ ID NO: 13183 - DNA, 19 bp, synthetic construct
  misc_feature 1..19: note = Description of Artificial Sequence: Syntheticoligonucleotide
  source 1..19: mol_type = other DNA
agactcgcgcgagtctcgc

SEQ ID NO: 13184 - DNA, 19 bp, synthetic construct
  misc_feature 1..19: note = Description of Artificial Sequence: Syntheticoligonucleotide
  source 1..19: mol_type = other DNA
tgactcgcgcgagtcacgc

SEQ ID NO: 13185 - DNA, 19 bp, synthetic construct
  misc_feature 1..19: note = Description of Artificial Sequence: Syntheticoligonucleotide
  source 1..19: mol_type = other DNA
ggactcgcgcgagtcctgc

SEQ ID NO: 13186 - DNA, 19 bp, synthetic construct
  misc_feature 1..19: note = Description of Artificial Sequence: Syntheticoligonucleotide
  source 1..19: mol_type = other DNA
ggactcgcgcgagtccagc

SEQ ID NO: 13187 - DNA, 19 bp, synthetic construct
  misc_feature 1..19: note = Description of Artificial Sequence: Syntheticoligonucleotide
  source 1..19: mol_type = other DNA
ggactcgcgcgagtcctcg

SEQ ID NO: 13188 - DNA, 19 bp, synthetic construct
  misc_feature 1..19: note = Description of Artificial Sequence: Syntheticoligonucleotide
  source 1..19: mol_type = other DNA
ggactcgcgcgagtccacg

SEQ ID NO: 13189 - DNA, 19 bp, synthetic construct
  misc_feature 1..19: note = Description of Artificial Sequence: Syntheticoligonucleotide
  source 1..19: mol_type = other DNA
cgactcgcgcgagtcggtg

SEQ ID NO: 13190 - DNA, 19 bp, synthetic construct
  misc_feature 1..19: note = Description of Artificial Sequence: Syntheticoligonucleotide
  source 1..19: mol_type = other DNA
cgactcgcgcgagtcggag

SEQ ID NO: 13191 - DNA, 19 bp, synthetic construct
  misc_feature 1..19: note = Description of Artificial Sequence: Syntheticoligonucleotide
  source 1..19: mol_type = other DNA
ggactcgcgcgagtcccgc

SEQ ID NO: 13192 - DNA, 19 bp, synthetic construct
  misc_feature 1..19: note = Description of Artificial Sequence: Syntheticoligonucleotide
  source 1..19: mol_type = other DNA
ggactcgcgcgagtccctc

SEQ ID NO: 13193 - DNA, 19 bp, synthetic construct
  misc_feature 1..19: note = Description of Artificial Sequence: Syntheticoligonucleotide
  source 1..19: mol_type = other DNA
ggactcgcgcgagtcccac

SEQ ID NO: 13194 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactcacgtgagtcnnnn

SEQ ID NO: 13195 - DNA, 19 bp, synthetic construct
  misc_feature 1..19: note = Description of Artificial Sequence: Syntheticoligonucleotide
  source 1..19: mol_type = other DNA
ggactcacgtgagtccgcc

SEQ ID NO: 13196 - DNA, 19 bp, synthetic construct
  misc_feature 1..19: note = Description of Artificial Sequence: Syntheticoligonucleotide
  source 1..19: mol_type = other DNA
ggactcacgtgagtccgct

SEQ ID NO: 13197 - DNA, 19 bp, synthetic construct
  misc_feature 1..19: note = Description of Artificial Sequence: Syntheticoligonucleotide
  source 1..19: mol_type = other DNA
ggactcacgtgagtccgtc

SEQ ID NO: 13198 - DNA, 19 bp, synthetic construct
  misc_feature 1..19: note = Description of Artificial Sequence: Syntheticoligonucleotide
  source 1..19: mol_type = other DNA
ggactcacgtgagtcctcc

SEQ ID NO: 13199 - DNA, 19 bp, synthetic construct
  misc_feature 1..19: note = Description of Artificial Sequence: Syntheticoligonucleotide
  source 1..19: mol_type = other DNA
agactcacgtgagtctgcc

SEQ ID NO: 13200 - DNA, 19 bp, synthetic construct
  misc_feature 1..19: note = Description of Artificial Sequence: Syntheticoligonucleotide
  source 1..19: mol_type = other DNA
ggactcacgtgagtccgca

SEQ ID NO: 13201 - DNA, 19 bp, synthetic construct
  misc_feature 1..19: note = Description of Artificial Sequence: Syntheticoligonucleotide
  source 1..19: mol_type = other DNA
ggactcacgtgagtccgac

SEQ ID NO: 13202 - DNA, 19 bp, synthetic construct
  misc_feature 1..19: note = Description of Artificial Sequence: Syntheticoligonucleotide
  source 1..19: mol_type = other DNA
ggactcacgtgagtccacc

SEQ ID NO: 13203 - DNA, 19 bp, synthetic construct
  misc_feature 1..19: note = Description of Artificial Sequence: Syntheticoligonucleotide
  source 1..19: mol_type = other DNA
tgactcacgtgagtcagcc

SEQ ID NO: 13204 - DNA, 19 bp, synthetic construct
  misc_feature 1..19: note = Description of Artificial Sequence: Syntheticoligonucleotide
  source 1..19: mol_type = other DNA
cgactcacgtgagtcgggc

SEQ ID NO: 13205 - DNA, 19 bp, synthetic construct
  misc_feature 1..19: note = Description of Artificial Sequence: Syntheticoligonucleotide
  source 1..19: mol_type = other DNA
cgactcacgtgagtcgggt

SEQ ID NO: 13206 - DNA, 19 bp, synthetic construct
  misc_feature 1..19: note = Description of Artificial Sequence: Syntheticoligonucleotide
  source 1..19: mol_type = other DNA
cgactcacgtgagtcggtc

SEQ ID NO: 13207 - DNA, 19 bp, synthetic construct
  misc_feature 1..19: note = Description of Artificial Sequence: Syntheticoligonucleotide
  source 1..19: mol_type = other DNA
cgactcacgtgagtcgtgc

SEQ ID NO: 13208 - DNA, 19 bp, synthetic construct
  misc_feature 1..19: note = Description of Artificial Sequence: Syntheticoligonucleotide
  source 1..19: mol_type = other DNA
agactcacgtgagtctggc

SEQ ID NO: 13209 - DNA, 19 bp, synthetic construct
  misc_feature 1..19: note = Description of Artificial Sequence: Syntheticoligonucleotide
  source 1..19: mol_type = other DNA
cgactcacgtgagtcggga

SEQ ID NO: 13210 - DNA, 19 bp, synthetic construct
  misc_feature 1..19: note = Description of Artificial Sequence: Syntheticoligonucleotide
  source 1..19: mol_type = other DNA
cgactcacgtgagtcggac

SEQ ID NO: 13211 - DNA, 19 bp, synthetic construct
  misc_feature 1..19: note = Description of Artificial Sequence: Syntheticoligonucleotide
  source 1..19: mol_type = other DNA
tgactcacgtgagtcaggc

SEQ ID NO: 13212 - DNA, 19 bp, synthetic construct
  misc_feature 1..19: note = Description of Artificial Sequence: Syntheticoligonucleotide
  source 1..19: mol_type = other DNA
cgactcacgtgagtcgccc

SEQ ID NO: 13213 - DNA, 19 bp, synthetic construct
  misc_feature 1..19: note = Description of Artificial Sequence: Syntheticoligonucleotide
  source 1..19: mol_type = other DNA
cgactcacgtgagtcgcct

SEQ ID NO: 13214 - DNA, 19 bp, synthetic construct
  misc_feature 1..19: note = Description of Artificial Sequence: Syntheticoligonucleotide
  source 1..19: mol_type = other DNA
cgactcacgtgagtcgctc

SEQ ID NO: 13215 - DNA, 19 bp, synthetic construct
  misc_feature 1..19: note = Description of Artificial Sequence: Syntheticoligonucleotide
  source 1..19: mol_type = other DNA
cgactcacgtgagtcgtcc

SEQ ID NO: 13216 - DNA, 19 bp, synthetic construct
  misc_feature 1..19: note = Description of Artificial Sequence: Syntheticoligonucleotide
  source 1..19: mol_type = other DNA
agactcacgtgagtctccc

SEQ ID NO: 13217 - DNA, 19 bp, synthetic construct
  misc_feature 1..19: note = Description of Artificial Sequence: Syntheticoligonucleotide
  source 1..19: mol_type = other DNA
cgactcacgtgagtcgcca

SEQ ID NO: 13218 - DNA, 19 bp, synthetic construct
  misc_feature 1..19: note = Description of Artificial Sequence: Syntheticoligonucleotide
  source 1..19: mol_type = other DNA
cgactcacgtgagtcgcac

SEQ ID NO: 13219 - DNA, 19 bp, synthetic construct
  misc_feature 1..19: note = Description of Artificial Sequence: Syntheticoligonucleotide
  source 1..19: mol_type = other DNA
tgactcacgtgagtcaccc

SEQ ID NO: 13220 - DNA, 19 bp, synthetic construct
  misc_feature 1..19: note = Description of Artificial Sequence: Syntheticoligonucleotide
  source 1..19: mol_type = other DNA
ggactcacgtgagtcccgt

SEQ ID NO: 13221 - DNA, 19 bp, synthetic construct
  misc_feature 1..19: note = Description of Artificial Sequence: Syntheticoligonucleotide
  source 1..19: mol_type = other DNA
ggactcacgtgagtccctg

SEQ ID NO: 13222 - DNA, 19 bp, synthetic construct
  misc_feature 1..19: note = Description of Artificial Sequence: Syntheticoligonucleotide
  source 1..19: mol_type = other DNA
ggactcacgtgagtcctgg

SEQ ID NO: 13223 - DNA, 19 bp, synthetic construct
  misc_feature 1..19: note = Description of Artificial Sequence: Syntheticoligonucleotide
  source 1..19: mol_type = other DNA
agactcacgtgagtctcgg

SEQ ID NO: 13224 - DNA, 19 bp, synthetic construct
  misc_feature 1..19: note = Description of Artificial Sequence: Syntheticoligonucleotide
  source 1..19: mol_type = other DNA
ggactcacgtgagtcccga

SEQ ID NO: 13225 - DNA, 19 bp, synthetic construct
  misc_feature 1..19: note = Description of Artificial Sequence: Syntheticoligonucleotide
  source 1..19: mol_type = other DNA
ggactcacgtgagtcccag

SEQ ID NO: 13226 - DNA, 19 bp, synthetic construct
  misc_feature 1..19: note = Description of Artificial Sequence: Syntheticoligonucleotide
  source 1..19: mol_type = other DNA
ggactcacgtgagtccagg

SEQ ID NO: 13227 - DNA, 19 bp, synthetic construct
  misc_feature 1..19: note = Description of Artificial Sequence: Syntheticoligonucleotide
  source 1..19: mol_type = other DNA
tgactcacgtgagtcacgg

SEQ ID NO: 13228 - DNA, 19 bp, synthetic construct
  misc_feature 1..19: note = Description of Artificial Sequence: Syntheticoligonucleotide
  source 1..19: mol_type = other DNA
cgactcacgtgagtcgccg

SEQ ID NO: 13229 - DNA, 19 bp, synthetic construct
  misc_feature 1..19: note = Description of Artificial Sequence: Syntheticoligonucleotide
  source 1..19: mol_type = other DNA
cgactcacgtgagtcgctg

SEQ ID NO: 13230 - DNA, 19 bp, synthetic construct
  misc_feature 1..19: note = Description of Artificial Sequence: Syntheticoligonucleotide
  source 1..19: mol_type = other DNA
cgactcacgtgagtcgtcg

SEQ ID NO: 13231 - DNA, 19 bp, synthetic construct
  misc_feature 1..19: note = Description of Artificial Sequence: Syntheticoligonucleotide
  source 1..19: mol_type = other DNA
agactcacgtgagtctccg

SEQ ID NO: 13232 - DNA, 19 bp, synthetic construct
  misc_feature 1..19: note = Description of Artificial Sequence: Syntheticoligonucleotide
  source 1..19: mol_type = other DNA
cgactcacgtgagtcgcag

SEQ ID NO: 13233 - DNA, 19 bp, synthetic construct
  misc_feature 1..19: note = Description of Artificial Sequence: Syntheticoligonucleotide
  source 1..19: mol_type = other DNA
tgactcacgtgagtcaccg

SEQ ID NO: 13234 - DNA, 19 bp, synthetic construct
  misc_feature 1..19: note = Description of Artificial Sequence: Syntheticoligonucleotide
  source 1..19: mol_type = other DNA
ggactcacgtgagtccgtg

SEQ ID NO: 13235 - DNA, 19 bp, synthetic construct
  misc_feature 1..19: note = Description of Artificial Sequence: Syntheticoligonucleotide
  source 1..19: mol_type = other DNA
agactcacgtgagtctggg

SEQ ID NO: 13236 - DNA, 19 bp, synthetic construct
  misc_feature 1..19: note = Description of Artificial Sequence: Syntheticoligonucleotide
  source 1..19: mol_type = other DNA
ggactcacgtgagtccgag

SEQ ID NO: 13237 - DNA, 19 bp, synthetic construct
  misc_feature 1..19: note = Description of Artificial Sequence: Syntheticoligonucleotide
  source 1..19: mol_type = other DNA
tgactcacgtgagtcaggg

SEQ ID NO: 13238 - DNA, 19 bp, synthetic construct
  misc_feature 1..19: note = Description of Artificial Sequence: Syntheticoligonucleotide
  source 1..19: mol_type = other DNA
cgactcacgtgagtcgtgg

SEQ ID NO: 13239 - DNA, 19 bp, synthetic construct
  misc_feature 1..19: note = Description of Artificial Sequence: Syntheticoligonucleotide
  source 1..19: mol_type = other DNA
cgactcacgtgagtcggct

SEQ ID NO: 13240 - DNA, 19 bp, synthetic construct
  misc_feature 1..19: note = Description of Artificial Sequence: Syntheticoligonucleotide
  source 1..19: mol_type = other DNA
cgactcacgtgagtcggca

SEQ ID NO: 13241 - DNA, 19 bp, synthetic construct
  misc_feature 1..19: note = Description of Artificial Sequence: Syntheticoligonucleotide
  source 1..19: mol_type = other DNA
agactcacgtgagtctcgc

SEQ ID NO: 13242 - DNA, 19 bp, synthetic construct
  misc_feature 1..19: note = Description of Artificial Sequence: Syntheticoligonucleotide
  source 1..19: mol_type = other DNA
tgactcacgtgagtcacgc

SEQ ID NO: 13243 - DNA, 19 bp, synthetic construct
  misc_feature 1..19: note = Description of Artificial Sequence: Syntheticoligonucleotide
  source 1..19: mol_type = other DNA
ggactcacgtgagtcctgc

SEQ ID NO: 13244 - DNA, 19 bp, synthetic construct
  misc_feature 1..19: note = Description of Artificial Sequence: Syntheticoligonucleotide
  source 1..19: mol_type = other DNA
ggactcacgtgagtccagc

SEQ ID NO: 13245 - DNA, 19 bp, synthetic construct
  misc_feature 1..19: note = Description of Artificial Sequence: Syntheticoligonucleotide
  source 1..19: mol_type = other DNA
ggactcacgtgagtcctcg

SEQ ID NO: 13246 - DNA, 19 bp, synthetic construct
  misc_feature 1..19: note = Description of Artificial Sequence: Syntheticoligonucleotide
  source 1..19: mol_type = other DNA
ggactcacgtgagtccacg

SEQ ID NO: 13247 - DNA, 19 bp, synthetic construct
  misc_feature 1..19: note = Description of Artificial Sequence: Syntheticoligonucleotide
  source 1..19: mol_type = other DNA
cgactcacgtgagtcggtg

SEQ ID NO: 13248 - DNA, 19 bp, synthetic construct
  misc_feature 1..19: note = Description of Artificial Sequence: Syntheticoligonucleotide
  source 1..19: mol_type = other DNA
cgactcacgtgagtcggag

SEQ ID NO: 13249 - DNA, 19 bp, synthetic construct
  misc_feature 1..19: note = Description of Artificial Sequence: Syntheticoligonucleotide
  source 1..19: mol_type = other DNA
ggactcacgtgagtcccgc

SEQ ID NO: 13250 - DNA, 19 bp, synthetic construct
  misc_feature 1..19: note = Description of Artificial Sequence: Syntheticoligonucleotide
  source 1..19: mol_type = other DNA
ggactcacgtgagtccctc

SEQ ID NO: 13251 - DNA, 19 bp, synthetic construct
  misc_feature 1..19: note = Description of Artificial Sequence: Syntheticoligonucleotide
  source 1..19: mol_type = other DNA
ggactcacgtgagtcccac

SEQ ID NO: 13252 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactcggccgagtcnnnn

SEQ ID NO: 13253 - DNA, 19 bp, synthetic construct
  misc_feature 1..19: note = Description of Artificial Sequence: Syntheticoligonucleotide
  source 1..19: mol_type = other DNA
ggactcggccgagtccgcc

SEQ ID NO: 13254 - DNA, 19 bp, synthetic construct
  misc_feature 1..19: note = Description of Artificial Sequence: Syntheticoligonucleotide
  source 1..19: mol_type = other DNA
ggactcggccgagtccgct

SEQ ID NO: 13255 - DNA, 19 bp, synthetic construct
  misc_feature 1..19: note = Description of Artificial Sequence: Syntheticoligonucleotide
  source 1..19: mol_type = other DNA
ggactcggccgagtccgtc

SEQ ID NO: 13256 - DNA, 19 bp, synthetic construct
  misc_feature 1..19: note = Description of Artificial Sequence: Syntheticoligonucleotide
  source 1..19: mol_type = other DNA
ggactcggccgagtcctcc

SEQ ID NO: 13257 - DNA, 19 bp, synthetic construct
  misc_feature 1..19: note = Description of Artificial Sequence: Syntheticoligonucleotide
  source 1..19: mol_type = other DNA
agactcggccgagtctgcc

SEQ ID NO: 13258 - DNA, 19 bp, synthetic construct
  misc_feature 1..19: note = Description of Artificial Sequence: Syntheticoligonucleotide
  source 1..19: mol_type = other DNA
ggactcggccgagtccgca

SEQ ID NO: 13259 - DNA, 19 bp, synthetic construct
  misc_feature 1..19: note = Description of Artificial Sequence: Syntheticoligonucleotide
  source 1..19: mol_type = other DNA
ggactcggccgagtccgac

SEQ ID NO: 13260 - DNA, 19 bp, synthetic construct
  misc_feature 1..19: note = Description of Artificial Sequence: Syntheticoligonucleotide
  source 1..19: mol_type = other DNA
ggactcggccgagtccacc

SEQ ID NO: 13261 - DNA, 19 bp, synthetic construct
  misc_feature 1..19: note = Description of Artificial Sequence: Syntheticoligonucleotide
  source 1..19: mol_type = other DNA
tgactcggccgagtcagcc

SEQ ID NO: 13262 - DNA, 19 bp, synthetic construct
  misc_feature 1..19: note = Description of Artificial Sequence: Syntheticoligonucleotide
  source 1..19: mol_type = other DNA
cgactcggccgagtcgggc

SEQ ID NO: 13263 - DNA, 19 bp, synthetic construct
  misc_feature 1..19: note = Description of Artificial Sequence: Syntheticoligonucleotide
  source 1..19: mol_type = other DNA
cgactcggccgagtcgggt

SEQ ID NO: 13264 - DNA, 19 bp, synthetic construct
  misc_feature 1..19: note = Description of Artificial Sequence: Syntheticoligonucleotide
  source 1..19: mol_type = other DNA
cgactcggccgagtcggtc

SEQ ID NO: 13265 - DNA, 19 bp, synthetic construct
  misc_feature 1..19: note = Description of Artificial Sequence: Syntheticoligonucleotide
  source 1..19: mol_type = other DNA
cgactcggccgagtcgtgc

SEQ ID NO: 13266 - DNA, 19 bp, synthetic construct
  misc_feature 1..19: note = Description of Artificial Sequence: Syntheticoligonucleotide
  source 1..19: mol_type = other DNA
agactcggccgagtctggc

SEQ ID NO: 13267 - DNA, 19 bp, synthetic construct
  misc_feature 1..19: note = Description of Artificial Sequence: Syntheticoligonucleotide
  source 1..19: mol_type = other DNA
cgactcggccgagtcggga

SEQ ID NO: 13268 - DNA, 19 bp, synthetic construct
  misc_feature 1..19: note = Description of Artificial Sequence: Syntheticoligonucleotide
  source 1..19: mol_type = other DNA
cgactcggccgagtcggac

SEQ ID NO: 13269 - DNA, 19 bp, synthetic construct
  misc_feature 1..19: note = Description of Artificial Sequence: Syntheticoligonucleotide
  source 1..19: mol_type = other DNA
tgactcggccgagtcaggc

SEQ ID NO: 13270 - DNA, 19 bp, synthetic construct
  misc_feature 1..19: note = Description of Artificial Sequence: Syntheticoligonucleotide
  source 1..19: mol_type = other DNA
cgactcggccgagtcgccc

SEQ ID NO: 13271 - DNA, 19 bp, synthetic construct
  misc_feature 1..19: note = Description of Artificial Sequence: Syntheticoligonucleotide
  source 1..19: mol_type = other DNA
cgactcggccgagtcgcct

SEQ ID NO: 13272 - DNA, 19 bp, synthetic construct
  misc_feature 1..19: note = Description of Artificial Sequence: Syntheticoligonucleotide
  source 1..19: mol_type = other DNA
cgactcggccgagtcgctc

SEQ ID NO: 13273 - DNA, 19 bp, synthetic construct
  misc_feature 1..19: note = Description of Artificial Sequence: Syntheticoligonucleotide
  source 1..19: mol_type = other DNA
cgactcggccgagtcgtcc

SEQ ID NO: 13274 - DNA, 19 bp, synthetic construct
  misc_feature 1..19: note = Description of Artificial Sequence: Syntheticoligonucleotide
  source 1..19: mol_type = other DNA
agactcggccgagtctccc

SEQ ID NO: 13275 - DNA, 19 bp, synthetic construct
  misc_feature 1..19: note = Description of Artificial Sequence: Syntheticoligonucleotide
  source 1..19: mol_type = other DNA
cgactcggccgagtcgcca

SEQ ID NO: 13276 - DNA, 19 bp, synthetic construct
  misc_feature 1..19: note = Description of Artificial Sequence: Syntheticoligonucleotide
  source 1..19: mol_type = other DNA
cgactcggccgagtcgcac

SEQ ID NO: 13277 - DNA, 19 bp, synthetic construct
  misc_feature 1..19: note = Description of Artificial Sequence: Syntheticoligonucleotide
  source 1..19: mol_type = other DNA
tgactcggccgagtcaccc

SEQ ID NO: 13278 - DNA, 19 bp, synthetic construct
  misc_feature 1..19: note = Description of Artificial Sequence: Syntheticoligonucleotide
  source 1..19: mol_type = other DNA
ggactcggccgagtcccgt

SEQ ID NO: 13279 - DNA, 19 bp, synthetic construct
  misc_feature 1..19: note = Description of Artificial Sequence: Syntheticoligonucleotide
  source 1..19: mol_type = other DNA
ggactcggccgagtccctg

SEQ ID NO: 13280 - DNA, 19 bp, synthetic construct
  misc_feature 1..19: note = Description of Artificial Sequence: Syntheticoligonucleotide
  source 1..19: mol_type = other DNA
ggactcggccgagtcctgg

SEQ ID NO: 13281 - DNA, 19 bp, synthetic construct
  misc_feature 1..19: note = Description of Artificial Sequence: Syntheticoligonucleotide
  source 1..19: mol_type = other DNA
agactcggccgagtctcgg

SEQ ID NO: 13282 - DNA, 19 bp, synthetic construct
  misc_feature 1..19: note = Description of Artificial Sequence: Syntheticoligonucleotide
  source 1..19: mol_type = other DNA
ggactcggccgagtcccga

SEQ ID NO: 13283 - DNA, 19 bp, synthetic construct
  misc_feature 1..19: note = Description of Artificial Sequence: Syntheticoligonucleotide
  source 1..19: mol_type = other DNA
ggactcggccgagtcccag

SEQ ID NO: 13284 - DNA, 19 bp, synthetic construct
  misc_feature 1..19: note = Description of Artificial Sequence: Syntheticoligonucleotide
  source 1..19: mol_type = other DNA
ggactcggccgagtccagg

SEQ ID NO: 13285 - DNA, 19 bp, synthetic construct
  misc_feature 1..19: note = Description of Artificial Sequence: Syntheticoligonucleotide
  source 1..19: mol_type = other DNA
tgactcggccgagtcacgg

SEQ ID NO: 13286 - DNA, 19 bp, synthetic construct
  misc_feature 1..19: note = Description of Artificial Sequence: Syntheticoligonucleotide
  source 1..19: mol_type = other DNA
cgactcggccgagtcgccg

SEQ ID NO: 13287 - DNA, 19 bp, synthetic construct
  misc_feature 1..19: note = Description of Artificial Sequence: Syntheticoligonucleotide
  source 1..19: mol_type = other DNA
cgactcggccgagtcgctg

SEQ ID NO: 13288 - DNA, 19 bp, synthetic construct
  misc_feature 1..19: note = Description of Artificial Sequence: Syntheticoligonucleotide
  source 1..19: mol_type = other DNA
cgactcggccgagtcgtcg

SEQ ID NO: 13289 - DNA, 19 bp, synthetic construct
  misc_feature 1..19: note = Description of Artificial Sequence: Syntheticoligonucleotide
  source 1..19: mol_type = other DNA
agactcggccgagtctccg

SEQ ID NO: 13290 - DNA, 19 bp, synthetic construct
  misc_feature 1..19: note = Description of Artificial Sequence: Syntheticoligonucleotide
  source 1..19: mol_type = other DNA
cgactcggccgagtcgcag

SEQ ID NO: 13291 - DNA, 19 bp, synthetic construct
  misc_feature 1..19: note = Description of Artificial Sequence: Syntheticoligonucleotide
  source 1..19: mol_type = other DNA
tgactcggccgagtcaccg

SEQ ID NO: 13292 - DNA, 19 bp, synthetic construct
  misc_feature 1..19: note = Description of Artificial Sequence: Syntheticoligonucleotide
  source 1..19: mol_type = other DNA
ggactcggccgagtccgtg

SEQ ID NO: 13293 - DNA, 19 bp, synthetic construct
  misc_feature 1..19: note = Description of Artificial Sequence: Syntheticoligonucleotide
  source 1..19: mol_type = other DNA
agactcggccgagtctggg

SEQ ID NO: 13294 - DNA, 19 bp, synthetic construct
  misc_feature 1..19: note = Description of Artificial Sequence: Syntheticoligonucleotide
  source 1..19: mol_type = other DNA
ggactcggccgagtccgag

SEQ ID NO: 13295 - DNA, 19 bp, synthetic construct
  misc_feature 1..19: note = Description of Artificial Sequence: Syntheticoligonucleotide
  source 1..19: mol_type = other DNA
tgactcggccgagtcaggg

SEQ ID NO: 13296 - DNA, 19 bp, synthetic construct
  misc_feature 1..19: note = Description of Artificial Sequence: Syntheticoligonucleotide
  source 1..19: mol_type = other DNA
cgactcggccgagtcgtgg

SEQ ID NO: 13297 - DNA, 19 bp, synthetic construct
  misc_feature 1..19: note = Description of Artificial Sequence: Syntheticoligonucleotide
  source 1..19: mol_type = other DNA
cgactcggccgagtcggct

SEQ ID NO: 13298 - DNA, 19 bp, synthetic construct
  misc_feature 1..19: note = Description of Artificial Sequence: Syntheticoligonucleotide
  source 1..19: mol_type = other DNA
cgactcggccgagtcggca

SEQ ID NO: 13299 - DNA, 19 bp, synthetic construct
  misc_feature 1..19: note = Description of Artificial Sequence: Syntheticoligonucleotide
  source 1..19: mol_type = other DNA
agactcggccgagtctcgc

SEQ ID NO: 13300 - DNA, 19 bp, synthetic construct
  misc_feature 1..19: note = Description of Artificial Sequence: Syntheticoligonucleotide
  source 1..19: mol_type = other DNA
tgactcggccgagtcacgc

SEQ ID NO: 13301 - DNA, 19 bp, synthetic construct
  misc_feature 1..19: note = Description of Artificial Sequence: Syntheticoligonucleotide
  source 1..19: mol_type = other DNA
ggactcggccgagtcctgc

SEQ ID NO: 13302 - DNA, 19 bp, synthetic construct
  misc_feature 1..19: note = Description of Artificial Sequence: Syntheticoligonucleotide
  source 1..19: mol_type = other DNA
ggactcggccgagtccagc

SEQ ID NO: 13303 - DNA, 19 bp, synthetic construct
  misc_feature 1..19: note = Description of Artificial Sequence: Syntheticoligonucleotide
  source 1..19: mol_type = other DNA
ggactcggccgagtcctcg

SEQ ID NO: 13304 - DNA, 19 bp, synthetic construct
  misc_feature 1..19: note = Description of Artificial Sequence: Syntheticoligonucleotide
  source 1..19: mol_type = other DNA
ggactcggccgagtccacg

SEQ ID NO: 13305 - DNA, 19 bp, synthetic construct
  misc_feature 1..19: note = Description of Artificial Sequence: Syntheticoligonucleotide
  source 1..19: mol_type = other DNA
cgactcggccgagtcggtg

SEQ ID NO: 13306 - DNA, 19 bp, synthetic construct
  misc_feature 1..19: note = Description of Artificial Sequence: Syntheticoligonucleotide
  source 1..19: mol_type = other DNA
cgactcggccgagtcggag

SEQ ID NO: 13307 - DNA, 19 bp, synthetic construct
  misc_feature 1..19: note = Description of Artificial Sequence: Syntheticoligonucleotide
  source 1..19: mol_type = other DNA
ggactcggccgagtcccgc

SEQ ID NO: 13308 - DNA, 19 bp, synthetic construct
  misc_feature 1..19: note = Description of Artificial Sequence: Syntheticoligonucleotide
  source 1..19: mol_type = other DNA
ggactcggccgagtccctc

SEQ ID NO: 13309 - DNA, 19 bp, synthetic construct
  misc_feature 1..19: note = Description of Artificial Sequence: Syntheticoligonucleotide
  source 1..19: mol_type = other DNA
ggactcggccgagtcccac

SEQ ID NO: 13310 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactcccgggagtcnnnn

SEQ ID NO: 13311 - DNA, 19 bp, synthetic construct
  misc_feature 1..19: note = Description of Artificial Sequence: Syntheticoligonucleotide
  source 1..19: mol_type = other DNA
ggactcccgggagtccgcc

SEQ ID NO: 13312 - DNA, 19 bp, synthetic construct
  misc_feature 1..19: note = Description of Artificial Sequence: Syntheticoligonucleotide
  source 1..19: mol_type = other DNA
ggactcccgggagtccgct

SEQ ID NO: 13313 - DNA, 19 bp, synthetic construct
  misc_feature 1..19: note = Description of Artificial Sequence: Syntheticoligonucleotide
  source 1..19: mol_type = other DNA
ggactcccgggagtccgtc

SEQ ID NO: 13314 - DNA, 19 bp, synthetic construct
  misc_feature 1..19: note = Description of Artificial Sequence: Syntheticoligonucleotide
  source 1..19: mol_type = other DNA
ggactcccgggagtcctcc

SEQ ID NO: 13315 - DNA, 19 bp, synthetic construct
  misc_feature 1..19: note = Description of Artificial Sequence: Syntheticoligonucleotide
  source 1..19: mol_type = other DNA
agactcccgggagtctgcc

SEQ ID NO: 13316 - DNA, 19 bp, synthetic construct
  misc_feature 1..19: note = Description of Artificial Sequence: Syntheticoligonucleotide
  source 1..19: mol_type = other DNA
ggactcccgggagtccgca

SEQ ID NO: 13317 - DNA, 19 bp, synthetic construct
  misc_feature 1..19: note = Description of Artificial Sequence: Syntheticoligonucleotide
  source 1..19: mol_type = other DNA
ggactcccgggagtccgac

SEQ ID NO: 13318 - DNA, 19 bp, synthetic construct
  misc_feature 1..19: note = Description of Artificial Sequence: Syntheticoligonucleotide
  source 1..19: mol_type = other DNA
ggactcccgggagtccacc

SEQ ID NO: 13319 - DNA, 19 bp, synthetic construct
  misc_feature 1..19: note = Description of Artificial Sequence: Syntheticoligonucleotide
  source 1..19: mol_type = other DNA
tgactcccgggagtcagcc

SEQ ID NO: 13320 - DNA, 19 bp, synthetic construct
  misc_feature 1..19: note = Description of Artificial Sequence: Syntheticoligonucleotide
  source 1..19: mol_type = other DNA
cgactcccgggagtcgggc

SEQ ID NO: 13321 - DNA, 19 bp, synthetic construct
  misc_feature 1..19: note = Description of Artificial Sequence: Syntheticoligonucleotide
  source 1..19: mol_type = other DNA
cgactcccgggagtcgggt

SEQ ID NO: 13322 - DNA, 19 bp, synthetic construct
  misc_feature 1..19: note = Description of Artificial Sequence: Syntheticoligonucleotide
  source 1..19: mol_type = other DNA
cgactcccgggagtcggtc

SEQ ID NO: 13323 - DNA, 19 bp, synthetic construct
  misc_feature 1..19: note = Description of Artificial Sequence: Syntheticoligonucleotide
  source 1..19: mol_type = other DNA
cgactcccgggagtcgtgc

SEQ ID NO: 13324 - DNA, 19 bp, synthetic construct
  misc_feature 1..19: note = Description of Artificial Sequence: Syntheticoligonucleotide
  source 1..19: mol_type = other DNA
agactcccgggagtctggc

SEQ ID NO: 13325 - DNA, 19 bp, synthetic construct
  misc_feature 1..19: note = Description of Artificial Sequence: Syntheticoligonucleotide
  source 1..19: mol_type = other DNA
cgactcccgggagtcggga

SEQ ID NO: 13326 - DNA, 19 bp, synthetic construct
  misc_feature 1..19: note = Description of Artificial Sequence: Syntheticoligonucleotide
  source 1..19: mol_type = other DNA
cgactcccgggagtcggac

SEQ ID NO: 13327 - DNA, 19 bp, synthetic construct
  misc_feature 1..19: note = Description of Artificial Sequence: Syntheticoligonucleotide
  source 1..19: mol_type = other DNA
tgactcccgggagtcaggc

SEQ ID NO: 13328 - DNA, 19 bp, synthetic construct
  misc_feature 1..19: note = Description of Artificial Sequence: Syntheticoligonucleotide
  source 1..19: mol_type = other DNA
cgactcccgggagtcgccc

SEQ ID NO: 13329 - DNA, 19 bp, synthetic construct
  misc_feature 1..19: note = Description of Artificial Sequence: Syntheticoligonucleotide
  source 1..19: mol_type = other DNA
cgactcccgggagtcgcct

SEQ ID NO: 13330 - DNA, 19 bp, synthetic construct
  misc_feature 1..19: note = Description of Artificial Sequence: Syntheticoligonucleotide
  source 1..19: mol_type = other DNA
cgactcccgggagtcgctc

SEQ ID NO: 13331 - DNA, 19 bp, synthetic construct
  misc_feature 1..19: note = Description of Artificial Sequence: Syntheticoligonucleotide
  source 1..19: mol_type = other DNA
cgactcccgggagtcgtcc

SEQ ID NO: 13332 - DNA, 19 bp, synthetic construct
  misc_feature 1..19: note = Description of Artificial Sequence: Syntheticoligonucleotide
  source 1..19: mol_type = other DNA
agactcccgggagtctccc

SEQ ID NO: 13333 - DNA, 19 bp, synthetic construct
  misc_feature 1..19: note = Description of Artificial Sequence: Syntheticoligonucleotide
  source 1..19: mol_type = other DNA
cgactcccgggagtcgcca

SEQ ID NO: 13334 - DNA, 19 bp, synthetic construct
  misc_feature 1..19: note = Description of Artificial Sequence: Syntheticoligonucleotide
  source 1..19: mol_type = other DNA
cgactcccgggagtcgcac

SEQ ID NO: 13335 - DNA, 19 bp, synthetic construct
  misc_feature 1..19: note = Description of Artificial Sequence: Syntheticoligonucleotide
  source 1..19: mol_type = other DNA
tgactcccgggagtcaccc

SEQ ID NO: 13336 - DNA, 19 bp, synthetic construct
  misc_feature 1..19: note = Description of Artificial Sequence: Syntheticoligonucleotide
  source 1..19: mol_type = other DNA
ggactcccgggagtcccgt

SEQ ID NO: 13337 - DNA, 19 bp, synthetic construct
  misc_feature 1..19: note = Description of Artificial Sequence: Syntheticoligonucleotide
  source 1..19: mol_type = other DNA
ggactcccgggagtccctg

SEQ ID NO: 13338 - DNA, 19 bp, synthetic construct
  misc_feature 1..19: note = Description of Artificial Sequence: Syntheticoligonucleotide
  source 1..19: mol_type = other DNA
ggactcccgggagtcctgg

SEQ ID NO: 13339 - DNA, 19 bp, synthetic construct
  misc_feature 1..19: note = Description of Artificial Sequence: Syntheticoligonucleotide
  source 1..19: mol_type = other DNA
agactcccgggagtctcgg

SEQ ID NO: 13340 - DNA, 19 bp, synthetic construct
  misc_feature 1..19: note = Description of Artificial Sequence: Syntheticoligonucleotide
  source 1..19: mol_type = other DNA
ggactcccgggagtcccga

SEQ ID NO: 13341 - DNA, 19 bp, synthetic construct
  misc_feature 1..19: note = Description of Artificial Sequence: Syntheticoligonucleotide
  source 1..19: mol_type = other DNA
ggactcccgggagtcccag

SEQ ID NO: 13342 - DNA, 19 bp, synthetic construct
  misc_feature 1..19: note = Description of Artificial Sequence: Syntheticoligonucleotide
  source 1..19: mol_type = other DNA
ggactcccgggagtccagg

SEQ ID NO: 13343 - DNA, 19 bp, synthetic construct
  misc_feature 1..19: note = Description of Artificial Sequence: Syntheticoligonucleotide
  source 1..19: mol_type = other DNA
tgactcccgggagtcacgg

SEQ ID NO: 13344 - DNA, 19 bp, synthetic construct
  misc_feature 1..19: note = Description of Artificial Sequence: Syntheticoligonucleotide
  source 1..19: mol_type = other DNA
cgactcccgggagtcgccg

SEQ ID NO: 13345 - DNA, 19 bp, synthetic construct
  misc_feature 1..19: note = Description of Artificial Sequence: Syntheticoligonucleotide
  source 1..19: mol_type = other DNA
cgactcccgggagtcgctg

SEQ ID NO: 13346 - DNA, 19 bp, synthetic construct
  misc_feature 1..19: note = Description of Artificial Sequence: Syntheticoligonucleotide
  source 1..19: mol_type = other DNA
cgactcccgggagtcgtcg

SEQ ID NO: 13347 - DNA, 19 bp, synthetic construct
  misc_feature 1..19: note = Description of Artificial Sequence: Syntheticoligonucleotide
  source 1..19: mol_type = other DNA
agactcccgggagtctccg

SEQ ID NO: 13348 - DNA, 19 bp, synthetic construct
  misc_feature 1..19: note = Description of Artificial Sequence: Syntheticoligonucleotide
  source 1..19: mol_type = other DNA
cgactcccgggagtcgcag

SEQ ID NO: 13349 - DNA, 19 bp, synthetic construct
  misc_feature 1..19: note = Description of Artificial Sequence: Syntheticoligonucleotide
  source 1..19: mol_type = other DNA
tgactcccgggagtcaccg

SEQ ID NO: 13350 - DNA, 19 bp, synthetic construct
  misc_feature 1..19: note = Description of Artificial Sequence: Syntheticoligonucleotide
  source 1..19: mol_type = other DNA
ggactcccgggagtccgtg

SEQ ID NO: 13351 - DNA, 19 bp, synthetic construct
  misc_feature 1..19: note = Description of Artificial Sequence: Syntheticoligonucleotide
  source 1..19: mol_type = other DNA
agactcccgggagtctggg

SEQ ID NO: 13352 - DNA, 19 bp, synthetic construct
  misc_feature 1..19: note = Description of Artificial Sequence: Syntheticoligonucleotide
  source 1..19: mol_type = other DNA
ggactcccgggagtccgag

SEQ ID NO: 13353 - DNA, 19 bp, synthetic construct
  misc_feature 1..19: note = Description of Artificial Sequence: Syntheticoligonucleotide
  source 1..19: mol_type = other DNA
tgactcccgggagtcaggg

SEQ ID NO: 13354 - DNA, 19 bp, synthetic construct
  misc_feature 1..19: note = Description of Artificial Sequence: Syntheticoligonucleotide
  source 1..19: mol_type = other DNA
cgactcccgggagtcgtgg

SEQ ID NO: 13355 - DNA, 19 bp, synthetic construct
  misc_feature 1..19: note = Description of Artificial Sequence: Syntheticoligonucleotide
  source 1..19: mol_type = other DNA
cgactcccgggagtcggct

SEQ ID NO: 13356 - DNA, 19 bp, synthetic construct
  misc_feature 1..19: note = Description of Artificial Sequence: Syntheticoligonucleotide
  source 1..19: mol_type = other DNA
cgactcccgggagtcggca

SEQ ID NO: 13357 - DNA, 19 bp, synthetic construct
  misc_feature 1..19: note = Description of Artificial Sequence: Syntheticoligonucleotide
  source 1..19: mol_type = other DNA
agactcccgggagtctcgc

SEQ ID NO: 13358 - DNA, 19 bp, synthetic construct
  misc_feature 1..19: note = Description of Artificial Sequence: Syntheticoligonucleotide
  source 1..19: mol_type = other DNA
tgactcccgggagtcacgc

SEQ ID NO: 13359 - DNA, 19 bp, synthetic construct
  misc_feature 1..19: note = Description of Artificial Sequence: Syntheticoligonucleotide
  source 1..19: mol_type = other DNA
ggactcccgggagtcctgc

SEQ ID NO: 13360 - DNA, 19 bp, synthetic construct
  misc_feature 1..19: note = Description of Artificial Sequence: Syntheticoligonucleotide
  source 1..19: mol_type = other DNA
ggactcccgggagtccagc

SEQ ID NO: 13361 - DNA, 19 bp, synthetic construct
  misc_feature 1..19: note = Description of Artificial Sequence: Syntheticoligonucleotide
  source 1..19: mol_type = other DNA
ggactcccgggagtcctcg

SEQ ID NO: 13362 - DNA, 19 bp, synthetic construct
  misc_feature 1..19: note = Description of Artificial Sequence: Syntheticoligonucleotide
  source 1..19: mol_type = other DNA
ggactcccgggagtccacg

SEQ ID NO: 13363 - DNA, 19 bp, synthetic construct
  misc_feature 1..19: note = Description of Artificial Sequence: Syntheticoligonucleotide
  source 1..19: mol_type = other DNA
cgactcccgggagtcggtg

SEQ ID NO: 13364 - DNA, 19 bp, synthetic construct
  misc_feature 1..19: note = Description of Artificial Sequence: Syntheticoligonucleotide
  source 1..19: mol_type = other DNA
cgactcccgggagtcggag

SEQ ID NO: 13365 - DNA, 19 bp, synthetic construct
  misc_feature 1..19: note = Description of Artificial Sequence: Syntheticoligonucleotide
  source 1..19: mol_type = other DNA
ggactcccgggagtcccgc

SEQ ID NO: 13366 - DNA, 19 bp, synthetic construct
  misc_feature 1..19: note = Description of Artificial Sequence: Syntheticoligonucleotide
  source 1..19: mol_type = other DNA
ggactcccgggagtccctc

SEQ ID NO: 13367 - DNA, 19 bp, synthetic construct
  misc_feature 1..19: note = Description of Artificial Sequence: Syntheticoligonucleotide
  source 1..19: mol_type = other DNA
ggactcccgggagtcccac

SEQ ID NO: 13368 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactcgtacgagtcnnnn

SEQ ID NO: 13369 - DNA, 19 bp, synthetic construct
  misc_feature 1..19: note = Description of Artificial Sequence: Syntheticoligonucleotide
  source 1..19: mol_type = other DNA
ggactcgtacgagtccgcc

SEQ ID NO: 13370 - DNA, 19 bp, synthetic construct
  misc_feature 1..19: note = Description of Artificial Sequence: Syntheticoligonucleotide
  source 1..19: mol_type = other DNA
ggactcgtacgagtccgct

SEQ ID NO: 13371 - DNA, 19 bp, synthetic construct
  misc_feature 1..19: note = Description of Artificial Sequence: Syntheticoligonucleotide
  source 1..19: mol_type = other DNA
ggactcgtacgagtccgtc

SEQ ID NO: 13372 - DNA, 19 bp, synthetic construct
  misc_feature 1..19: note = Description of Artificial Sequence: Syntheticoligonucleotide
  source 1..19: mol_type = other DNA
ggactcgtacgagtcctcc

SEQ ID NO: 13373 - DNA, 19 bp, synthetic construct
  misc_feature 1..19: note = Description of Artificial Sequence: Syntheticoligonucleotide
  source 1..19: mol_type = other DNA
agactcgtacgagtctgcc

SEQ ID NO: 13374 - DNA, 19 bp, synthetic construct
  misc_feature 1..19: note = Description of Artificial Sequence: Syntheticoligonucleotide
  source 1..19: mol_type = other DNA
ggactcgtacgagtccgca

SEQ ID NO: 13375 - DNA, 19 bp, synthetic construct
  misc_feature 1..19: note = Description of Artificial Sequence: Syntheticoligonucleotide
  source 1..19: mol_type = other DNA
ggactcgtacgagtccgac

SEQ ID NO: 13376 - DNA, 19 bp, synthetic construct
  misc_feature 1..19: note = Description of Artificial Sequence: Syntheticoligonucleotide
  source 1..19: mol_type = other DNA
ggactcgtacgagtccacc

SEQ ID NO: 13377 - DNA, 19 bp, synthetic construct
  misc_feature 1..19: note = Description of Artificial Sequence: Syntheticoligonucleotide
  source 1..19: mol_type = other DNA
tgactcgtacgagtcagcc

SEQ ID NO: 13378 - DNA, 19 bp, synthetic construct
  misc_feature 1..19: note = Description of Artificial Sequence: Syntheticoligonucleotide
  source 1..19: mol_type = other DNA
cgactcgtacgagtcgggc

SEQ ID NO: 13379 - DNA, 19 bp, synthetic construct
  misc_feature 1..19: note = Description of Artificial Sequence: Syntheticoligonucleotide
  source 1..19: mol_type = other DNA
cgactcgtacgagtcgggt

SEQ ID NO: 13380 - DNA, 19 bp, synthetic construct
  misc_feature 1..19: note = Description of Artificial Sequence: Syntheticoligonucleotide
  source 1..19: mol_type = other DNA
cgactcgtacgagtcggtc

SEQ ID NO: 13381 - DNA, 19 bp, synthetic construct
  misc_feature 1..19: note = Description of Artificial Sequence: Syntheticoligonucleotide
  source 1..19: mol_type = other DNA
cgactcgtacgagtcgtgc

SEQ ID NO: 13382 - DNA, 19 bp, synthetic construct
  misc_feature 1..19: note = Description of Artificial Sequence: Syntheticoligonucleotide
  source 1..19: mol_type = other DNA
agactcgtacgagtctggc

SEQ ID NO: 13383 - DNA, 19 bp, synthetic construct
  misc_feature 1..19: note = Description of Artificial Sequence: Syntheticoligonucleotide
  source 1..19: mol_type = other DNA
cgactcgtacgagtcggga

SEQ ID NO: 13384 - DNA, 19 bp, synthetic construct
  misc_feature 1..19: note = Description of Artificial Sequence: Syntheticoligonucleotide
  source 1..19: mol_type = other DNA
cgactcgtacgagtcggac

SEQ ID NO: 13385 - DNA, 19 bp, synthetic construct
  misc_feature 1..19: note = Description of Artificial Sequence: Syntheticoligonucleotide
  source 1..19: mol_type = other DNA
tgactcgtacgagtcaggc

SEQ ID NO: 13386 - DNA, 19 bp, synthetic construct
  misc_feature 1..19: note = Description of Artificial Sequence: Syntheticoligonucleotide
  source 1..19: mol_type = other DNA
cgactcgtacgagtcgccc

SEQ ID NO: 13387 - DNA, 19 bp, synthetic construct
  misc_feature 1..19: note = Description of Artificial Sequence: Syntheticoligonucleotide
  source 1..19: mol_type = other DNA
cgactcgtacgagtcgcct

SEQ ID NO: 13388 - DNA, 19 bp, synthetic construct
  misc_feature 1..19: note = Description of Artificial Sequence: Syntheticoligonucleotide
  source 1..19: mol_type = other DNA
cgactcgtacgagtcgctc

SEQ ID NO: 13389 - DNA, 19 bp, synthetic construct
  misc_feature 1..19: note = Description of Artificial Sequence: Syntheticoligonucleotide
  source 1..19: mol_type = other DNA
cgactcgtacgagtcgtcc

SEQ ID NO: 13390 - DNA, 19 bp, synthetic construct
  misc_feature 1..19: note = Description of Artificial Sequence: Syntheticoligonucleotide
  source 1..19: mol_type = other DNA
agactcgtacgagtctccc

SEQ ID NO: 13391 - DNA, 19 bp, synthetic construct
  misc_feature 1..19: note = Description of Artificial Sequence: Syntheticoligonucleotide
  source 1..19: mol_type = other DNA
cgactcgtacgagtcgcca

SEQ ID NO: 13392 - DNA, 19 bp, synthetic construct
  misc_feature 1..19: note = Description of Artificial Sequence: Syntheticoligonucleotide
  source 1..19: mol_type = other DNA
cgactcgtacgagtcgcac

SEQ ID NO: 13393 - DNA, 19 bp, synthetic construct
  misc_feature 1..19: note = Description of Artificial Sequence: Syntheticoligonucleotide
  source 1..19: mol_type = other DNA
tgactcgtacgagtcaccc

SEQ ID NO: 13394 - DNA, 19 bp, synthetic construct
  misc_feature 1..19: note = Description of Artificial Sequence: Syntheticoligonucleotide
  source 1..19: mol_type = other DNA
ggactcgtacgagtcccgt

SEQ ID NO: 13395 - DNA, 19 bp, synthetic construct
  misc_feature 1..19: note = Description of Artificial Sequence: Syntheticoligonucleotide
  source 1..19: mol_type = other DNA
ggactcgtacgagtccctg

SEQ ID NO: 13396 - DNA, 19 bp, synthetic construct
  misc_feature 1..19: note = Description of Artificial Sequence: Syntheticoligonucleotide
  source 1..19: mol_type = other DNA
ggactcgtacgagtcctgg

SEQ ID NO: 13397 - DNA, 19 bp, synthetic construct
  misc_feature 1..19: note = Description of Artificial Sequence: Syntheticoligonucleotide
  source 1..19: mol_type = other DNA
agactcgtacgagtctcgg

SEQ ID NO: 13398 - DNA, 19 bp, synthetic construct
  misc_feature 1..19: note = Description of Artificial Sequence: Syntheticoligonucleotide
  source 1..19: mol_type = other DNA
ggactcgtacgagtcccga

SEQ ID NO: 13399 - DNA, 19 bp, synthetic construct
  misc_feature 1..19: note = Description of Artificial Sequence: Syntheticoligonucleotide
  source 1..19: mol_type = other DNA
ggactcgtacgagtcccag

SEQ ID NO: 13400 - DNA, 19 bp, synthetic construct
  misc_feature 1..19: note = Description of Artificial Sequence: Syntheticoligonucleotide
  source 1..19: mol_type = other DNA
ggactcgtacgagtccagg

SEQ ID NO: 13401 - DNA, 19 bp, synthetic construct
  misc_feature 1..19: note = Description of Artificial Sequence: Syntheticoligonucleotide
  source 1..19: mol_type = other DNA
tgactcgtacgagtcacgg

SEQ ID NO: 13402 - DNA, 19 bp, synthetic construct
  misc_feature 1..19: note = Description of Artificial Sequence: Syntheticoligonucleotide
  source 1..19: mol_type = other DNA
cgactcgtacgagtcgccg

SEQ ID NO: 13403 - DNA, 19 bp, synthetic construct
  misc_feature 1..19: note = Description of Artificial Sequence: Syntheticoligonucleotide
  source 1..19: mol_type = other DNA
cgactcgtacgagtcgctg

SEQ ID NO: 13404 - DNA, 19 bp, synthetic construct
  misc_feature 1..19: note = Description of Artificial Sequence: Syntheticoligonucleotide
  source 1..19: mol_type = other DNA
cgactcgtacgagtcgtcg

SEQ ID NO: 13405 - DNA, 19 bp, synthetic construct
  misc_feature 1..19: note = Description of Artificial Sequence: Syntheticoligonucleotide
  source 1..19: mol_type = other DNA
agactcgtacgagtctccg

SEQ ID NO: 13406 - DNA, 19 bp, synthetic construct
  misc_feature 1..19: note = Description of Artificial Sequence: Syntheticoligonucleotide
  source 1..19: mol_type = other DNA
cgactcgtacgagtcgcag

SEQ ID NO: 13407 - DNA, 19 bp, synthetic construct
  misc_feature 1..19: note = Description of Artificial Sequence: Syntheticoligonucleotide
  source 1..19: mol_type = other DNA
tgactcgtacgagtcaccg

SEQ ID NO: 13408 - DNA, 19 bp, synthetic construct
  misc_feature 1..19: note = Description of Artificial Sequence: Syntheticoligonucleotide
  source 1..19: mol_type = other DNA
ggactcgtacgagtccgtg

SEQ ID NO: 13409 - DNA, 19 bp, synthetic construct
  misc_feature 1..19: note = Description of Artificial Sequence: Syntheticoligonucleotide
  source 1..19: mol_type = other DNA
agactcgtacgagtctggg

SEQ ID NO: 13410 - DNA, 19 bp, synthetic construct
  misc_feature 1..19: note = Description of Artificial Sequence: Syntheticoligonucleotide
  source 1..19: mol_type = other DNA
ggactcgtacgagtccgag

SEQ ID NO: 13411 - DNA, 19 bp, synthetic construct
  misc_feature 1..19: note = Description of Artificial Sequence: Syntheticoligonucleotide
  source 1..19: mol_type = other DNA
tgactcgtacgagtcaggg

SEQ ID NO: 13412 - DNA, 19 bp, synthetic construct
  misc_feature 1..19: note = Description of Artificial Sequence: Syntheticoligonucleotide
  source 1..19: mol_type = other DNA
cgactcgtacgagtcgtgg

SEQ ID NO: 13413 - DNA, 19 bp, synthetic construct
  misc_feature 1..19: note = Description of Artificial Sequence: Syntheticoligonucleotide
  source 1..19: mol_type = other DNA
cgactcgtacgagtcggct

SEQ ID NO: 13414 - DNA, 19 bp, synthetic construct
  misc_feature 1..19: note = Description of Artificial Sequence: Syntheticoligonucleotide
  source 1..19: mol_type = other DNA
cgactcgtacgagtcggca

SEQ ID NO: 13415 - DNA, 19 bp, synthetic construct
  misc_feature 1..19: note = Description of Artificial Sequence: Syntheticoligonucleotide
  source 1..19: mol_type = other DNA
agactcgtacgagtctcgc

SEQ ID NO: 13416 - DNA, 19 bp, synthetic construct
  misc_feature 1..19: note = Description of Artificial Sequence: Syntheticoligonucleotide
  source 1..19: mol_type = other DNA
tgactcgtacgagtcacgc

SEQ ID NO: 13417 - DNA, 19 bp, synthetic construct
  misc_feature 1..19: note = Description of Artificial Sequence: Syntheticoligonucleotide
  source 1..19: mol_type = other DNA
ggactcgtacgagtcctgc

SEQ ID NO: 13418 - DNA, 19 bp, synthetic construct
  misc_feature 1..19: note = Description of Artificial Sequence: Syntheticoligonucleotide
  source 1..19: mol_type = other DNA
ggactcgtacgagtccagc

SEQ ID NO: 13419 - DNA, 19 bp, synthetic construct
  misc_feature 1..19: note = Description of Artificial Sequence: Syntheticoligonucleotide
  source 1..19: mol_type = other DNA
ggactcgtacgagtcctcg

SEQ ID NO: 13420 - DNA, 19 bp, synthetic construct
  misc_feature 1..19: note = Description of Artificial Sequence: Syntheticoligonucleotide
  source 1..19: mol_type = other DNA
ggactcgtacgagtccacg

SEQ ID NO: 13421 - DNA, 19 bp, synthetic construct
  misc_feature 1..19: note = Description of Artificial Sequence: Syntheticoligonucleotide
  source 1..19: mol_type = other DNA
cgactcgtacgagtcggtg

SEQ ID NO: 13422 - DNA, 19 bp, synthetic construct
  misc_feature 1..19: note = Description of Artificial Sequence: Syntheticoligonucleotide
  source 1..19: mol_type = other DNA
cgactcgtacgagtcggag

SEQ ID NO: 13423 - DNA, 19 bp, synthetic construct
  misc_feature 1..19: note = Description of Artificial Sequence: Syntheticoligonucleotide
  source 1..19: mol_type = other DNA
ggactcgtacgagtcccgc

SEQ ID NO: 13424 - DNA, 19 bp, synthetic construct
  misc_feature 1..19: note = Description of Artificial Sequence: Syntheticoligonucleotide
  source 1..19: mol_type = other DNA
ggactcgtacgagtccctc

SEQ ID NO: 13425 - DNA, 19 bp, synthetic construct
  misc_feature 1..19: note = Description of Artificial Sequence: Syntheticoligonucleotide
  source 1..19: mol_type = other DNA
ggactcgtacgagtcccac

SEQ ID NO: 13426 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactcctaggagtcnnnn

SEQ ID NO: 13427 - DNA, 19 bp, synthetic construct
  misc_feature 1..19: note = Description of Artificial Sequence: Syntheticoligonucleotide
  source 1..19: mol_type = other DNA
ggactcctaggagtccgcc

SEQ ID NO: 13428 - DNA, 19 bp, synthetic construct
  misc_feature 1..19: note = Description of Artificial Sequence: Syntheticoligonucleotide
  source 1..19: mol_type = other DNA
ggactcctaggagtccgct

SEQ ID NO: 13429 - DNA, 19 bp, synthetic construct
  misc_feature 1..19: note = Description of Artificial Sequence: Syntheticoligonucleotide
  source 1..19: mol_type = other DNA
ggactcctaggagtccgtc

SEQ ID NO: 13430 - DNA, 19 bp, synthetic construct
  misc_feature 1..19: note = Description of Artificial Sequence: Syntheticoligonucleotide
  source 1..19: mol_type = other DNA
ggactcctaggagtcctcc

SEQ ID NO: 13431 - DNA, 19 bp, synthetic construct
  misc_feature 1..19: note = Description of Artificial Sequence: Syntheticoligonucleotide
  source 1..19: mol_type = other DNA
agactcctaggagtctgcc

SEQ ID NO: 13432 - DNA, 19 bp, synthetic construct
  misc_feature 1..19: note = Description of Artificial Sequence: Syntheticoligonucleotide
  source 1..19: mol_type = other DNA
ggactcctaggagtccgca

SEQ ID NO: 13433 - DNA, 19 bp, synthetic construct
  misc_feature 1..19: note = Description of Artificial Sequence: Syntheticoligonucleotide
  source 1..19: mol_type = other DNA
ggactcctaggagtccgac

SEQ ID NO: 13434 - DNA, 19 bp, synthetic construct
  misc_feature 1..19: note = Description of Artificial Sequence: Syntheticoligonucleotide
  source 1..19: mol_type = other DNA
ggactcctaggagtccacc

SEQ ID NO: 13435 - DNA, 19 bp, synthetic construct
  misc_feature 1..19: note = Description of Artificial Sequence: Syntheticoligonucleotide
  source 1..19: mol_type = other DNA
tgactcctaggagtcagcc

SEQ ID NO: 13436 - DNA, 19 bp, synthetic construct
  misc_feature 1..19: note = Description of Artificial Sequence: Syntheticoligonucleotide
  source 1..19: mol_type = other DNA
cgactcctaggagtcgggc

SEQ ID NO: 13437 - DNA, 19 bp, synthetic construct
  misc_feature 1..19: note = Description of Artificial Sequence: Syntheticoligonucleotide
  source 1..19: mol_type = other DNA
cgactcctaggagtcgggt

SEQ ID NO: 13438 - DNA, 19 bp, synthetic construct
  misc_feature 1..19: note = Description of Artificial Sequence: Syntheticoligonucleotide
  source 1..19: mol_type = other DNA
cgactcctaggagtcggtc

SEQ ID NO: 13439 - DNA, 19 bp, synthetic construct
  misc_feature 1..19: note = Description of Artificial Sequence: Syntheticoligonucleotide
  source 1..19: mol_type = other DNA
cgactcctaggagtcgtgc

SEQ ID NO: 13440 - DNA, 19 bp, synthetic construct
  misc_feature 1..19: note = Description of Artificial Sequence: Syntheticoligonucleotide
  source 1..19: mol_type = other DNA
agactcctaggagtctggc

SEQ ID NO: 13441 - DNA, 19 bp, synthetic construct
  misc_feature 1..19: note = Description of Artificial Sequence: Syntheticoligonucleotide
  source 1..19: mol_type = other DNA
cgactcctaggagtcggga

SEQ ID NO: 13442 - DNA, 19 bp, synthetic construct
  misc_feature 1..19: note = Description of Artificial Sequence: Syntheticoligonucleotide
  source 1..19: mol_type = other DNA
cgactcctaggagtcggac

SEQ ID NO: 13443 - DNA, 19 bp, synthetic construct
  misc_feature 1..19: note = Description of Artificial Sequence: Syntheticoligonucleotide
  source 1..19: mol_type = other DNA
tgactcctaggagtcaggc

SEQ ID NO: 13444 - DNA, 19 bp, synthetic construct
  misc_feature 1..19: note = Description of Artificial Sequence: Syntheticoligonucleotide
  source 1..19: mol_type = other DNA
cgactcctaggagtcgccc

SEQ ID NO: 13445 - DNA, 19 bp, synthetic construct
  misc_feature 1..19: note = Description of Artificial Sequence: Syntheticoligonucleotide
  source 1..19: mol_type = other DNA
cgactcctaggagtcgcct

SEQ ID NO: 13446 - DNA, 19 bp, synthetic construct
  misc_feature 1..19: note = Description of Artificial Sequence: Syntheticoligonucleotide
  source 1..19: mol_type = other DNA
cgactcctaggagtcgctc

SEQ ID NO: 13447 - DNA, 19 bp, synthetic construct
  misc_feature 1..19: note = Description of Artificial Sequence: Syntheticoligonucleotide
  source 1..19: mol_type = other DNA
cgactcctaggagtcgtcc

SEQ ID NO: 13448 - DNA, 19 bp, synthetic construct
  misc_feature 1..19: note = Description of Artificial Sequence: Syntheticoligonucleotide
  source 1..19: mol_type = other DNA
agactcctaggagtctccc

SEQ ID NO: 13449 - DNA, 19 bp, synthetic construct
  misc_feature 1..19: note = Description of Artificial Sequence: Syntheticoligonucleotide
  source 1..19: mol_type = other DNA
cgactcctaggagtcgcca

SEQ ID NO: 13450 - DNA, 19 bp, synthetic construct
  misc_feature 1..19: note = Description of Artificial Sequence: Syntheticoligonucleotide
  source 1..19: mol_type = other DNA
cgactcctaggagtcgcac

SEQ ID NO: 13451 - DNA, 19 bp, synthetic construct
  misc_feature 1..19: note = Description of Artificial Sequence: Syntheticoligonucleotide
  source 1..19: mol_type = other DNA
tgactcctaggagtcaccc

SEQ ID NO: 13452 - DNA, 19 bp, synthetic construct
  misc_feature 1..19: note = Description of Artificial Sequence: Syntheticoligonucleotide
  source 1..19: mol_type = other DNA
ggactcctaggagtcccgt

SEQ ID NO: 13453 - DNA, 19 bp, synthetic construct
  misc_feature 1..19: note = Description of Artificial Sequence: Syntheticoligonucleotide
  source 1..19: mol_type = other DNA
ggactcctaggagtccctg

SEQ ID NO: 13454 - DNA, 19 bp, synthetic construct
  misc_feature 1..19: note = Description of Artificial Sequence: Syntheticoligonucleotide
  source 1..19: mol_type = other DNA
ggactcctaggagtcctgg

SEQ ID NO: 13455 - DNA, 19 bp, synthetic construct
  misc_feature 1..19: note = Description of Artificial Sequence: Syntheticoligonucleotide
  source 1..19: mol_type = other DNA
agactcctaggagtctcgg

SEQ ID NO: 13456 - DNA, 19 bp, synthetic construct
  misc_feature 1..19: note = Description of Artificial Sequence: Syntheticoligonucleotide
  source 1..19: mol_type = other DNA
ggactcctaggagtcccga

SEQ ID NO: 13457 - DNA, 19 bp, synthetic construct
  misc_feature 1..19: note = Description of Artificial Sequence: Syntheticoligonucleotide
  source 1..19: mol_type = other DNA
ggactcctaggagtcccag

SEQ ID NO: 13458 - DNA, 19 bp, synthetic construct
  misc_feature 1..19: note = Description of Artificial Sequence: Syntheticoligonucleotide
  source 1..19: mol_type = other DNA
ggactcctaggagtccagg

SEQ ID NO: 13459 - DNA, 19 bp, synthetic construct
  misc_feature 1..19: note = Description of Artificial Sequence: Syntheticoligonucleotide
  source 1..19: mol_type = other DNA
tgactcctaggagtcacgg

SEQ ID NO: 13460 - DNA, 19 bp, synthetic construct
  misc_feature 1..19: note = Description of Artificial Sequence: Syntheticoligonucleotide
  source 1..19: mol_type = other DNA
cgactcctaggagtcgccg

SEQ ID NO: 13461 - DNA, 19 bp, synthetic construct
  misc_feature 1..19: note = Description of Artificial Sequence: Syntheticoligonucleotide
  source 1..19: mol_type = other DNA
cgactcctaggagtcgctg

SEQ ID NO: 13462 - DNA, 19 bp, synthetic construct
  misc_feature 1..19: note = Description of Artificial Sequence: Syntheticoligonucleotide
  source 1..19: mol_type = other DNA
cgactcctaggagtcgtcg

SEQ ID NO: 13463 - DNA, 19 bp, synthetic construct
  misc_feature 1..19: note = Description of Artificial Sequence: Syntheticoligonucleotide
  source 1..19: mol_type = other DNA
agactcctaggagtctccg

SEQ ID NO: 13464 - DNA, 19 bp, synthetic construct
  misc_feature 1..19: note = Description of Artificial Sequence: Syntheticoligonucleotide
  source 1..19: mol_type = other DNA
cgactcctaggagtcgcag

SEQ ID NO: 13465 - DNA, 19 bp, synthetic construct
  misc_feature 1..19: note = Description of Artificial Sequence: Syntheticoligonucleotide
  source 1..19: mol_type = other DNA
tgactcctaggagtcaccg

SEQ ID NO: 13466 - DNA, 19 bp, synthetic construct
  misc_feature 1..19: note = Description of Artificial Sequence: Syntheticoligonucleotide
  source 1..19: mol_type = other DNA
ggactcctaggagtccgtg

SEQ ID NO: 13467 - DNA, 19 bp, synthetic construct
  misc_feature 1..19: note = Description of Artificial Sequence: Syntheticoligonucleotide
  source 1..19: mol_type = other DNA
agactcctaggagtctggg

SEQ ID NO: 13468 - DNA, 19 bp, synthetic construct
  misc_feature 1..19: note = Description of Artificial Sequence: Syntheticoligonucleotide
  source 1..19: mol_type = other DNA
ggactcctaggagtccgag

SEQ ID NO: 13469 - DNA, 19 bp, synthetic construct
  misc_feature 1..19: note = Description of Artificial Sequence: Syntheticoligonucleotide
  source 1..19: mol_type = other DNA
tgactcctaggagtcaggg

SEQ ID NO: 13470 - DNA, 19 bp, synthetic construct
  misc_feature 1..19: note = Description of Artificial Sequence: Syntheticoligonucleotide
  source 1..19: mol_type = other DNA
cgactcctaggagtcgtgg

SEQ ID NO: 13471 - DNA, 19 bp, synthetic construct
  misc_feature 1..19: note = Description of Artificial Sequence: Syntheticoligonucleotide
  source 1..19: mol_type = other DNA
cgactcctaggagtcggct

SEQ ID NO: 13472 - DNA, 19 bp, synthetic construct
  misc_feature 1..19: note = Description of Artificial Sequence: Syntheticoligonucleotide
  source 1..19: mol_type = other DNA
cgactcctaggagtcggca

SEQ ID NO: 13473 - DNA, 19 bp, synthetic construct
  misc_feature 1..19: note = Description of Artificial Sequence: Syntheticoligonucleotide
  source 1..19: mol_type = other DNA
agactcctaggagtctcgc

SEQ ID NO: 13474 - DNA, 19 bp, synthetic construct
  misc_feature 1..19: note = Description of Artificial Sequence: Syntheticoligonucleotide
  source 1..19: mol_type = other DNA
tgactcctaggagtcacgc

SEQ ID NO: 13475 - DNA, 19 bp, synthetic construct
  misc_feature 1..19: note = Description of Artificial Sequence: Syntheticoligonucleotide
  source 1..19: mol_type = other DNA
ggactcctaggagtcctgc

SEQ ID NO: 13476 - DNA, 19 bp, synthetic construct
  misc_feature 1..19: note = Description of Artificial Sequence: Syntheticoligonucleotide
  source 1..19: mol_type = other DNA
ggactcctaggagtccagc

SEQ ID NO: 13477 - DNA, 19 bp, synthetic construct
  misc_feature 1..19: note = Description of Artificial Sequence: Syntheticoligonucleotide
  source 1..19: mol_type = other DNA
ggactcctaggagtcctcg

SEQ ID NO: 13478 - DNA, 19 bp, synthetic construct
  misc_feature 1..19: note = Description of Artificial Sequence: Syntheticoligonucleotide
  source 1..19: mol_type = other DNA
ggactcctaggagtccacg

SEQ ID NO: 13479 - DNA, 19 bp, synthetic construct
  misc_feature 1..19: note = Description of Artificial Sequence: Syntheticoligonucleotide
  source 1..19: mol_type = other DNA
cgactcctaggagtcggtg

SEQ ID NO: 13480 - DNA, 19 bp, synthetic construct
  misc_feature 1..19: note = Description of Artificial Sequence: Syntheticoligonucleotide
  source 1..19: mol_type = other DNA
cgactcctaggagtcggag

SEQ ID NO: 13481 - DNA, 19 bp, synthetic construct
  misc_feature 1..19: note = Description of Artificial Sequence: Syntheticoligonucleotide
  source 1..19: mol_type = other DNA
ggactcctaggagtcccgc

SEQ ID NO: 13482 - DNA, 19 bp, synthetic construct
  misc_feature 1..19: note = Description of Artificial Sequence: Syntheticoligonucleotide
  source 1..19: mol_type = other DNA
ggactcctaggagtccctc

SEQ ID NO: 13483 - DNA, 19 bp, synthetic construct
  misc_feature 1..19: note = Description of Artificial Sequence: Syntheticoligonucleotide
  source 1..19: mol_type = other DNA
ggactcctaggagtcccac

SEQ ID NO: 13484 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactccatggagtcnnnn

SEQ ID NO: 13485 - DNA, 19 bp, synthetic construct
  misc_feature 1..19: note = Description of Artificial Sequence: Syntheticoligonucleotide
  source 1..19: mol_type = other DNA
ggactccatggagtccgcc

SEQ ID NO: 13486 - DNA, 19 bp, synthetic construct
  misc_feature 1..19: note = Description of Artificial Sequence: Syntheticoligonucleotide
  source 1..19: mol_type = other DNA
ggactccatggagtccgct

SEQ ID NO: 13487 - DNA, 19 bp, synthetic construct
  misc_feature 1..19: note = Description of Artificial Sequence: Syntheticoligonucleotide
  source 1..19: mol_type = other DNA
ggactccatggagtccgtc

SEQ ID NO: 13488 - DNA, 19 bp, synthetic construct
  misc_feature 1..19: note = Description of Artificial Sequence: Syntheticoligonucleotide
  source 1..19: mol_type = other DNA
ggactccatggagtcctcc

SEQ ID NO: 13489 - DNA, 19 bp, synthetic construct
  misc_feature 1..19: note = Description of Artificial Sequence: Syntheticoligonucleotide
  source 1..19: mol_type = other DNA
agactccatggagtctgcc

SEQ ID NO: 13490 - DNA, 19 bp, synthetic construct
  misc_feature 1..19: note = Description of Artificial Sequence: Syntheticoligonucleotide
  source 1..19: mol_type = other DNA
ggactccatggagtccgca

SEQ ID NO: 13491 - DNA, 19 bp, synthetic construct
  misc_feature 1..19: note = Description of Artificial Sequence: Syntheticoligonucleotide
  source 1..19: mol_type = other DNA
ggactccatggagtccgac

SEQ ID NO: 13492 - DNA, 19 bp, synthetic construct
  misc_feature 1..19: note = Description of Artificial Sequence: Syntheticoligonucleotide
  source 1..19: mol_type = other DNA
ggactccatggagtccacc

SEQ ID NO: 13493 - DNA, 19 bp, synthetic construct
  misc_feature 1..19: note = Description of Artificial Sequence: Syntheticoligonucleotide
  source 1..19: mol_type = other DNA
tgactccatggagtcagcc

SEQ ID NO: 13494 - DNA, 19 bp, synthetic construct
  misc_feature 1..19: note = Description of Artificial Sequence: Syntheticoligonucleotide
  source 1..19: mol_type = other DNA
cgactccatggagtcgggc

SEQ ID NO: 13495 - DNA, 19 bp, synthetic construct
  misc_feature 1..19: note = Description of Artificial Sequence: Syntheticoligonucleotide
  source 1..19: mol_type = other DNA
cgactccatggagtcgggt

SEQ ID NO: 13496 - DNA, 19 bp, synthetic construct
  misc_feature 1..19: note = Description of Artificial Sequence: Syntheticoligonucleotide
  source 1..19: mol_type = other DNA
cgactccatggagtcggtc

SEQ ID NO: 13497 - DNA, 19 bp, synthetic construct
  misc_feature 1..19: note = Description of Artificial Sequence: Syntheticoligonucleotide
  source 1..19: mol_type = other DNA
cgactccatggagtcgtgc

SEQ ID NO: 13498 - DNA, 19 bp, synthetic construct
  misc_feature 1..19: note = Description of Artificial Sequence: Syntheticoligonucleotide
  source 1..19: mol_type = other DNA
agactccatggagtctggc

SEQ ID NO: 13499 - DNA, 19 bp, synthetic construct
  misc_feature 1..19: note = Description of Artificial Sequence: Syntheticoligonucleotide
  source 1..19: mol_type = other DNA
cgactccatggagtcggga

SEQ ID NO: 13500 - DNA, 19 bp, synthetic construct
  misc_feature 1..19: note = Description of Artificial Sequence: Syntheticoligonucleotide
  source 1..19: mol_type = other DNA
cgactccatggagtcggac

SEQ ID NO: 13501 - DNA, 19 bp, synthetic construct
  misc_feature 1..19: note = Description of Artificial Sequence: Syntheticoligonucleotide
  source 1..19: mol_type = other DNA
tgactccatggagtcaggc

SEQ ID NO: 13502 - DNA, 19 bp, synthetic construct
  misc_feature 1..19: note = Description of Artificial Sequence: Syntheticoligonucleotide
  source 1..19: mol_type = other DNA
cgactccatggagtcgccc

SEQ ID NO: 13503 - DNA, 19 bp, synthetic construct
  misc_feature 1..19: note = Description of Artificial Sequence: Syntheticoligonucleotide
  source 1..19: mol_type = other DNA
cgactccatggagtcgcct

SEQ ID NO: 13504 - DNA, 19 bp, synthetic construct
  misc_feature 1..19: note = Description of Artificial Sequence: Syntheticoligonucleotide
  source 1..19: mol_type = other DNA
cgactccatggagtcgctc

SEQ ID NO: 13505 - DNA, 19 bp, synthetic construct
  misc_feature 1..19: note = Description of Artificial Sequence: Syntheticoligonucleotide
  source 1..19: mol_type = other DNA
cgactccatggagtcgtcc

SEQ ID NO: 13506 - DNA, 19 bp, synthetic construct
  misc_feature 1..19: note = Description of Artificial Sequence: Syntheticoligonucleotide
  source 1..19: mol_type = other DNA
agactccatggagtctccc

SEQ ID NO: 13507 - DNA, 19 bp, synthetic construct
  misc_feature 1..19: note = Description of Artificial Sequence: Syntheticoligonucleotide
  source 1..19: mol_type = other DNA
cgactccatggagtcgcca

SEQ ID NO: 13508 - DNA, 19 bp, synthetic construct
  misc_feature 1..19: note = Description of Artificial Sequence: Syntheticoligonucleotide
  source 1..19: mol_type = other DNA
cgactccatggagtcgcac

SEQ ID NO: 13509 - DNA, 19 bp, synthetic construct
  misc_feature 1..19: note = Description of Artificial Sequence: Syntheticoligonucleotide
  source 1..19: mol_type = other DNA
tgactccatggagtcaccc

SEQ ID NO: 13510 - DNA, 19 bp, synthetic construct
  misc_feature 1..19: note = Description of Artificial Sequence: Syntheticoligonucleotide
  source 1..19: mol_type = other DNA
ggactccatggagtcccgt

SEQ ID NO: 13511 - DNA, 19 bp, synthetic construct
  misc_feature 1..19: note = Description of Artificial Sequence: Syntheticoligonucleotide
  source 1..19: mol_type = other DNA
ggactccatggagtccctg

SEQ ID NO: 13512 - DNA, 19 bp, synthetic construct
  misc_feature 1..19: note = Description of Artificial Sequence: Syntheticoligonucleotide
  source 1..19: mol_type = other DNA
ggactccatggagtcctgg

SEQ ID NO: 13513 - DNA, 19 bp, synthetic construct
  misc_feature 1..19: note = Description of Artificial Sequence: Syntheticoligonucleotide
  source 1..19: mol_type = other DNA
agactccatggagtctcgg

SEQ ID NO: 13514 - DNA, 19 bp, synthetic construct
  misc_feature 1..19: note = Description of Artificial Sequence: Syntheticoligonucleotide
  source 1..19: mol_type = other DNA
ggactccatggagtcccga

SEQ ID NO: 13515 - DNA, 19 bp, synthetic construct
  misc_feature 1..19: note = Description of Artificial Sequence: Syntheticoligonucleotide
  source 1..19: mol_type = other DNA
ggactccatggagtcccag

SEQ ID NO: 13516 - DNA, 19 bp, synthetic construct
  misc_feature 1..19: note = Description of Artificial Sequence: Syntheticoligonucleotide
  source 1..19: mol_type = other DNA
ggactccatggagtccagg

SEQ ID NO: 13517 - DNA, 19 bp, synthetic construct
  misc_feature 1..19: note = Description of Artificial Sequence: Syntheticoligonucleotide
  source 1..19: mol_type = other DNA
tgactccatggagtcacgg

SEQ ID NO: 13518 - DNA, 19 bp, synthetic construct
  misc_feature 1..19: note = Description of Artificial Sequence: Syntheticoligonucleotide
  source 1..19: mol_type = other DNA
cgactccatggagtcgccg

SEQ ID NO: 13519 - DNA, 19 bp, synthetic construct
  misc_feature 1..19: note = Description of Artificial Sequence: Syntheticoligonucleotide
  source 1..19: mol_type = other DNA
cgactccatggagtcgctg

SEQ ID NO: 13520 - DNA, 19 bp, synthetic construct
  misc_feature 1..19: note = Description of Artificial Sequence: Syntheticoligonucleotide
  source 1..19: mol_type = other DNA
cgactccatggagtcgtcg

SEQ ID NO: 13521 - DNA, 19 bp, synthetic construct
  misc_feature 1..19: note = Description of Artificial Sequence: Syntheticoligonucleotide
  source 1..19: mol_type = other DNA
agactccatggagtctccg

SEQ ID NO: 13522 - DNA, 19 bp, synthetic construct
  misc_feature 1..19: note = Description of Artificial Sequence: Syntheticoligonucleotide
  source 1..19: mol_type = other DNA
cgactccatggagtcgcag

SEQ ID NO: 13523 - DNA, 19 bp, synthetic construct
  misc_feature 1..19: note = Description of Artificial Sequence: Syntheticoligonucleotide
  source 1..19: mol_type = other DNA
tgactccatggagtcaccg

SEQ ID NO: 13524 - DNA, 19 bp, synthetic construct
  misc_feature 1..19: note = Description of Artificial Sequence: Syntheticoligonucleotide
  source 1..19: mol_type = other DNA
ggactccatggagtccgtg

SEQ ID NO: 13525 - DNA, 19 bp, synthetic construct
  misc_feature 1..19: note = Description of Artificial Sequence: Syntheticoligonucleotide
  source 1..19: mol_type = other DNA
agactccatggagtctggg

SEQ ID NO: 13526 - DNA, 19 bp, synthetic construct
  misc_feature 1..19: note = Description of Artificial Sequence: Syntheticoligonucleotide
  source 1..19: mol_type = other DNA
ggactccatggagtccgag

SEQ ID NO: 13527 - DNA, 19 bp, synthetic construct
  misc_feature 1..19: note = Description of Artificial Sequence: Syntheticoligonucleotide
  source 1..19: mol_type = other DNA
tgactccatggagtcaggg

SEQ ID NO: 13528 - DNA, 19 bp, synthetic construct
  misc_feature 1..19: note = Description of Artificial Sequence: Syntheticoligonucleotide
  source 1..19: mol_type = other DNA
cgactccatggagtcgtgg

SEQ ID NO: 13529 - DNA, 19 bp, synthetic construct
  misc_feature 1..19: note = Description of Artificial Sequence: Syntheticoligonucleotide
  source 1..19: mol_type = other DNA
cgactccatggagtcggct

SEQ ID NO: 13530 - DNA, 19 bp, synthetic construct
  misc_feature 1..19: note = Description of Artificial Sequence: Syntheticoligonucleotide
  source 1..19: mol_type = other DNA
cgactccatggagtcggca

SEQ ID NO: 13531 - DNA, 19 bp, synthetic construct
  misc_feature 1..19: note = Description of Artificial Sequence: Syntheticoligonucleotide
  source 1..19: mol_type = other DNA
agactccatggagtctcgc

SEQ ID NO: 13532 - DNA, 19 bp, synthetic construct
  misc_feature 1..19: note = Description of Artificial Sequence: Syntheticoligonucleotide
  source 1..19: mol_type = other DNA
tgactccatggagtcacgc

SEQ ID NO: 13533 - DNA, 19 bp, synthetic construct
  misc_feature 1..19: note = Description of Artificial Sequence: Syntheticoligonucleotide
  source 1..19: mol_type = other DNA
ggactccatggagtcctgc

SEQ ID NO: 13534 - DNA, 19 bp, synthetic construct
  misc_feature 1..19: note = Description of Artificial Sequence: Syntheticoligonucleotide
  source 1..19: mol_type = other DNA
ggactccatggagtccagc

SEQ ID NO: 13535 - DNA, 19 bp, synthetic construct
  misc_feature 1..19: note = Description of Artificial Sequence: Syntheticoligonucleotide
  source 1..19: mol_type = other DNA
ggactccatggagtcctcg

SEQ ID NO: 13536 - DNA, 19 bp, synthetic construct
  misc_feature 1..19: note = Description of Artificial Sequence: Syntheticoligonucleotide
  source 1..19: mol_type = other DNA
ggactccatggagtccacg

SEQ ID NO: 13537 - DNA, 19 bp, synthetic construct
  misc_feature 1..19: note = Description of Artificial Sequence: Syntheticoligonucleotide
  source 1..19: mol_type = other DNA
cgactccatggagtcggtg

SEQ ID NO: 13538 - DNA, 19 bp, synthetic construct
  misc_feature 1..19: note = Description of Artificial Sequence: Syntheticoligonucleotide
  source 1..19: mol_type = other DNA
cgactccatggagtcggag

SEQ ID NO: 13539 - DNA, 19 bp, synthetic construct
  misc_feature 1..19: note = Description of Artificial Sequence: Syntheticoligonucleotide
  source 1..19: mol_type = other DNA
ggactccatggagtcccgc

SEQ ID NO: 13540 - DNA, 19 bp, synthetic construct
  misc_feature 1..19: note = Description of Artificial Sequence: Syntheticoligonucleotide
  source 1..19: mol_type = other DNA
ggactccatggagtccctc

SEQ ID NO: 13541 - DNA, 19 bp, synthetic construct
  misc_feature 1..19: note = Description of Artificial Sequence: Syntheticoligonucleotide
  source 1..19: mol_type = other DNA
ggactccatggagtcccac

SEQ ID NO: 13542 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactctcgagagtcnnnn

SEQ ID NO: 13543 - DNA, 19 bp, synthetic construct
  misc_feature 1..19: note = Description of Artificial Sequence: Syntheticoligonucleotide
  source 1..19: mol_type = other DNA
ggactctcgagagtccgcc

SEQ ID NO: 13544 - DNA, 19 bp, synthetic construct
  misc_feature 1..19: note = Description of Artificial Sequence: Syntheticoligonucleotide
  source 1..19: mol_type = other DNA
ggactctcgagagtccgct

SEQ ID NO: 13545 - DNA, 19 bp, synthetic construct
  misc_feature 1..19: note = Description of Artificial Sequence: Syntheticoligonucleotide
  source 1..19: mol_type = other DNA
ggactctcgagagtccgtc

SEQ ID NO: 13546 - DNA, 19 bp, synthetic construct
  misc_feature 1..19: note = Description of Artificial Sequence: Syntheticoligonucleotide
  source 1..19: mol_type = other DNA
ggactctcgagagtcctcc

SEQ ID NO: 13547 - DNA, 19 bp, synthetic construct
  misc_feature 1..19: note = Description of Artificial Sequence: Syntheticoligonucleotide
  source 1..19: mol_type = other DNA
agactctcgagagtctgcc

SEQ ID NO: 13548 - DNA, 19 bp, synthetic construct
  misc_feature 1..19: note = Description of Artificial Sequence: Syntheticoligonucleotide
  source 1..19: mol_type = other DNA
ggactctcgagagtccgca

SEQ ID NO: 13549 - DNA, 19 bp, synthetic construct
  misc_feature 1..19: note = Description of Artificial Sequence: Syntheticoligonucleotide
  source 1..19: mol_type = other DNA
ggactctcgagagtccgac

SEQ ID NO: 13550 - DNA, 19 bp, synthetic construct
  misc_feature 1..19: note = Description of Artificial Sequence: Syntheticoligonucleotide
  source 1..19: mol_type = other DNA
ggactctcgagagtccacc

SEQ ID NO: 13551 - DNA, 19 bp, synthetic construct
  misc_feature 1..19: note = Description of Artificial Sequence: Syntheticoligonucleotide
  source 1..19: mol_type = other DNA
tgactctcgagagtcagcc

SEQ ID NO: 13552 - DNA, 19 bp, synthetic construct
  misc_feature 1..19: note = Description of Artificial Sequence: Syntheticoligonucleotide
  source 1..19: mol_type = other DNA
cgactctcgagagtcgggc

SEQ ID NO: 13553 - DNA, 19 bp, synthetic construct
  misc_feature 1..19: note = Description of Artificial Sequence: Syntheticoligonucleotide
  source 1..19: mol_type = other DNA
cgactctcgagagtcgggt

SEQ ID NO: 13554 - DNA, 19 bp, synthetic construct
  misc_feature 1..19: note = Description of Artificial Sequence: Syntheticoligonucleotide
  source 1..19: mol_type = other DNA
cgactctcgagagtcggtc

SEQ ID NO: 13555 - DNA, 19 bp, synthetic construct
  misc_feature 1..19: note = Description of Artificial Sequence: Syntheticoligonucleotide
  source 1..19: mol_type = other DNA
cgactctcgagagtcgtgc

SEQ ID NO: 13556 - DNA, 19 bp, synthetic construct
  misc_feature 1..19: note = Description of Artificial Sequence: Syntheticoligonucleotide
  source 1..19: mol_type = other DNA
agactctcgagagtctggc

SEQ ID NO: 13557 - DNA, 19 bp, synthetic construct
  misc_feature 1..19: note = Description of Artificial Sequence: Syntheticoligonucleotide
  source 1..19: mol_type = other DNA
cgactctcgagagtcggga

SEQ ID NO: 13558 - DNA, 19 bp, synthetic construct
  misc_feature 1..19: note = Description of Artificial Sequence: Syntheticoligonucleotide
  source 1..19: mol_type = other DNA
cgactctcgagagtcggac

SEQ ID NO: 13559 - DNA, 19 bp, synthetic construct
  misc_feature 1..19: note = Description of Artificial Sequence: Syntheticoligonucleotide
  source 1..19: mol_type = other DNA
tgactctcgagagtcaggc

SEQ ID NO: 13560 - DNA, 19 bp, synthetic construct
  misc_feature 1..19: note = Description of Artificial Sequence: Syntheticoligonucleotide
  source 1..19: mol_type = other DNA
cgactctcgagagtcgccc

SEQ ID NO: 13561 - DNA, 19 bp, synthetic construct
  misc_feature 1..19: note = Description of Artificial Sequence: Syntheticoligonucleotide
  source 1..19: mol_type = other DNA
cgactctcgagagtcgcct

SEQ ID NO: 13562 - DNA, 19 bp, synthetic construct
  misc_feature 1..19: note = Description of Artificial Sequence: Syntheticoligonucleotide
  source 1..19: mol_type = other DNA
cgactctcgagagtcgctc

SEQ ID NO: 13563 - DNA, 19 bp, synthetic construct
  misc_feature 1..19: note = Description of Artificial Sequence: Syntheticoligonucleotide
  source 1..19: mol_type = other DNA
cgactctcgagagtcgtcc

SEQ ID NO: 13564 - DNA, 19 bp, synthetic construct
  misc_feature 1..19: note = Description of Artificial Sequence: Syntheticoligonucleotide
  source 1..19: mol_type = other DNA
agactctcgagagtctccc

SEQ ID NO: 13565 - DNA, 19 bp, synthetic construct
  misc_feature 1..19: note = Description of Artificial Sequence: Syntheticoligonucleotide
  source 1..19: mol_type = other DNA
cgactctcgagagtcgcca

SEQ ID NO: 13566 - DNA, 19 bp, synthetic construct
  misc_feature 1..19: note = Description of Artificial Sequence: Syntheticoligonucleotide
  source 1..19: mol_type = other DNA
cgactctcgagagtcgcac

SEQ ID NO: 13567 - DNA, 19 bp, synthetic construct
  misc_feature 1..19: note = Description of Artificial Sequence: Syntheticoligonucleotide
  source 1..19: mol_type = other DNA
tgactctcgagagtcaccc

SEQ ID NO: 13568 - DNA, 19 bp, synthetic construct
  misc_feature 1..19: note = Description of Artificial Sequence: Syntheticoligonucleotide
  source 1..19: mol_type = other DNA
ggactctcgagagtcccgt

SEQ ID NO: 13569 - DNA, 19 bp, synthetic construct
  misc_feature 1..19: note = Description of Artificial Sequence: Syntheticoligonucleotide
  source 1..19: mol_type = other DNA
ggactctcgagagtccctg

SEQ ID NO: 13570 - DNA, 19 bp, synthetic construct
  misc_feature 1..19: note = Description of Artificial Sequence: Syntheticoligonucleotide
  source 1..19: mol_type = other DNA
ggactctcgagagtcctgg

SEQ ID NO: 13571 - DNA, 19 bp, synthetic construct
  misc_feature 1..19: note = Description of Artificial Sequence: Syntheticoligonucleotide
  source 1..19: mol_type = other DNA
agactctcgagagtctcgg

SEQ ID NO: 13572 - DNA, 19 bp, synthetic construct
  misc_feature 1..19: note = Description of Artificial Sequence: Syntheticoligonucleotide
  source 1..19: mol_type = other DNA
ggactctcgagagtcccga

SEQ ID NO: 13573 - DNA, 19 bp, synthetic construct
  misc_feature 1..19: note = Description of Artificial Sequence: Syntheticoligonucleotide
  source 1..19: mol_type = other DNA
ggactctcgagagtcccag

SEQ ID NO: 13574 - DNA, 19 bp, synthetic construct
  misc_feature 1..19: note = Description of Artificial Sequence: Syntheticoligonucleotide
  source 1..19: mol_type = other DNA
ggactctcgagagtccagg

SEQ ID NO: 13575 - DNA, 19 bp, synthetic construct
  misc_feature 1..19: note = Description of Artificial Sequence: Syntheticoligonucleotide
  source 1..19: mol_type = other DNA
tgactctcgagagtcacgg

SEQ ID NO: 13576 - DNA, 19 bp, synthetic construct
  misc_feature 1..19: note = Description of Artificial Sequence: Syntheticoligonucleotide
  source 1..19: mol_type = other DNA
cgactctcgagagtcgccg

SEQ ID NO: 13577 - DNA, 19 bp, synthetic construct
  misc_feature 1..19: note = Description of Artificial Sequence: Syntheticoligonucleotide
  source 1..19: mol_type = other DNA
cgactctcgagagtcgctg

SEQ ID NO: 13578 - DNA, 19 bp, synthetic construct
  misc_feature 1..19: note = Description of Artificial Sequence: Syntheticoligonucleotide
  source 1..19: mol_type = other DNA
cgactctcgagagtcgtcg

SEQ ID NO: 13579 - DNA, 19 bp, synthetic construct
  misc_feature 1..19: note = Description of Artificial Sequence: Syntheticoligonucleotide
  source 1..19: mol_type = other DNA
agactctcgagagtctccg

SEQ ID NO: 13580 - DNA, 19 bp, synthetic construct
  misc_feature 1..19: note = Description of Artificial Sequence: Syntheticoligonucleotide
  source 1..19: mol_type = other DNA
cgactctcgagagtcgcag

SEQ ID NO: 13581 - DNA, 19 bp, synthetic construct
  misc_feature 1..19: note = Description of Artificial Sequence: Syntheticoligonucleotide
  source 1..19: mol_type = other DNA
tgactctcgagagtcaccg

SEQ ID NO: 13582 - DNA, 19 bp, synthetic construct
  misc_feature 1..19: note = Description of Artificial Sequence: Syntheticoligonucleotide
  source 1..19: mol_type = other DNA
ggactctcgagagtccgtg

SEQ ID NO: 13583 - DNA, 19 bp, synthetic construct
  misc_feature 1..19: note = Description of Artificial Sequence: Syntheticoligonucleotide
  source 1..19: mol_type = other DNA
agactctcgagagtctggg

SEQ ID NO: 13584 - DNA, 19 bp, synthetic construct
  misc_feature 1..19: note = Description of Artificial Sequence: Syntheticoligonucleotide
  source 1..19: mol_type = other DNA
ggactctcgagagtccgag

SEQ ID NO: 13585 - DNA, 19 bp, synthetic construct
  misc_feature 1..19: note = Description of Artificial Sequence: Syntheticoligonucleotide
  source 1..19: mol_type = other DNA
tgactctcgagagtcaggg

SEQ ID NO: 13586 - DNA, 19 bp, synthetic construct
  misc_feature 1..19: note = Description of Artificial Sequence: Syntheticoligonucleotide
  source 1..19: mol_type = other DNA
cgactctcgagagtcgtgg

SEQ ID NO: 13587 - DNA, 19 bp, synthetic construct
  misc_feature 1..19: note = Description of Artificial Sequence: Syntheticoligonucleotide
  source 1..19: mol_type = other DNA
cgactctcgagagtcggct

SEQ ID NO: 13588 - DNA, 19 bp, synthetic construct
  misc_feature 1..19: note = Description of Artificial Sequence: Syntheticoligonucleotide
  source 1..19: mol_type = other DNA
cgactctcgagagtcggca

SEQ ID NO: 13589 - DNA, 19 bp, synthetic construct
  misc_feature 1..19: note = Description of Artificial Sequence: Syntheticoligonucleotide
  source 1..19: mol_type = other DNA
agactctcgagagtctcgc

SEQ ID NO: 13590 - DNA, 19 bp, synthetic construct
  misc_feature 1..19: note = Description of Artificial Sequence: Syntheticoligonucleotide
  source 1..19: mol_type = other DNA
tgactctcgagagtcacgc

SEQ ID NO: 13591 - DNA, 19 bp, synthetic construct
  misc_feature 1..19: note = Description of Artificial Sequence: Syntheticoligonucleotide
  source 1..19: mol_type = other DNA
ggactctcgagagtcctgc

SEQ ID NO: 13592 - DNA, 19 bp, synthetic construct
  misc_feature 1..19: note = Description of Artificial Sequence: Syntheticoligonucleotide
  source 1..19: mol_type = other DNA
ggactctcgagagtccagc

SEQ ID NO: 13593 - DNA, 19 bp, synthetic construct
  misc_feature 1..19: note = Description of Artificial Sequence: Syntheticoligonucleotide
  source 1..19: mol_type = other DNA
ggactctcgagagtcctcg

SEQ ID NO: 13594 - DNA, 19 bp, synthetic construct
  misc_feature 1..19: note = Description of Artificial Sequence: Syntheticoligonucleotide
  source 1..19: mol_type = other DNA
ggactctcgagagtccacg

SEQ ID NO: 13595 - DNA, 19 bp, synthetic construct
  misc_feature 1..19: note = Description of Artificial Sequence: Syntheticoligonucleotide
  source 1..19: mol_type = other DNA
cgactctcgagagtcggtg

SEQ ID NO: 13596 - DNA, 19 bp, synthetic construct
  misc_feature 1..19: note = Description of Artificial Sequence: Syntheticoligonucleotide
  source 1..19: mol_type = other DNA
cgactctcgagagtcggag

SEQ ID NO: 13597 - DNA, 19 bp, synthetic construct
  misc_feature 1..19: note = Description of Artificial Sequence: Syntheticoligonucleotide
  source 1..19: mol_type = other DNA
ggactctcgagagtcccgc

SEQ ID NO: 13598 - DNA, 19 bp, synthetic construct
  misc_feature 1..19: note = Description of Artificial Sequence: Syntheticoligonucleotide
  source 1..19: mol_type = other DNA
ggactctcgagagtccctc

SEQ ID NO: 13599 - DNA, 19 bp, synthetic construct
  misc_feature 1..19: note = Description of Artificial Sequence: Syntheticoligonucleotide
  source 1..19: mol_type = other DNA
ggactctcgagagtcccac

SEQ ID NO: 13600 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactcagctgagtcnnnn

SEQ ID NO: 13601 - DNA, 19 bp, synthetic construct
  misc_feature 1..19: note = Description of Artificial Sequence: Syntheticoligonucleotide
  source 1..19: mol_type = other DNA
ggactcagctgagtccgcc

SEQ ID NO: 13602 - DNA, 19 bp, synthetic construct
  misc_feature 1..19: note = Description of Artificial Sequence: Syntheticoligonucleotide
  source 1..19: mol_type = other DNA
ggactcagctgagtccgct

SEQ ID NO: 13603 - DNA, 19 bp, synthetic construct
  misc_feature 1..19: note = Description of Artificial Sequence: Syntheticoligonucleotide
  source 1..19: mol_type = other DNA
ggactcagctgagtccgtc

SEQ ID NO: 13604 - DNA, 19 bp, synthetic construct
  misc_feature 1..19: note = Description of Artificial Sequence: Syntheticoligonucleotide
  source 1..19: mol_type = other DNA
ggactcagctgagtcctcc

SEQ ID NO: 13605 - DNA, 19 bp, synthetic construct
  misc_feature 1..19: note = Description of Artificial Sequence: Syntheticoligonucleotide
  source 1..19: mol_type = other DNA
agactcagctgagtctgcc

SEQ ID NO: 13606 - DNA, 19 bp, synthetic construct
  misc_feature 1..19: note = Description of Artificial Sequence: Syntheticoligonucleotide
  source 1..19: mol_type = other DNA
ggactcagctgagtccgca

SEQ ID NO: 13607 - DNA, 19 bp, synthetic construct
  misc_feature 1..19: note = Description of Artificial Sequence: Syntheticoligonucleotide
  source 1..19: mol_type = other DNA
ggactcagctgagtccgac

SEQ ID NO: 13608 - DNA, 19 bp, synthetic construct
  misc_feature 1..19: note = Description of Artificial Sequence: Syntheticoligonucleotide
  source 1..19: mol_type = other DNA
ggactcagctgagtccacc

SEQ ID NO: 13609 - DNA, 19 bp, synthetic construct
  misc_feature 1..19: note = Description of Artificial Sequence: Syntheticoligonucleotide
  source 1..19: mol_type = other DNA
tgactcagctgagtcagcc

SEQ ID NO: 13610 - DNA, 19 bp, synthetic construct
  misc_feature 1..19: note = Description of Artificial Sequence: Syntheticoligonucleotide
  source 1..19: mol_type = other DNA
cgactcagctgagtcgggc

SEQ ID NO: 13611 - DNA, 19 bp, synthetic construct
  misc_feature 1..19: note = Description of Artificial Sequence: Syntheticoligonucleotide
  source 1..19: mol_type = other DNA
cgactcagctgagtcgggt

SEQ ID NO: 13612 - DNA, 19 bp, synthetic construct
  misc_feature 1..19: note = Description of Artificial Sequence: Syntheticoligonucleotide
  source 1..19: mol_type = other DNA
cgactcagctgagtcggtc

SEQ ID NO: 13613 - DNA, 19 bp, synthetic construct
  misc_feature 1..19: note = Description of Artificial Sequence: Syntheticoligonucleotide
  source 1..19: mol_type = other DNA
cgactcagctgagtcgtgc

SEQ ID NO: 13614 - DNA, 19 bp, synthetic construct
  misc_feature 1..19: note = Description of Artificial Sequence: Syntheticoligonucleotide
  source 1..19: mol_type = other DNA
agactcagctgagtctggc

SEQ ID NO: 13615 - DNA, 19 bp, synthetic construct
  misc_feature 1..19: note = Description of Artificial Sequence: Syntheticoligonucleotide
  source 1..19: mol_type = other DNA
cgactcagctgagtcggga

SEQ ID NO: 13616 - DNA, 19 bp, synthetic construct
  misc_feature 1..19: note = Description of Artificial Sequence: Syntheticoligonucleotide
  source 1..19: mol_type = other DNA
cgactcagctgagtcggac

SEQ ID NO: 13617 - DNA, 19 bp, synthetic construct
  misc_feature 1..19: note = Description of Artificial Sequence: Syntheticoligonucleotide
  source 1..19: mol_type = other DNA
tgactcagctgagtcaggc

SEQ ID NO: 13618 - DNA, 19 bp, synthetic construct
  misc_feature 1..19: note = Description of Artificial Sequence: Syntheticoligonucleotide
  source 1..19: mol_type = other DNA
cgactcagctgagtcgccc

SEQ ID NO: 13619 - DNA, 19 bp, synthetic construct
  misc_feature 1..19: note = Description of Artificial Sequence: Syntheticoligonucleotide
  source 1..19: mol_type = other DNA
cgactcagctgagtcgcct

SEQ ID NO: 13620 - DNA, 19 bp, synthetic construct
  misc_feature 1..19: note = Description of Artificial Sequence: Syntheticoligonucleotide
  source 1..19: mol_type = other DNA
cgactcagctgagtcgctc

SEQ ID NO: 13621 - DNA, 19 bp, synthetic construct
  misc_feature 1..19: note = Description of Artificial Sequence: Syntheticoligonucleotide
  source 1..19: mol_type = other DNA
cgactcagctgagtcgtcc

SEQ ID NO: 13622 - DNA, 19 bp, synthetic construct
  misc_feature 1..19: note = Description of Artificial Sequence: Syntheticoligonucleotide
  source 1..19: mol_type = other DNA
agactcagctgagtctccc

SEQ ID NO: 13623 - DNA, 19 bp, synthetic construct
  misc_feature 1..19: note = Description of Artificial Sequence: Syntheticoligonucleotide
  source 1..19: mol_type = other DNA
cgactcagctgagtcgcca

SEQ ID NO: 13624 - DNA, 19 bp, synthetic construct
  misc_feature 1..19: note = Description of Artificial Sequence: Syntheticoligonucleotide
  source 1..19: mol_type = other DNA
cgactcagctgagtcgcac

SEQ ID NO: 13625 - DNA, 19 bp, synthetic construct
  misc_feature 1..19: note = Description of Artificial Sequence: Syntheticoligonucleotide
  source 1..19: mol_type = other DNA
tgactcagctgagtcaccc

SEQ ID NO: 13626 - DNA, 19 bp, synthetic construct
  misc_feature 1..19: note = Description of Artificial Sequence: Syntheticoligonucleotide
  source 1..19: mol_type = other DNA
ggactcagctgagtcccgt

SEQ ID NO: 13627 - DNA, 19 bp, synthetic construct
  misc_feature 1..19: note = Description of Artificial Sequence: Syntheticoligonucleotide
  source 1..19: mol_type = other DNA
ggactcagctgagtccctg

SEQ ID NO: 13628 - DNA, 19 bp, synthetic construct
  misc_feature 1..19: note = Description of Artificial Sequence: Syntheticoligonucleotide
  source 1..19: mol_type = other DNA
ggactcagctgagtcctgg

SEQ ID NO: 13629 - DNA, 19 bp, synthetic construct
  misc_feature 1..19: note = Description of Artificial Sequence: Syntheticoligonucleotide
  source 1..19: mol_type = other DNA
agactcagctgagtctcgg

SEQ ID NO: 13630 - DNA, 19 bp, synthetic construct
  misc_feature 1..19: note = Description of Artificial Sequence: Syntheticoligonucleotide
  source 1..19: mol_type = other DNA
ggactcagctgagtcccga

SEQ ID NO: 13631 - DNA, 19 bp, synthetic construct
  misc_feature 1..19: note = Description of Artificial Sequence: Syntheticoligonucleotide
  source 1..19: mol_type = other DNA
ggactcagctgagtcccag

SEQ ID NO: 13632 - DNA, 19 bp, synthetic construct
  misc_feature 1..19: note = Description of Artificial Sequence: Syntheticoligonucleotide
  source 1..19: mol_type = other DNA
ggactcagctgagtccagg

SEQ ID NO: 13633 - DNA, 19 bp, synthetic construct
  misc_feature 1..19: note = Description of Artificial Sequence: Syntheticoligonucleotide
  source 1..19: mol_type = other DNA
tgactcagctgagtcacgg

SEQ ID NO: 13634 - DNA, 19 bp, synthetic construct
  misc_feature 1..19: note = Description of Artificial Sequence: Syntheticoligonucleotide
  source 1..19: mol_type = other DNA
cgactcagctgagtcgccg

SEQ ID NO: 13635 - DNA, 19 bp, synthetic construct
  misc_feature 1..19: note = Description of Artificial Sequence: Syntheticoligonucleotide
  source 1..19: mol_type = other DNA
cgactcagctgagtcgctg

SEQ ID NO: 13636 - DNA, 19 bp, synthetic construct
  misc_feature 1..19: note = Description of Artificial Sequence: Syntheticoligonucleotide
  source 1..19: mol_type = other DNA
cgactcagctgagtcgtcg

SEQ ID NO: 13637 - DNA, 19 bp, synthetic construct
  misc_feature 1..19: note = Description of Artificial Sequence: Syntheticoligonucleotide
  source 1..19: mol_type = other DNA
agactcagctgagtctccg

SEQ ID NO: 13638 - DNA, 19 bp, synthetic construct
  misc_feature 1..19: note = Description of Artificial Sequence: Syntheticoligonucleotide
  source 1..19: mol_type = other DNA
cgactcagctgagtcgcag

SEQ ID NO: 13639 - DNA, 19 bp, synthetic construct
  misc_feature 1..19: note = Description of Artificial Sequence: Syntheticoligonucleotide
  source 1..19: mol_type = other DNA
tgactcagctgagtcaccg

SEQ ID NO: 13640 - DNA, 19 bp, synthetic construct
  misc_feature 1..19: note = Description of Artificial Sequence: Syntheticoligonucleotide
  source 1..19: mol_type = other DNA
ggactcagctgagtccgtg

SEQ ID NO: 13641 - DNA, 19 bp, synthetic construct
  misc_feature 1..19: note = Description of Artificial Sequence: Syntheticoligonucleotide
  source 1..19: mol_type = other DNA
agactcagctgagtctggg

SEQ ID NO: 13642 - DNA, 19 bp, synthetic construct
  misc_feature 1..19: note = Description of Artificial Sequence: Syntheticoligonucleotide
  source 1..19: mol_type = other DNA
ggactcagctgagtccgag

SEQ ID NO: 13643 - DNA, 19 bp, synthetic construct
  misc_feature 1..19: note = Description of Artificial Sequence: Syntheticoligonucleotide
  source 1..19: mol_type = other DNA
tgactcagctgagtcaggg

SEQ ID NO: 13644 - DNA, 19 bp, synthetic construct
  misc_feature 1..19: note = Description of Artificial Sequence: Syntheticoligonucleotide
  source 1..19: mol_type = other DNA
cgactcagctgagtcgtgg

SEQ ID NO: 13645 - DNA, 19 bp, synthetic construct
  misc_feature 1..19: note = Description of Artificial Sequence: Syntheticoligonucleotide
  source 1..19: mol_type = other DNA
cgactcagctgagtcggct

SEQ ID NO: 13646 - DNA, 19 bp, synthetic construct
  misc_feature 1..19: note = Description of Artificial Sequence: Syntheticoligonucleotide
  source 1..19: mol_type = other DNA
cgactcagctgagtcggca

SEQ ID NO: 13647 - DNA, 19 bp, synthetic construct
  misc_feature 1..19: note = Description of Artificial Sequence: Syntheticoligonucleotide
  source 1..19: mol_type = other DNA
agactcagctgagtctcgc

SEQ ID NO: 13648 - DNA, 19 bp, synthetic construct
  misc_feature 1..19: note = Description of Artificial Sequence: Syntheticoligonucleotide
  source 1..19: mol_type = other DNA
tgactcagctgagtcacgc

SEQ ID NO: 13649 - DNA, 19 bp, synthetic construct
  misc_feature 1..19: note = Description of Artificial Sequence: Syntheticoligonucleotide
  source 1..19: mol_type = other DNA
ggactcagctgagtcctgc

SEQ ID NO: 13650 - DNA, 19 bp, synthetic construct
  misc_feature 1..19: note = Description of Artificial Sequence: Syntheticoligonucleotide
  source 1..19: mol_type = other DNA
ggactcagctgagtccagc

SEQ ID NO: 13651 - DNA, 19 bp, synthetic construct
  misc_feature 1..19: note = Description of Artificial Sequence: Syntheticoligonucleotide
  source 1..19: mol_type = other DNA
ggactcagctgagtcctcg

SEQ ID NO: 13652 - DNA, 19 bp, synthetic construct
  misc_feature 1..19: note = Description of Artificial Sequence: Syntheticoligonucleotide
  source 1..19: mol_type = other DNA
ggactcagctgagtccacg

SEQ ID NO: 13653 - DNA, 19 bp, synthetic construct
  misc_feature 1..19: note = Description of Artificial Sequence: Syntheticoligonucleotide
  source 1..19: mol_type = other DNA
cgactcagctgagtcggtg

SEQ ID NO: 13654 - DNA, 19 bp, synthetic construct
  misc_feature 1..19: note = Description of Artificial Sequence: Syntheticoligonucleotide
  source 1..19: mol_type = other DNA
cgactcagctgagtcggag

SEQ ID NO: 13655 - DNA, 19 bp, synthetic construct
  misc_feature 1..19: note = Description of Artificial Sequence: Syntheticoligonucleotide
  source 1..19: mol_type = other DNA
ggactcagctgagtcccgc

SEQ ID NO: 13656 - DNA, 19 bp, synthetic construct
  misc_feature 1..19: note = Description of Artificial Sequence: Syntheticoligonucleotide
  source 1..19: mol_type = other DNA
ggactcagctgagtccctc

SEQ ID NO: 13657 - DNA, 19 bp, synthetic construct
  misc_feature 1..19: note = Description of Artificial Sequence: Syntheticoligonucleotide
  source 1..19: mol_type = other DNA
ggactcagctgagtcccac

SEQ ID NO: 13658 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactcaattgagtcnnnn

SEQ ID NO: 13659 - DNA, 19 bp, synthetic construct
  misc_feature 1..19: note = Description of Artificial Sequence: Syntheticoligonucleotide
  source 1..19: mol_type = other DNA
ggactcaattgagtccgcc

SEQ ID NO: 13660 - DNA, 19 bp, synthetic construct
  misc_feature 1..19: note = Description of Artificial Sequence: Syntheticoligonucleotide
  source 1..19: mol_type = other DNA
ggactcaattgagtccgct

SEQ ID NO: 13661 - DNA, 19 bp, synthetic construct
  misc_feature 1..19: note = Description of Artificial Sequence: Syntheticoligonucleotide
  source 1..19: mol_type = other DNA
ggactcaattgagtccgtc

SEQ ID NO: 13662 - DNA, 19 bp, synthetic construct
  misc_feature 1..19: note = Description of Artificial Sequence: Syntheticoligonucleotide
  source 1..19: mol_type = other DNA
ggactcaattgagtcctcc

SEQ ID NO: 13663 - DNA, 19 bp, synthetic construct
  misc_feature 1..19: note = Description of Artificial Sequence: Syntheticoligonucleotide
  source 1..19: mol_type = other DNA
agactcaattgagtctgcc

SEQ ID NO: 13664 - DNA, 19 bp, synthetic construct
  misc_feature 1..19: note = Description of Artificial Sequence: Syntheticoligonucleotide
  source 1..19: mol_type = other DNA
ggactcaattgagtccgca

SEQ ID NO: 13665 - DNA, 19 bp, synthetic construct
  misc_feature 1..19: note = Description of Artificial Sequence: Syntheticoligonucleotide
  source 1..19: mol_type = other DNA
ggactcaattgagtccgac

SEQ ID NO: 13666 - DNA, 19 bp, synthetic construct
  misc_feature 1..19: note = Description of Artificial Sequence: Syntheticoligonucleotide
  source 1..19: mol_type = other DNA
ggactcaattgagtccacc

SEQ ID NO: 13667 - DNA, 19 bp, synthetic construct
  misc_feature 1..19: note = Description of Artificial Sequence: Syntheticoligonucleotide
  source 1..19: mol_type = other DNA
tgactcaattgagtcagcc

SEQ ID NO: 13668 - DNA, 19 bp, synthetic construct
  misc_feature 1..19: note = Description of Artificial Sequence: Syntheticoligonucleotide
  source 1..19: mol_type = other DNA
cgactcaattgagtcgggc

SEQ ID NO: 13669 - DNA, 19 bp, synthetic construct
  misc_feature 1..19: note = Description of Artificial Sequence: Syntheticoligonucleotide
  source 1..19: mol_type = other DNA
cgactcaattgagtcgggt

SEQ ID NO: 13670 - DNA, 19 bp, synthetic construct
  misc_feature 1..19: note = Description of Artificial Sequence: Syntheticoligonucleotide
  source 1..19: mol_type = other DNA
cgactcaattgagtcggtc

SEQ ID NO: 13671 - DNA, 19 bp, synthetic construct
  misc_feature 1..19: note = Description of Artificial Sequence: Syntheticoligonucleotide
  source 1..19: mol_type = other DNA
cgactcaattgagtcgtgc

SEQ ID NO: 13672 - DNA, 19 bp, synthetic construct
  misc_feature 1..19: note = Description of Artificial Sequence: Syntheticoligonucleotide
  source 1..19: mol_type = other DNA
agactcaattgagtctggc

SEQ ID NO: 13673 - DNA, 19 bp, synthetic construct
  misc_feature 1..19: note = Description of Artificial Sequence: Syntheticoligonucleotide
  source 1..19: mol_type = other DNA
cgactcaattgagtcggga

SEQ ID NO: 13674 - DNA, 19 bp, synthetic construct
  misc_feature 1..19: note = Description of Artificial Sequence: Syntheticoligonucleotide
  source 1..19: mol_type = other DNA
cgactcaattgagtcggac

SEQ ID NO: 13675 - DNA, 19 bp, synthetic construct
  misc_feature 1..19: note = Description of Artificial Sequence: Syntheticoligonucleotide
  source 1..19: mol_type = other DNA
tgactcaattgagtcaggc

SEQ ID NO: 13676 - DNA, 19 bp, synthetic construct
  misc_feature 1..19: note = Description of Artificial Sequence: Syntheticoligonucleotide
  source 1..19: mol_type = other DNA
cgactcaattgagtcgccc

SEQ ID NO: 13677 - DNA, 19 bp, synthetic construct
  misc_feature 1..19: note = Description of Artificial Sequence: Syntheticoligonucleotide
  source 1..19: mol_type = other DNA
cgactcaattgagtcgcct

SEQ ID NO: 13678 - DNA, 19 bp, synthetic construct
  misc_feature 1..19: note = Description of Artificial Sequence: Syntheticoligonucleotide
  source 1..19: mol_type = other DNA
cgactcaattgagtcgctc

SEQ ID NO: 13679 - DNA, 19 bp, synthetic construct
  misc_feature 1..19: note = Description of Artificial Sequence: Syntheticoligonucleotide
  source 1..19: mol_type = other DNA
cgactcaattgagtcgtcc

SEQ ID NO: 13680 - DNA, 19 bp, synthetic construct
  misc_feature 1..19: note = Description of Artificial Sequence: Syntheticoligonucleotide
  source 1..19: mol_type = other DNA
agactcaattgagtctccc

SEQ ID NO: 13681 - DNA, 19 bp, synthetic construct
  misc_feature 1..19: note = Description of Artificial Sequence: Syntheticoligonucleotide
  source 1..19: mol_type = other DNA
cgactcaattgagtcgcca

SEQ ID NO: 13682 - DNA, 19 bp, synthetic construct
  misc_feature 1..19: note = Description of Artificial Sequence: Syntheticoligonucleotide
  source 1..19: mol_type = other DNA
cgactcaattgagtcgcac

SEQ ID NO: 13683 - DNA, 19 bp, synthetic construct
  misc_feature 1..19: note = Description of Artificial Sequence: Syntheticoligonucleotide
  source 1..19: mol_type = other DNA
tgactcaattgagtcaccc

SEQ ID NO: 13684 - DNA, 19 bp, synthetic construct
  misc_feature 1..19: note = Description of Artificial Sequence: Syntheticoligonucleotide
  source 1..19: mol_type = other DNA
ggactcaattgagtcccgt

SEQ ID NO: 13685 - DNA, 19 bp, synthetic construct
  misc_feature 1..19: note = Description of Artificial Sequence: Syntheticoligonucleotide
  source 1..19: mol_type = other DNA
ggactcaattgagtccctg

SEQ ID NO: 13686 - DNA, 19 bp, synthetic construct
  misc_feature 1..19: note = Description of Artificial Sequence: Syntheticoligonucleotide
  source 1..19: mol_type = other DNA
ggactcaattgagtcctgg

SEQ ID NO: 13687 - DNA, 19 bp, synthetic construct
  misc_feature 1..19: note = Description of Artificial Sequence: Syntheticoligonucleotide
  source 1..19: mol_type = other DNA
agactcaattgagtctcgg

SEQ ID NO: 13688 - DNA, 19 bp, synthetic construct
  misc_feature 1..19: note = Description of Artificial Sequence: Syntheticoligonucleotide
  source 1..19: mol_type = other DNA
ggactcaattgagtcccga

SEQ ID NO: 13689 - DNA, 19 bp, synthetic construct
  misc_feature 1..19: note = Description of Artificial Sequence: Syntheticoligonucleotide
  source 1..19: mol_type = other DNA
ggactcaattgagtcccag

SEQ ID NO: 13690 - DNA, 19 bp, synthetic construct
  misc_feature 1..19: note = Description of Artificial Sequence: Syntheticoligonucleotide
  source 1..19: mol_type = other DNA
ggactcaattgagtccagg

SEQ ID NO: 13691 - DNA, 19 bp, synthetic construct
  misc_feature 1..19: note = Description of Artificial Sequence: Syntheticoligonucleotide
  source 1..19: mol_type = other DNA
tgactcaattgagtcacgg

SEQ ID NO: 13692 - DNA, 19 bp, synthetic construct
  misc_feature 1..19: note = Description of Artificial Sequence: Syntheticoligonucleotide
  source 1..19: mol_type = other DNA
cgactcaattgagtcgccg

SEQ ID NO: 13693 - DNA, 19 bp, synthetic construct
  misc_feature 1..19: note = Description of Artificial Sequence: Syntheticoligonucleotide
  source 1..19: mol_type = other DNA
cgactcaattgagtcgctg

SEQ ID NO: 13694 - DNA, 19 bp, synthetic construct
  misc_feature 1..19: note = Description of Artificial Sequence: Syntheticoligonucleotide
  source 1..19: mol_type = other DNA
cgactcaattgagtcgtcg

SEQ ID NO: 13695 - DNA, 19 bp, synthetic construct
  misc_feature 1..19: note = Description of Artificial Sequence: Syntheticoligonucleotide
  source 1..19: mol_type = other DNA
agactcaattgagtctccg

SEQ ID NO: 13696 - DNA, 19 bp, synthetic construct
  misc_feature 1..19: note = Description of Artificial Sequence: Syntheticoligonucleotide
  source 1..19: mol_type = other DNA
cgactcaattgagtcgcag

SEQ ID NO: 13697 - DNA, 19 bp, synthetic construct
  misc_feature 1..19: note = Description of Artificial Sequence: Syntheticoligonucleotide
  source 1..19: mol_type = other DNA
tgactcaattgagtcaccg

SEQ ID NO: 13698 - DNA, 19 bp, synthetic construct
  misc_feature 1..19: note = Description of Artificial Sequence: Syntheticoligonucleotide
  source 1..19: mol_type = other DNA
ggactcaattgagtccgtg

SEQ ID NO: 13699 - DNA, 19 bp, synthetic construct
  misc_feature 1..19: note = Description of Artificial Sequence: Syntheticoligonucleotide
  source 1..19: mol_type = other DNA
agactcaattgagtctggg

SEQ ID NO: 13700 - DNA, 19 bp, synthetic construct
  misc_feature 1..19: note = Description of Artificial Sequence: Syntheticoligonucleotide
  source 1..19: mol_type = other DNA
ggactcaattgagtccgag

SEQ ID NO: 13701 - DNA, 19 bp, synthetic construct
  misc_feature 1..19: note = Description of Artificial Sequence: Syntheticoligonucleotide
  source 1..19: mol_type = other DNA
tgactcaattgagtcaggg

SEQ ID NO: 13702 - DNA, 19 bp, synthetic construct
  misc_feature 1..19: note = Description of Artificial Sequence: Syntheticoligonucleotide
  source 1..19: mol_type = other DNA
cgactcaattgagtcgtgg

SEQ ID NO: 13703 - DNA, 19 bp, synthetic construct
  misc_feature 1..19: note = Description of Artificial Sequence: Syntheticoligonucleotide
  source 1..19: mol_type = other DNA
cgactcaattgagtcggct

SEQ ID NO: 13704 - DNA, 19 bp, synthetic construct
  misc_feature 1..19: note = Description of Artificial Sequence: Syntheticoligonucleotide
  source 1..19: mol_type = other DNA
cgactcaattgagtcggca

SEQ ID NO: 13705 - DNA, 19 bp, synthetic construct
  misc_feature 1..19: note = Description of Artificial Sequence: Syntheticoligonucleotide
  source 1..19: mol_type = other DNA
agactcaattgagtctcgc

SEQ ID NO: 13706 - DNA, 19 bp, synthetic construct
  misc_feature 1..19: note = Description of Artificial Sequence: Syntheticoligonucleotide
  source 1..19: mol_type = other DNA
tgactcaattgagtcacgc

SEQ ID NO: 13707 - DNA, 19 bp, synthetic construct
  misc_feature 1..19: note = Description of Artificial Sequence: Syntheticoligonucleotide
  source 1..19: mol_type = other DNA
ggactcaattgagtcctgc

SEQ ID NO: 13708 - DNA, 19 bp, synthetic construct
  misc_feature 1..19: note = Description of Artificial Sequence: Syntheticoligonucleotide
  source 1..19: mol_type = other DNA
ggactcaattgagtccagc

SEQ ID NO: 13709 - DNA, 19 bp, synthetic construct
  misc_feature 1..19: note = Description of Artificial Sequence: Syntheticoligonucleotide
  source 1..19: mol_type = other DNA
ggactcaattgagtcctcg

SEQ ID NO: 13710 - DNA, 19 bp, synthetic construct
  misc_feature 1..19: note = Description of Artificial Sequence: Syntheticoligonucleotide
  source 1..19: mol_type = other DNA
ggactcaattgagtccacg

SEQ ID NO: 13711 - DNA, 19 bp, synthetic construct
  misc_feature 1..19: note = Description of Artificial Sequence: Syntheticoligonucleotide
  source 1..19: mol_type = other DNA
cgactcaattgagtcggtg

SEQ ID NO: 13712 - DNA, 19 bp, synthetic construct
  misc_feature 1..19: note = Description of Artificial Sequence: Syntheticoligonucleotide
  source 1..19: mol_type = other DNA
cgactcaattgagtcggag

SEQ ID NO: 13713 - DNA, 19 bp, synthetic construct
  misc_feature 1..19: note = Description of Artificial Sequence: Syntheticoligonucleotide
  source 1..19: mol_type = other DNA
ggactcaattgagtcccgc

SEQ ID NO: 13714 - DNA, 19 bp, synthetic construct
  misc_feature 1..19: note = Description of Artificial Sequence: Syntheticoligonucleotide
  source 1..19: mol_type = other DNA
ggactcaattgagtccctc

SEQ ID NO: 13715 - DNA, 19 bp, synthetic construct
  misc_feature 1..19: note = Description of Artificial Sequence: Syntheticoligonucleotide
  source 1..19: mol_type = other DNA
ggactcaattgagtcccac

SEQ ID NO: 13716 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactctatagagtcnnnn

SEQ ID NO: 13717 - DNA, 19 bp, synthetic construct
  misc_feature 1..19: note = Description of Artificial Sequence: Syntheticoligonucleotide
  source 1..19: mol_type = other DNA
ggactctatagagtccgcc

SEQ ID NO: 13718 - DNA, 19 bp, synthetic construct
  misc_feature 1..19: note = Description of Artificial Sequence: Syntheticoligonucleotide
  source 1..19: mol_type = other DNA
ggactctatagagtccgct

SEQ ID NO: 13719 - DNA, 19 bp, synthetic construct
  misc_feature 1..19: note = Description of Artificial Sequence: Syntheticoligonucleotide
  source 1..19: mol_type = other DNA
ggactctatagagtccgtc

SEQ ID NO: 13720 - DNA, 19 bp, synthetic construct
  misc_feature 1..19: note = Description of Artificial Sequence: Syntheticoligonucleotide
  source 1..19: mol_type = other DNA
ggactctatagagtcctcc

SEQ ID NO: 13721 - DNA, 19 bp, synthetic construct
  misc_feature 1..19: note = Description of Artificial Sequence: Syntheticoligonucleotide
  source 1..19: mol_type = other DNA
agactctatagagtctgcc

SEQ ID NO: 13722 - DNA, 19 bp, synthetic construct
  misc_feature 1..19: note = Description of Artificial Sequence: Syntheticoligonucleotide
  source 1..19: mol_type = other DNA
ggactctatagagtccgca

SEQ ID NO: 13723 - DNA, 19 bp, synthetic construct
  misc_feature 1..19: note = Description of Artificial Sequence: Syntheticoligonucleotide
  source 1..19: mol_type = other DNA
ggactctatagagtccgac

SEQ ID NO: 13724 - DNA, 19 bp, synthetic construct
  misc_feature 1..19: note = Description of Artificial Sequence: Syntheticoligonucleotide
  source 1..19: mol_type = other DNA
ggactctatagagtccacc

SEQ ID NO: 13725 - DNA, 19 bp, synthetic construct
  misc_feature 1..19: note = Description of Artificial Sequence: Syntheticoligonucleotide
  source 1..19: mol_type = other DNA
tgactctatagagtcagcc

SEQ ID NO: 13726 - DNA, 19 bp, synthetic construct
  misc_feature 1..19: note = Description of Artificial Sequence: Syntheticoligonucleotide
  source 1..19: mol_type = other DNA
cgactctatagagtcgggc

SEQ ID NO: 13727 - DNA, 19 bp, synthetic construct
  misc_feature 1..19: note = Description of Artificial Sequence: Syntheticoligonucleotide
  source 1..19: mol_type = other DNA
cgactctatagagtcgggt

SEQ ID NO: 13728 - DNA, 19 bp, synthetic construct
  misc_feature 1..19: note = Description of Artificial Sequence: Syntheticoligonucleotide
  source 1..19: mol_type = other DNA
cgactctatagagtcggtc

SEQ ID NO: 13729 - DNA, 19 bp, synthetic construct
  misc_feature 1..19: note = Description of Artificial Sequence: Syntheticoligonucleotide
  source 1..19: mol_type = other DNA
cgactctatagagtcgtgc

SEQ ID NO: 13730 - DNA, 19 bp, synthetic construct
  misc_feature 1..19: note = Description of Artificial Sequence: Syntheticoligonucleotide
  source 1..19: mol_type = other DNA
agactctatagagtctggc

SEQ ID NO: 13731 - DNA, 19 bp, synthetic construct
  misc_feature 1..19: note = Description of Artificial Sequence: Syntheticoligonucleotide
  source 1..19: mol_type = other DNA
cgactctatagagtcggga

SEQ ID NO: 13732 - DNA, 19 bp, synthetic construct
  misc_feature 1..19: note = Description of Artificial Sequence: Syntheticoligonucleotide
  source 1..19: mol_type = other DNA
cgactctatagagtcggac

SEQ ID NO: 13733 - DNA, 19 bp, synthetic construct
  misc_feature 1..19: note = Description of Artificial Sequence: Syntheticoligonucleotide
  source 1..19: mol_type = other DNA
tgactctatagagtcaggc

SEQ ID NO: 13734 - DNA, 19 bp, synthetic construct
  misc_feature 1..19: note = Description of Artificial Sequence: Syntheticoligonucleotide
  source 1..19: mol_type = other DNA
cgactctatagagtcgccc

SEQ ID NO: 13735 - DNA, 19 bp, synthetic construct
  misc_feature 1..19: note = Description of Artificial Sequence: Syntheticoligonucleotide
  source 1..19: mol_type = other DNA
cgactctatagagtcgcct

SEQ ID NO: 13736 - DNA, 19 bp, synthetic construct
  misc_feature 1..19: note = Description of Artificial Sequence: Syntheticoligonucleotide
  source 1..19: mol_type = other DNA
cgactctatagagtcgctc

SEQ ID NO: 13737 - DNA, 19 bp, synthetic construct
  misc_feature 1..19: note = Description of Artificial Sequence: Syntheticoligonucleotide
  source 1..19: mol_type = other DNA
cgactctatagagtcgtcc

SEQ ID NO: 13738 - DNA, 19 bp, synthetic construct
  misc_feature 1..19: note = Description of Artificial Sequence: Syntheticoligonucleotide
  source 1..19: mol_type = other DNA
agactctatagagtctccc

SEQ ID NO: 13739 - DNA, 19 bp, synthetic construct
  misc_feature 1..19: note = Description of Artificial Sequence: Syntheticoligonucleotide
  source 1..19: mol_type = other DNA
cgactctatagagtcgcca

SEQ ID NO: 13740 - DNA, 19 bp, synthetic construct
  misc_feature 1..19: note = Description of Artificial Sequence: Syntheticoligonucleotide
  source 1..19: mol_type = other DNA
cgactctatagagtcgcac

SEQ ID NO: 13741 - DNA, 19 bp, synthetic construct
  misc_feature 1..19: note = Description of Artificial Sequence: Syntheticoligonucleotide
  source 1..19: mol_type = other DNA
tgactctatagagtcaccc

SEQ ID NO: 13742 - DNA, 19 bp, synthetic construct
  misc_feature 1..19: note = Description of Artificial Sequence: Syntheticoligonucleotide
  source 1..19: mol_type = other DNA
ggactctatagagtcccgt

SEQ ID NO: 13743 - DNA, 19 bp, synthetic construct
  misc_feature 1..19: note = Description of Artificial Sequence: Syntheticoligonucleotide
  source 1..19: mol_type = other DNA
ggactctatagagtccctg

SEQ ID NO: 13744 - DNA, 19 bp, synthetic construct
  misc_feature 1..19: note = Description of Artificial Sequence: Syntheticoligonucleotide
  source 1..19: mol_type = other DNA
ggactctatagagtcctgg

SEQ ID NO: 13745 - DNA, 19 bp, synthetic construct
  misc_feature 1..19: note = Description of Artificial Sequence: Syntheticoligonucleotide
  source 1..19: mol_type = other DNA
agactctatagagtctcgg

SEQ ID NO: 13746 - DNA, 19 bp, synthetic construct
  misc_feature 1..19: note = Description of Artificial Sequence: Syntheticoligonucleotide
  source 1..19: mol_type = other DNA
ggactctatagagtcccga

SEQ ID NO: 13747 - DNA, 19 bp, synthetic construct
  misc_feature 1..19: note = Description of Artificial Sequence: Syntheticoligonucleotide
  source 1..19: mol_type = other DNA
ggactctatagagtcccag

SEQ ID NO: 13748 - DNA, 19 bp, synthetic construct
  misc_feature 1..19: note = Description of Artificial Sequence: Syntheticoligonucleotide
  source 1..19: mol_type = other DNA
ggactctatagagtccagg

SEQ ID NO: 13749 - DNA, 19 bp, synthetic construct
  misc_feature 1..19: note = Description of Artificial Sequence: Syntheticoligonucleotide
  source 1..19: mol_type = other DNA
tgactctatagagtcacgg

SEQ ID NO: 13750 - DNA, 19 bp, synthetic construct
  misc_feature 1..19: note = Description of Artificial Sequence: Syntheticoligonucleotide
  source 1..19: mol_type = other DNA
cgactctatagagtcgccg

SEQ ID NO: 13751 - DNA, 19 bp, synthetic construct
  misc_feature 1..19: note = Description of Artificial Sequence: Syntheticoligonucleotide
  source 1..19: mol_type = other DNA
cgactctatagagtcgctg

SEQ ID NO: 13752 - DNA, 19 bp, synthetic construct
  misc_feature 1..19: note = Description of Artificial Sequence: Syntheticoligonucleotide
  source 1..19: mol_type = other DNA
cgactctatagagtcgtcg

SEQ ID NO: 13753 - DNA, 19 bp, synthetic construct
  misc_feature 1..19: note = Description of Artificial Sequence: Syntheticoligonucleotide
  source 1..19: mol_type = other DNA
agactctatagagtctccg

SEQ ID NO: 13754 - DNA, 19 bp, synthetic construct
  misc_feature 1..19: note = Description of Artificial Sequence: Syntheticoligonucleotide
  source 1..19: mol_type = other DNA
cgactctatagagtcgcag

SEQ ID NO: 13755 - DNA, 19 bp, synthetic construct
  misc_feature 1..19: note = Description of Artificial Sequence: Syntheticoligonucleotide
  source 1..19: mol_type = other DNA
tgactctatagagtcaccg

SEQ ID NO: 13756 - DNA, 19 bp, synthetic construct
  misc_feature 1..19: note = Description of Artificial Sequence: Syntheticoligonucleotide
  source 1..19: mol_type = other DNA
ggactctatagagtccgtg

SEQ ID NO: 13757 - DNA, 19 bp, synthetic construct
  misc_feature 1..19: note = Description of Artificial Sequence: Syntheticoligonucleotide
  source 1..19: mol_type = other DNA
agactctatagagtctggg

SEQ ID NO: 13758 - DNA, 19 bp, synthetic construct
  misc_feature 1..19: note = Description of Artificial Sequence: Syntheticoligonucleotide
  source 1..19: mol_type = other DNA
ggactctatagagtccgag

SEQ ID NO: 13759 - DNA, 19 bp, synthetic construct
  misc_feature 1..19: note = Description of Artificial Sequence: Syntheticoligonucleotide
  source 1..19: mol_type = other DNA
tgactctatagagtcaggg

SEQ ID NO: 13760 - DNA, 19 bp, synthetic construct
  misc_feature 1..19: note = Description of Artificial Sequence: Syntheticoligonucleotide
  source 1..19: mol_type = other DNA
cgactctatagagtcgtgg

SEQ ID NO: 13761 - DNA, 19 bp, synthetic construct
  misc_feature 1..19: note = Description of Artificial Sequence: Syntheticoligonucleotide
  source 1..19: mol_type = other DNA
cgactctatagagtcggct

SEQ ID NO: 13762 - DNA, 19 bp, synthetic construct
  misc_feature 1..19: note = Description of Artificial Sequence: Syntheticoligonucleotide
  source 1..19: mol_type = other DNA
cgactctatagagtcggca

SEQ ID NO: 13763 - DNA, 19 bp, synthetic construct
  misc_feature 1..19: note = Description of Artificial Sequence: Syntheticoligonucleotide
  source 1..19: mol_type = other DNA
agactctatagagtctcgc

SEQ ID NO: 13764 - DNA, 19 bp, synthetic construct
  misc_feature 1..19: note = Description of Artificial Sequence: Syntheticoligonucleotide
  source 1..19: mol_type = other DNA
tgactctatagagtcacgc

SEQ ID NO: 13765 - DNA, 19 bp, synthetic construct
  misc_feature 1..19: note = Description of Artificial Sequence: Syntheticoligonucleotide
  source 1..19: mol_type = other DNA
ggactctatagagtcctgc

SEQ ID NO: 13766 - DNA, 19 bp, synthetic construct
  misc_feature 1..19: note = Description of Artificial Sequence: Syntheticoligonucleotide
  source 1..19: mol_type = other DNA
ggactctatagagtccagc

SEQ ID NO: 13767 - DNA, 19 bp, synthetic construct
  misc_feature 1..19: note = Description of Artificial Sequence: Syntheticoligonucleotide
  source 1..19: mol_type = other DNA
ggactctatagagtcctcg

SEQ ID NO: 13768 - DNA, 19 bp, synthetic construct
  misc_feature 1..19: note = Description of Artificial Sequence: Syntheticoligonucleotide
  source 1..19: mol_type = other DNA
ggactctatagagtccacg

SEQ ID NO: 13769 - DNA, 19 bp, synthetic construct
  misc_feature 1..19: note = Description of Artificial Sequence: Syntheticoligonucleotide
  source 1..19: mol_type = other DNA
cgactctatagagtcggtg

SEQ ID NO: 13770 - DNA, 19 bp, synthetic construct
  misc_feature 1..19: note = Description of Artificial Sequence: Syntheticoligonucleotide
  source 1..19: mol_type = other DNA
cgactctatagagtcggag

SEQ ID NO: 13771 - DNA, 19 bp, synthetic construct
  misc_feature 1..19: note = Description of Artificial Sequence: Syntheticoligonucleotide
  source 1..19: mol_type = other DNA
ggactctatagagtcccgc

SEQ ID NO: 13772 - DNA, 19 bp, synthetic construct
  misc_feature 1..19: note = Description of Artificial Sequence: Syntheticoligonucleotide
  source 1..19: mol_type = other DNA
ggactctatagagtccctc

SEQ ID NO: 13773 - DNA, 19 bp, synthetic construct
  misc_feature 1..19: note = Description of Artificial Sequence: Syntheticoligonucleotide
  source 1..19: mol_type = other DNA
ggactctatagagtcccac

SEQ ID NO: 13774 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactcatatgagtcnnnn

SEQ ID NO: 13775 - DNA, 19 bp, synthetic construct
  misc_feature 1..19: note = Description of Artificial Sequence: Syntheticoligonucleotide
  source 1..19: mol_type = other DNA
ggactcatatgagtccgcc

SEQ ID NO: 13776 - DNA, 19 bp, synthetic construct
  misc_feature 1..19: note = Description of Artificial Sequence: Syntheticoligonucleotide
  source 1..19: mol_type = other DNA
ggactcatatgagtccgct

SEQ ID NO: 13777 - DNA, 19 bp, synthetic construct
  misc_feature 1..19: note = Description of Artificial Sequence: Syntheticoligonucleotide
  source 1..19: mol_type = other DNA
ggactcatatgagtccgtc

SEQ ID NO: 13778 - DNA, 19 bp, synthetic construct
  misc_feature 1..19: note = Description of Artificial Sequence: Syntheticoligonucleotide
  source 1..19: mol_type = other DNA
ggactcatatgagtcctcc

SEQ ID NO: 13779 - DNA, 19 bp, synthetic construct
  misc_feature 1..19: note = Description of Artificial Sequence: Syntheticoligonucleotide
  source 1..19: mol_type = other DNA
agactcatatgagtctgcc

SEQ ID NO: 13780 - DNA, 19 bp, synthetic construct
  misc_feature 1..19: note = Description of Artificial Sequence: Syntheticoligonucleotide
  source 1..19: mol_type = other DNA
ggactcatatgagtccgca

SEQ ID NO: 13781 - DNA, 19 bp, synthetic construct
  misc_feature 1..19: note = Description of Artificial Sequence: Syntheticoligonucleotide
  source 1..19: mol_type = other DNA
ggactcatatgagtccgac

SEQ ID NO: 13782 - DNA, 19 bp, synthetic construct
  misc_feature 1..19: note = Description of Artificial Sequence: Syntheticoligonucleotide
  source 1..19: mol_type = other DNA
ggactcatatgagtccacc

SEQ ID NO: 13783 - DNA, 19 bp, synthetic construct
  misc_feature 1..19: note = Description of Artificial Sequence: Syntheticoligonucleotide
  source 1..19: mol_type = other DNA
tgactcatatgagtcagcc

SEQ ID NO: 13784 - DNA, 19 bp, synthetic construct
  misc_feature 1..19: note = Description of Artificial Sequence: Syntheticoligonucleotide
  source 1..19: mol_type = other DNA
cgactcatatgagtcgggc

SEQ ID NO: 13785 - DNA, 19 bp, synthetic construct
  misc_feature 1..19: note = Description of Artificial Sequence: Syntheticoligonucleotide
  source 1..19: mol_type = other DNA
cgactcatatgagtcgggt

SEQ ID NO: 13786 - DNA, 19 bp, synthetic construct
  misc_feature 1..19: note = Description of Artificial Sequence: Syntheticoligonucleotide
  source 1..19: mol_type = other DNA
cgactcatatgagtcggtc

SEQ ID NO: 13787 - DNA, 19 bp, synthetic construct
  misc_feature 1..19: note = Description of Artificial Sequence: Syntheticoligonucleotide
  source 1..19: mol_type = other DNA
cgactcatatgagtcgtgc

SEQ ID NO: 13788 - DNA, 19 bp, synthetic construct
  misc_feature 1..19: note = Description of Artificial Sequence: Syntheticoligonucleotide
  source 1..19: mol_type = other DNA
agactcatatgagtctggc

SEQ ID NO: 13789 - DNA, 19 bp, synthetic construct
  misc_feature 1..19: note = Description of Artificial Sequence: Syntheticoligonucleotide
  source 1..19: mol_type = other DNA
cgactcatatgagtcggga

SEQ ID NO: 13790 - DNA, 19 bp, synthetic construct
  misc_feature 1..19: note = Description of Artificial Sequence: Syntheticoligonucleotide
  source 1..19: mol_type = other DNA
cgactcatatgagtcggac

SEQ ID NO: 13791 - DNA, 19 bp, synthetic construct
  misc_feature 1..19: note = Description of Artificial Sequence: Syntheticoligonucleotide
  source 1..19: mol_type = other DNA
tgactcatatgagtcaggc

SEQ ID NO: 13792 - DNA, 19 bp, synthetic construct
  misc_feature 1..19: note = Description of Artificial Sequence: Syntheticoligonucleotide
  source 1..19: mol_type = other DNA
cgactcatatgagtcgccc

SEQ ID NO: 13793 - DNA, 19 bp, synthetic construct
  misc_feature 1..19: note = Description of Artificial Sequence: Syntheticoligonucleotide
  source 1..19: mol_type = other DNA
cgactcatatgagtcgcct

SEQ ID NO: 13794 - DNA, 19 bp, synthetic construct
  misc_feature 1..19: note = Description of Artificial Sequence: Syntheticoligonucleotide
  source 1..19: mol_type = other DNA
cgactcatatgagtcgctc

SEQ ID NO: 13795 - DNA, 19 bp, synthetic construct
  misc_feature 1..19: note = Description of Artificial Sequence: Syntheticoligonucleotide
  source 1..19: mol_type = other DNA
cgactcatatgagtcgtcc

SEQ ID NO: 13796 - DNA, 19 bp, synthetic construct
  misc_feature 1..19: note = Description of Artificial Sequence: Syntheticoligonucleotide
  source 1..19: mol_type = other DNA
agactcatatgagtctccc

SEQ ID NO: 13797 - DNA, 19 bp, synthetic construct
  misc_feature 1..19: note = Description of Artificial Sequence: Syntheticoligonucleotide
  source 1..19: mol_type = other DNA
cgactcatatgagtcgcca

SEQ ID NO: 13798 - DNA, 19 bp, synthetic construct
  misc_feature 1..19: note = Description of Artificial Sequence: Syntheticoligonucleotide
  source 1..19: mol_type = other DNA
cgactcatatgagtcgcac

SEQ ID NO: 13799 - DNA, 19 bp, synthetic construct
  misc_feature 1..19: note = Description of Artificial Sequence: Syntheticoligonucleotide
  source 1..19: mol_type = other DNA
tgactcatatgagtcaccc

SEQ ID NO: 13800 - DNA, 19 bp, synthetic construct
  misc_feature 1..19: note = Description of Artificial Sequence: Syntheticoligonucleotide
  source 1..19: mol_type = other DNA
ggactcatatgagtcccgt

SEQ ID NO: 13801 - DNA, 19 bp, synthetic construct
  misc_feature 1..19: note = Description of Artificial Sequence: Syntheticoligonucleotide
  source 1..19: mol_type = other DNA
ggactcatatgagtccctg

SEQ ID NO: 13802 - DNA, 19 bp, synthetic construct
  misc_feature 1..19: note = Description of Artificial Sequence: Syntheticoligonucleotide
  source 1..19: mol_type = other DNA
ggactcatatgagtcctgg

SEQ ID NO: 13803 - DNA, 19 bp, synthetic construct
  misc_feature 1..19: note = Description of Artificial Sequence: Syntheticoligonucleotide
  source 1..19: mol_type = other DNA
agactcatatgagtctcgg

SEQ ID NO: 13804 - DNA, 19 bp, synthetic construct
  misc_feature 1..19: note = Description of Artificial Sequence: Syntheticoligonucleotide
  source 1..19: mol_type = other DNA
ggactcatatgagtcccga

SEQ ID NO: 13805 - DNA, 19 bp, synthetic construct
  misc_feature 1..19: note = Description of Artificial Sequence: Syntheticoligonucleotide
  source 1..19: mol_type = other DNA
ggactcatatgagtcccag

SEQ ID NO: 13806 - DNA, 19 bp, synthetic construct
  misc_feature 1..19: note = Description of Artificial Sequence: Syntheticoligonucleotide
  source 1..19: mol_type = other DNA
ggactcatatgagtccagg

SEQ ID NO: 13807 - DNA, 19 bp, synthetic construct
  misc_feature 1..19: note = Description of Artificial Sequence: Syntheticoligonucleotide
  source 1..19: mol_type = other DNA
tgactcatatgagtcacgg

SEQ ID NO: 13808 - DNA, 19 bp, synthetic construct
  misc_feature 1..19: note = Description of Artificial Sequence: Syntheticoligonucleotide
  source 1..19: mol_type = other DNA
cgactcatatgagtcgccg

SEQ ID NO: 13809 - DNA, 19 bp, synthetic construct
  misc_feature 1..19: note = Description of Artificial Sequence: Syntheticoligonucleotide
  source 1..19: mol_type = other DNA
cgactcatatgagtcgctg

SEQ ID NO: 13810 - DNA, 19 bp, synthetic construct
  misc_feature 1..19: note = Description of Artificial Sequence: Syntheticoligonucleotide
  source 1..19: mol_type = other DNA
cgactcatatgagtcgtcg

SEQ ID NO: 13811 - DNA, 19 bp, synthetic construct
  misc_feature 1..19: note = Description of Artificial Sequence: Syntheticoligonucleotide
  source 1..19: mol_type = other DNA
agactcatatgagtctccg

SEQ ID NO: 13812 - DNA, 19 bp, synthetic construct
  misc_feature 1..19: note = Description of Artificial Sequence: Syntheticoligonucleotide
  source 1..19: mol_type = other DNA
cgactcatatgagtcgcag

SEQ ID NO: 13813 - DNA, 19 bp, synthetic construct
  misc_feature 1..19: note = Description of Artificial Sequence: Syntheticoligonucleotide
  source 1..19: mol_type = other DNA
tgactcatatgagtcaccg

SEQ ID NO: 13814 - DNA, 19 bp, synthetic construct
  misc_feature 1..19: note = Description of Artificial Sequence: Syntheticoligonucleotide
  source 1..19: mol_type = other DNA
ggactcatatgagtccgtg

SEQ ID NO: 13815 - DNA, 19 bp, synthetic construct
  misc_feature 1..19: note = Description of Artificial Sequence: Syntheticoligonucleotide
  source 1..19: mol_type = other DNA
agactcatatgagtctggg

SEQ ID NO: 13816 - DNA, 19 bp, synthetic construct
  misc_feature 1..19: note = Description of Artificial Sequence: Syntheticoligonucleotide
  source 1..19: mol_type = other DNA
ggactcatatgagtccgag

SEQ ID NO: 13817 - DNA, 19 bp, synthetic construct
  misc_feature 1..19: note = Description of Artificial Sequence: Syntheticoligonucleotide
  source 1..19: mol_type = other DNA
tgactcatatgagtcaggg

SEQ ID NO: 13818 - DNA, 19 bp, synthetic construct
  misc_feature 1..19: note = Description of Artificial Sequence: Syntheticoligonucleotide
  source 1..19: mol_type = other DNA
cgactcatatgagtcgtgg

SEQ ID NO: 13819 - DNA, 19 bp, synthetic construct
  misc_feature 1..19: note = Description of Artificial Sequence: Syntheticoligonucleotide
  source 1..19: mol_type = other DNA
cgactcatatgagtcggct

SEQ ID NO: 13820 - DNA, 19 bp, synthetic construct
  misc_feature 1..19: note = Description of Artificial Sequence: Syntheticoligonucleotide
  source 1..19: mol_type = other DNA
cgactcatatgagtcggca

SEQ ID NO: 13821 - DNA, 19 bp, synthetic construct
  misc_feature 1..19: note = Description of Artificial Sequence: Syntheticoligonucleotide
  source 1..19: mol_type = other DNA
agactcatatgagtctcgc

SEQ ID NO: 13822 - DNA, 19 bp, synthetic construct
  misc_feature 1..19: note = Description of Artificial Sequence: Syntheticoligonucleotide
  source 1..19: mol_type = other DNA
tgactcatatgagtcacgc

SEQ ID NO: 13823 - DNA, 19 bp, synthetic construct
  misc_feature 1..19: note = Description of Artificial Sequence: Syntheticoligonucleotide
  source 1..19: mol_type = other DNA
ggactcatatgagtcctgc

SEQ ID NO: 13824 - DNA, 19 bp, synthetic construct
  misc_feature 1..19: note = Description of Artificial Sequence: Syntheticoligonucleotide
  source 1..19: mol_type = other DNA
ggactcatatgagtccagc

SEQ ID NO: 13825 - DNA, 19 bp, synthetic construct
  misc_feature 1..19: note = Description of Artificial Sequence: Syntheticoligonucleotide
  source 1..19: mol_type = other DNA
ggactcatatgagtcctcg

SEQ ID NO: 13826 - DNA, 19 bp, synthetic construct
  misc_feature 1..19: note = Description of Artificial Sequence: Syntheticoligonucleotide
  source 1..19: mol_type = other DNA
ggactcatatgagtccacg

SEQ ID NO: 13827 - DNA, 19 bp, synthetic construct
  misc_feature 1..19: note = Description of Artificial Sequence: Syntheticoligonucleotide
  source 1..19: mol_type = other DNA
cgactcatatgagtcggtg

SEQ ID NO: 13828 - DNA, 19 bp, synthetic construct
  misc_feature 1..19: note = Description of Artificial Sequence: Syntheticoligonucleotide
  source 1..19: mol_type = other DNA
cgactcatatgagtcggag

SEQ ID NO: 13829 - DNA, 19 bp, synthetic construct
  misc_feature 1..19: note = Description of Artificial Sequence: Syntheticoligonucleotide
  source 1..19: mol_type = other DNA
ggactcatatgagtcccgc

SEQ ID NO: 13830 - DNA, 19 bp, synthetic construct
  misc_feature 1..19: note = Description of Artificial Sequence: Syntheticoligonucleotide
  source 1..19: mol_type = other DNA
ggactcatatgagtccctc

SEQ ID NO: 13831 - DNA, 19 bp, synthetic construct
  misc_feature 1..19: note = Description of Artificial Sequence: Syntheticoligonucleotide
  source 1..19: mol_type = other DNA
ggactcatatgagtcccac

SEQ ID NO: 13832 - DNA, 19 bp, synthetic construct
  misc_feature 1..19: note = Description of Artificial Sequence: Syntheticoligonucleotide
  misc_difference 1: note = a, c, t, or g
  misc_difference 16..19: note = a, c, t, or g
  source 1..19: mol_type = other DNA
ngactcttaagagtcnnnn

SEQ ID NO: 13833 - DNA, 19 bp, synthetic construct
  misc_feature 1..19: note = Description of Artificial Sequence: Syntheticoligonucleotide
  source 1..19: mol_type = other DNA
ggactcttaagagtccgcc

SEQ ID NO: 13834 - DNA, 19 bp, synthetic construct
  misc_feature 1..19: note = Description of Artificial Sequence: Syntheticoligonucleotide
  source 1..19: mol_type = other DNA
ggactcttaagagtccgct

SEQ ID NO: 13835 - DNA, 19 bp, synthetic construct
  misc_feature 1..19: note = Description of Artificial Sequence: Syntheticoligonucleotide
  source 1..19: mol_type = other DNA
ggactcttaagagtccgtc

SEQ ID NO: 13836 - DNA, 19 bp, synthetic construct
  misc_feature 1..19: note = Description of Artificial Sequence: Syntheticoligonucleotide
  source 1..19: mol_type = other DNA
ggactcttaagagtcctcc

SEQ ID NO: 13837 - DNA, 19 bp, synthetic construct
  misc_feature 1..19: note = Description of Artificial Sequence: Syntheticoligonucleotide
  source 1..19: mol_type = other DNA
agactcttaagagtctgcc

SEQ ID NO: 13838 - DNA, 19 bp, synthetic construct
  misc_feature 1..19: note = Description of Artificial Sequence: Syntheticoligonucleotide
  source 1..19: mol_type = other DNA
ggactcttaagagtccgca

SEQ ID NO: 13839 - DNA, 19 bp, synthetic construct
  misc_feature 1..19: note = Description of Artificial Sequence: Syntheticoligonucleotide
  source 1..19: mol_type = other DNA
ggactcttaagagtccgac

SEQ ID NO: 13840 - DNA, 19 bp, synthetic construct
  misc_feature 1..19: note = Description of Artificial Sequence: Syntheticoligonucleotide
  source 1..19: mol_type = other DNA
ggactcttaagagtccacc

SEQ ID NO: 13841 - DNA, 19 bp, synthetic construct
  misc_feature 1..19: note = Description of Artificial Sequence: Syntheticoligonucleotide
  source 1..19: mol_type = other DNA
tgactcttaagagtcagcc

SEQ ID NO: 13842 - DNA, 19 bp, synthetic construct
  misc_feature 1..19: note = Description of Artificial Sequence: Syntheticoligonucleotide
  source 1..19: mol_type = other DNA
cgactcttaagagtcgggc

SEQ ID NO: 13843 - DNA, 19 bp, synthetic construct
  misc_feature 1..19: note = Description of Artificial Sequence: Syntheticoligonucleotide
  source 1..19: mol_type = other DNA
cgactcttaagagtcgggt

SEQ ID NO: 13844 - DNA, 19 bp, synthetic construct
  misc_feature 1..19: note = Description of Artificial Sequence: Syntheticoligonucleotide
  source 1..19: mol_type = other DNA
cgactcttaagagtcggtc

SEQ ID NO: 13845 - DNA, 19 bp, synthetic construct
  misc_feature 1..19: note = Description of Artificial Sequence: Syntheticoligonucleotide
  source 1..19: mol_type = other DNA
cgactcttaagagtcgtgc

SEQ ID NO: 13846 - DNA, 19 bp, synthetic construct
  misc_feature 1..19: note = Description of Artificial Sequence: Syntheticoligonucleotide
  source 1..19: mol_type = other DNA
agactcttaagagtctggc

SEQ ID NO: 13847 - DNA, 19 bp, synthetic construct
  misc_feature 1..19: note = Description of Artificial Sequence: Syntheticoligonucleotide
  source 1..19: mol_type = other DNA
cgactcttaagagtcggga

SEQ ID NO: 13848 - DNA, 19 bp, synthetic construct
  misc_feature 1..19: note = Description of Artificial Sequence: Syntheticoligonucleotide
  source 1..19: mol_type = other DNA
cgactcttaagagtcggac

SEQ ID NO: 13849 - DNA, 19 bp, synthetic construct
  misc_feature 1..19: note = Description of Artificial Sequence: Syntheticoligonucleotide
  source 1..19: mol_type = other DNA
tgactcttaagagtcaggc

SEQ ID NO: 13850 - DNA, 19 bp, synthetic construct
  misc_feature 1..19: note = Description of Artificial Sequence: Syntheticoligonucleotide
  source 1..19: mol_type = other DNA
cgactcttaagagtcgccc

SEQ ID NO: 13851 - DNA, 19 bp, synthetic construct
  misc_feature 1..19: note = Description of Artificial Sequence: Syntheticoligonucleotide
  source 1..19: mol_type = other DNA
cgactcttaagagtcgcct

SEQ ID NO: 13852 - DNA, 19 bp, synthetic construct
  misc_feature 1..19: note = Description of Artificial Sequence: Syntheticoligonucleotide
  source 1..19: mol_type = other DNA
cgactcttaagagtcgctc

SEQ ID NO: 13853 - DNA, 19 bp, synthetic construct
  misc_feature 1..19: note = Description of Artificial Sequence: Syntheticoligonucleotide
  source 1..19: mol_type = other DNA
cgactcttaagagtcgtcc

SEQ ID NO: 13854 - DNA, 19 bp, synthetic construct
  misc_feature 1..19: note = Description of Artificial Sequence: Syntheticoligonucleotide
  source 1..19: mol_type = other DNA
agactcttaagagtctccc

SEQ ID NO: 13855 - DNA, 19 bp, synthetic construct
  misc_feature 1..19: note = Description of Artificial Sequence: Syntheticoligonucleotide
  source 1..19: mol_type = other DNA
cgactcttaagagtcgcca

SEQ ID NO: 13856 - DNA, 19 bp, synthetic construct
  misc_feature 1..19: note = Description of Artificial Sequence: Syntheticoligonucleotide
  source 1..19: mol_type = other DNA
cgactcttaagagtcgcac

SEQ ID NO: 13857 - DNA, 19 bp, synthetic construct
  misc_feature 1..19: note = Description of Artificial Sequence: Syntheticoligonucleotide
  source 1..19: mol_type = other DNA
tgactcttaagagtcaccc

SEQ ID NO: 13858 - DNA, 19 bp, synthetic construct
  misc_feature 1..19: note = Description of Artificial Sequence: Syntheticoligonucleotide
  source 1..19: mol_type = other DNA
ggactcttaagagtcccgt

SEQ ID NO: 13859 - DNA, 19 bp, synthetic construct
  misc_feature 1..19: note = Description of Artificial Sequence: Syntheticoligonucleotide
  source 1..19: mol_type = other DNA
ggactcttaagagtccctg

SEQ ID NO: 13860 - DNA, 19 bp, synthetic construct
  misc_feature 1..19: note = Description of Artificial Sequence: Syntheticoligonucleotide
  source 1..19: mol_type = other DNA
ggactcttaagagtcctgg

SEQ ID NO: 13861 - DNA, 19 bp, synthetic construct
  misc_feature 1..19: note = Description of Artificial Sequence: Syntheticoligonucleotide
  source 1..19: mol_type = other DNA
agactcttaagagtctcgg

SEQ ID NO: 13862 - DNA, 19 bp, synthetic construct
  misc_feature 1..19: note = Description of Artificial Sequence: Syntheticoligonucleotide
  source 1..19: mol_type = other DNA
ggactcttaagagtcccga

SEQ ID NO: 13863 - DNA, 19 bp, synthetic construct
  misc_feature 1..19: note = Description of Artificial Sequence: Syntheticoligonucleotide
  source 1..19: mol_type = other DNA
ggactcttaagagtcccag

SEQ ID NO: 13864 - DNA, 19 bp, synthetic construct
  misc_feature 1..19: note = Description of Artificial Sequence: Syntheticoligonucleotide
  source 1..19: mol_type = other DNA
ggactcttaagagtccagg

SEQ ID NO: 13865 - DNA, 19 bp, synthetic construct
  misc_feature 1..19: note = Description of Artificial Sequence: Syntheticoligonucleotide
  source 1..19: mol_type = other DNA
tgactcttaagagtcacgg

SEQ ID NO: 13866 - DNA, 19 bp, synthetic construct
  misc_feature 1..19: note = Description of Artificial Sequence: Syntheticoligonucleotide
  source 1..19: mol_type = other DNA
cgactcttaagagtcgccg

SEQ ID NO: 13867 - DNA, 19 bp, synthetic construct
  misc_feature 1..19: note = Description of Artificial Sequence: Syntheticoligonucleotide
  source 1..19: mol_type = other DNA
cgactcttaagagtcgctg

SEQ ID NO: 13868 - DNA, 19 bp, synthetic construct
  misc_feature 1..19: note = Description of Artificial Sequence: Syntheticoligonucleotide
  source 1..19: mol_type = other DNA
cgactcttaagagtcgtcg

SEQ ID NO: 13869 - DNA, 19 bp, synthetic construct
  misc_feature 1..19: note = Description of Artificial Sequence: Syntheticoligonucleotide
  source 1..19: mol_type = other DNA
agactcttaagagtctccg

SEQ ID NO: 13870 - DNA, 19 bp, synthetic construct
  misc_feature 1..19: note = Description of Artificial Sequence: Syntheticoligonucleotide
  source 1..19: mol_type = other DNA
cgactcttaagagtcgcag

SEQ ID NO: 13871 - DNA, 19 bp, synthetic construct
  misc_feature 1..19: note = Description of Artificial Sequence: Syntheticoligonucleotide
  source 1..19: mol_type = other DNA
tgactcttaagagtcaccg

SEQ ID NO: 13872 - DNA, 19 bp, synthetic construct
  misc_feature 1..19: note = Description of Artificial Sequence: Syntheticoligonucleotide
  source 1..19: mol_type = other DNA
ggactcttaagagtccgtg

SEQ ID NO: 13873 - DNA, 19 bp, synthetic construct
  misc_feature 1..19: note = Description of Artificial Sequence: Syntheticoligonucleotide
  source 1..19: mol_type = other DNA
agactcttaagagtctggg

SEQ ID NO: 13874 - DNA, 19 bp, synthetic construct
  misc_feature 1..19: note = Description of Artificial Sequence: Syntheticoligonucleotide
  source 1..19: mol_type = other DNA
ggactcttaagagtccgag

SEQ ID NO: 13875 - DNA, 19 bp, synthetic construct
  misc_feature 1..19: note = Description of Artificial Sequence: Syntheticoligonucleotide
  source 1..19: mol_type = other DNA
tgactcttaagagtcaggg

SEQ ID NO: 13876 - DNA, 19 bp, synthetic construct
  misc_feature 1..19: note = Description of Artificial Sequence: Syntheticoligonucleotide
  source 1..19: mol_type = other DNA
cgactcttaagagtcgtgg

SEQ ID NO: 13877 - DNA, 19 bp, synthetic construct
  misc_feature 1..19: note = Description of Artificial Sequence: Syntheticoligonucleotide
  source 1..19: mol_type = other DNA
cgactcttaagagtcggct

SEQ ID NO: 13878 - DNA, 19 bp, synthetic construct
  misc_feature 1..19: note = Description of Artificial Sequence: Syntheticoligonucleotide
  source 1..19: mol_type = other DNA
cgactcttaagagtcggca

SEQ ID NO: 13879 - DNA, 19 bp, synthetic construct
  misc_feature 1..19: note = Description of Artificial Sequence: Syntheticoligonucleotide
  source 1..19: mol_type = other DNA
agactcttaagagtctcgc

SEQ ID NO: 13880 - DNA, 19 bp, synthetic construct
  misc_feature 1..19: note = Description of Artificial Sequence: Syntheticoligonucleotide
  source 1..19: mol_type = other DNA
tgactcttaagagtcacgc

SEQ ID NO: 13881 - DNA, 19 bp, synthetic construct
  misc_feature 1..19: note = Description of Artificial Sequence: Syntheticoligonucleotide
  source 1..19: mol_type = other DNA
ggactcttaagagtcctgc

SEQ ID NO: 13882 - DNA, 19 bp, synthetic construct
  misc_feature 1..19: note = Description of Artificial Sequence: Syntheticoligonucleotide
  source 1..19: mol_type = other DNA
ggactcttaagagtccagc

SEQ ID NO: 13883 - DNA, 19 bp, synthetic construct
  misc_feature 1..19: note = Description of Artificial Sequence: Syntheticoligonucleotide
  source 1..19: mol_type = other DNA
ggactcttaagagtcctcg

SEQ ID NO: 13884 - DNA, 19 bp, synthetic construct
  misc_feature 1..19: note = Description of Artificial Sequence: Syntheticoligonucleotide
  source 1..19: mol_type = other DNA
ggactcttaagagtccacg

SEQ ID NO: 13885 - DNA, 19 bp, synthetic construct
  misc_feature 1..19: note = Description of Artificial Sequence: Syntheticoligonucleotide
  source 1..19: mol_type = other DNA
cgactcttaagagtcggtg

SEQ ID NO: 13886 - DNA, 19 bp, synthetic construct
  misc_feature 1..19: note = Description of Artificial Sequence: Syntheticoligonucleotide
  source 1..19: mol_type = other DNA
cgactcttaagagtcggag

SEQ ID NO: 13887 - DNA, 19 bp, synthetic construct
  misc_feature 1..19: note = Description of Artificial Sequence: Syntheticoligonucleotide
  source 1..19: mol_type = other DNA
ggactcttaagagtcccgc

SEQ ID NO: 13888 - DNA, 19 bp, synthetic construct
  misc_feature 1..19: note = Description of Artificial Sequence: Syntheticoligonucleotide
  source 1..19: mol_type = other DNA
ggactcttaagagtccctc

SEQ ID NO: 13889 - DNA, 19 bp, synthetic construct
  misc_feature 1..19: note = Description of Artificial Sequence: Syntheticoligonucleotide
  source 1..19: mol_type = other DNA
ggactcttaagagtcccac

SEQ ID NO: 13890 - DNA, 19 bp, synthetic construct
  misc_feature 1..19: note = Description of Artificial Sequence: Syntheticoligonucleotide
  misc_difference 1: note = a, c, t, or g
  misc_difference 7..10: note = a, c, t, or g
  misc_difference 16..19: note = a, c, t, or g
  source 1..19: mol_type = other DNA
ngactcnnnngagtcnnnn

SEQ ID NO: 13891 - DNA, 20 bp, synthetic construct
  misc_feature 1..20: note = Description of Artificial Sequence: Syntheticoligonucleotide
  source 1..20: mol_type = other DNA
tatgactccgcggagtcata

SEQ ID NO: 13892 - DNA, 20 bp, synthetic construct
  misc_feature 1..20: note = Description of Artificial Sequence: Syntheticoligonucleotide
  source 1..20: mol_type = other DNA
aatgactccgcggagtcatt

SEQ ID NO: 13893 - DNA, 20 bp, synthetic construct
  misc_feature 1..20: note = Description of Artificial Sequence: Syntheticoligonucleotide
  source 1..20: mol_type = other DNA
gatgactccgcggagtcatc

SEQ ID NO: 13894 - DNA, 20 bp, synthetic construct
  misc_feature 1..20: note = Description of Artificial Sequence: Syntheticoligonucleotide
  source 1..20: mol_type = other DNA
taagactccgcggagtctta

SEQ ID NO: 13895 - DNA, 20 bp, synthetic construct
  misc_feature 1..20: note = Description of Artificial Sequence: Syntheticoligonucleotide
  source 1..20: mol_type = other DNA
aaagactccgcggagtcttt

SEQ ID NO: 13896 - DNA, 20 bp, synthetic construct
  misc_feature 1..20: note = Description of Artificial Sequence: Syntheticoligonucleotide
  source 1..20: mol_type = other DNA
gaagactccgcggagtcttc

SEQ ID NO: 13897 - DNA, 20 bp, synthetic construct
  misc_feature 1..20: note = Description of Artificial Sequence: Syntheticoligonucleotide
  source 1..20: mol_type = other DNA
caagactccgcggagtcttg

SEQ ID NO: 13898 - DNA, 20 bp, synthetic construct
  misc_feature 1..20: note = Description of Artificial Sequence: Syntheticoligonucleotide
  source 1..20: mol_type = other DNA
taggactccgcggagtccta

SEQ ID NO: 13899 - DNA, 20 bp, synthetic construct
  misc_feature 1..20: note = Description of Artificial Sequence: Syntheticoligonucleotide
  source 1..20: mol_type = other DNA
aaggactccgcggagtcctt

SEQ ID NO: 13900 - DNA, 20 bp, synthetic construct
  misc_feature 1..20: note = Description of Artificial Sequence: Syntheticoligonucleotide
  source 1..20: mol_type = other DNA
gaggactccgcggagtcctc

SEQ ID NO: 13901 - DNA, 20 bp, synthetic construct
  misc_feature 1..20: note = Description of Artificial Sequence: Syntheticoligonucleotide
  source 1..20: mol_type = other DNA
caggactccgcggagtcctg

SEQ ID NO: 13902 - DNA, 20 bp, synthetic construct
  misc_feature 1..20: note = Description of Artificial Sequence: Syntheticoligonucleotide
  source 1..20: mol_type = other DNA
tacgactccgcggagtcgta

SEQ ID NO: 13903 - DNA, 20 bp, synthetic construct
  misc_feature 1..20: note = Description of Artificial Sequence: Syntheticoligonucleotide
  source 1..20: mol_type = other DNA
aacgactccgcggagtcgtt

SEQ ID NO: 13904 - DNA, 20 bp, synthetic construct
  misc_feature 1..20: note = Description of Artificial Sequence: Syntheticoligonucleotide
  source 1..20: mol_type = other DNA
gacgactccgcggagtcgtc

SEQ ID NO: 13905 - DNA, 20 bp, synthetic construct
  misc_feature 1..20: note = Description of Artificial Sequence: Syntheticoligonucleotide
  source 1..20: mol_type = other DNA
cacgactccgcggagtcgtg

SEQ ID NO: 13906 - DNA, 20 bp, synthetic construct
  misc_feature 1..20: note = Description of Artificial Sequence: Syntheticoligonucleotide
  source 1..20: mol_type = other DNA
tgtgactccgcggagtcaca

SEQ ID NO: 13907 - DNA, 20 bp, synthetic construct
  misc_feature 1..20: note = Description of Artificial Sequence: Syntheticoligonucleotide
  source 1..20: mol_type = other DNA
agtgactccgcggagtcact

SEQ ID NO: 13908 - DNA, 20 bp, synthetic construct
  misc_feature 1..20: note = Description of Artificial Sequence: Syntheticoligonucleotide
  source 1..20: mol_type = other DNA
ggtgactccgcggagtcacc

SEQ ID NO: 13909 - DNA, 20 bp, synthetic construct
  misc_feature 1..20: note = Description of Artificial Sequence: Syntheticoligonucleotide
  source 1..20: mol_type = other DNA
cgtgactccgcggagtcacg

SEQ ID NO: 13910 - DNA, 20 bp, synthetic construct
  misc_feature 1..20: note = Description of Artificial Sequence: Syntheticoligonucleotide
  source 1..20: mol_type = other DNA
tgagactccgcggagtctca

SEQ ID NO: 13911 - DNA, 20 bp, synthetic construct
  misc_feature 1..20: note = Description of Artificial Sequence: Syntheticoligonucleotide
  source 1..20: mol_type = other DNA
agagactccgcggagtctct

SEQ ID NO: 13912 - DNA, 20 bp, synthetic construct
  misc_feature 1..20: note = Description of Artificial Sequence: Syntheticoligonucleotide
  source 1..20: mol_type = other DNA
ggagactccgcggagtctcc

SEQ ID NO: 13913 - DNA, 20 bp, synthetic construct
  misc_feature 1..20: note = Description of Artificial Sequence: Syntheticoligonucleotide
  source 1..20: mol_type = other DNA
cgagactccgcggagtctcg

SEQ ID NO: 13914 - DNA, 20 bp, synthetic construct
  misc_feature 1..20: note = Description of Artificial Sequence: Syntheticoligonucleotide
  source 1..20: mol_type = other DNA
tgggactccgcggagtccca

SEQ ID NO: 13915 - DNA, 20 bp, synthetic construct
  misc_feature 1..20: note = Description of Artificial Sequence: Syntheticoligonucleotide
  source 1..20: mol_type = other DNA
agggactccgcggagtccct

SEQ ID NO: 13916 - DNA, 20 bp, synthetic construct
  misc_feature 1..20: note = Description of Artificial Sequence: Syntheticoligonucleotide
  source 1..20: mol_type = other DNA
cgggactccgcggagtcccg

SEQ ID NO: 13917 - DNA, 20 bp, synthetic construct
  misc_feature 1..20: note = Description of Artificial Sequence: Syntheticoligonucleotide
  source 1..20: mol_type = other DNA
tgcgactccgcggagtcgca

SEQ ID NO: 13918 - DNA, 20 bp, synthetic construct
  misc_feature 1..20: note = Description of Artificial Sequence: Syntheticoligonucleotide
  source 1..20: mol_type = other DNA
agcgactccgcggagtcgct

SEQ ID NO: 13919 - DNA, 20 bp, synthetic construct
  misc_feature 1..20: note = Description of Artificial Sequence: Syntheticoligonucleotide
  source 1..20: mol_type = other DNA
ggcgactccgcggagtcgcc

SEQ ID NO: 13920 - DNA, 20 bp, synthetic construct
  misc_feature 1..20: note = Description of Artificial Sequence: Syntheticoligonucleotide
  source 1..20: mol_type = other DNA
cgcgactccgcggagtcgcg

SEQ ID NO: 13921 - DNA, 20 bp, synthetic construct
  misc_feature 1..20: note = Description of Artificial Sequence: Syntheticoligonucleotide
  source 1..20: mol_type = other DNA
tctgactccgcggagtcaga

SEQ ID NO: 13922 - DNA, 20 bp, synthetic construct
  misc_feature 1..20: note = Description of Artificial Sequence: Syntheticoligonucleotide
  source 1..20: mol_type = other DNA
actgactccgcggagtcagt

SEQ ID NO: 13923 - DNA, 20 bp, synthetic construct
  misc_feature 1..20: note = Description of Artificial Sequence: Syntheticoligonucleotide
  source 1..20: mol_type = other DNA
gctgactccgcggagtcagc

SEQ ID NO: 13924 - DNA, 20 bp, synthetic construct
  misc_feature 1..20: note = Description of Artificial Sequence: Syntheticoligonucleotide
  source 1..20: mol_type = other DNA
cctgactccgcggagtcagg

SEQ ID NO: 13925 - DNA, 20 bp, synthetic construct
  misc_feature 1..20: note = Description of Artificial Sequence: Syntheticoligonucleotide
  source 1..20: mol_type = other DNA
tcagactccgcggagtctga

SEQ ID NO: 13926 - DNA, 20 bp, synthetic construct
  misc_feature 1..20: note = Description of Artificial Sequence: Syntheticoligonucleotide
  source 1..20: mol_type = other DNA
acagactccgcggagtctgt

SEQ ID NO: 13927 - DNA, 20 bp, synthetic construct
  misc_feature 1..20: note = Description of Artificial Sequence: Syntheticoligonucleotide
  source 1..20: mol_type = other DNA
gcagactccgcggagtctgc

SEQ ID NO: 13928 - DNA, 20 bp, synthetic construct
  misc_feature 1..20: note = Description of Artificial Sequence: Syntheticoligonucleotide
  source 1..20: mol_type = other DNA
ccagactccgcggagtctgg

SEQ ID NO: 13929 - DNA, 20 bp, synthetic construct
  misc_feature 1..20: note = Description of Artificial Sequence: Syntheticoligonucleotide
  source 1..20: mol_type = other DNA
tcggactccgcggagtccga

SEQ ID NO: 13930 - DNA, 20 bp, synthetic construct
  misc_feature 1..20: note = Description of Artificial Sequence: Syntheticoligonucleotide
  source 1..20: mol_type = other DNA
acggactccgcggagtccgt

SEQ ID NO: 13931 - DNA, 20 bp, synthetic construct
  misc_feature 1..20: note = Description of Artificial Sequence: Syntheticoligonucleotide
  source 1..20: mol_type = other DNA
gcggactccgcggagtccgc

SEQ ID NO: 13932 - DNA, 20 bp, synthetic construct
  misc_feature 1..20: note = Description of Artificial Sequence: Syntheticoligonucleotide
  source 1..20: mol_type = other DNA
ccggactccgcggagtccgg

SEQ ID NO: 13933 - DNA, 20 bp, synthetic construct
  misc_feature 1..20: note = Description of Artificial Sequence: Syntheticoligonucleotide
  source 1..20: mol_type = other DNA
tccgactccgcggagtcgga

SEQ ID NO: 13934 - DNA, 20 bp, synthetic construct
  misc_feature 1..20: note = Description of Artificial Sequence: Syntheticoligonucleotide
  source 1..20: mol_type = other DNA
accgactccgcggagtcggt

SEQ ID NO: 13935 - DNA, 20 bp, synthetic construct
  misc_feature 1..20: note = Description of Artificial Sequence: Syntheticoligonucleotide
  source 1..20: mol_type = other DNA
gccgactccgcggagtcggc

SEQ ID NO: 13936 - DNA, 20 bp, synthetic construct
  misc_feature 1..20: note = Description of Artificial Sequence: Syntheticoligonucleotide
  source 1..20: mol_type = other DNA
cccgactccgcggagtcggg

SEQ ID NO: 13937 - DNA, 20 bp, synthetic construct
  misc_feature 1..20: note = Description of Artificial Sequence: Syntheticoligonucleotide
  source 1..20: mol_type = other DNA
tttgactccgcggagtcaaa

SEQ ID NO: 13938 - DNA, 20 bp, synthetic construct
  misc_feature 1..20: note = Description of Artificial Sequence: Syntheticoligonucleotide
  source 1..20: mol_type = other DNA
attgactccgcggagtcaat

SEQ ID NO: 13939 - DNA, 20 bp, synthetic construct
  misc_feature 1..20: note = Description of Artificial Sequence: Syntheticoligonucleotide
  source 1..20: mol_type = other DNA
gttgactccgcggagtcaac

SEQ ID NO: 13940 - DNA, 20 bp, synthetic construct
  misc_feature 1..20: note = Description of Artificial Sequence: Syntheticoligonucleotide
  source 1..20: mol_type = other DNA
cttgactccgcggagtcaag

SEQ ID NO: 13941 - DNA, 20 bp, synthetic construct
  misc_feature 1..20: note = Description of Artificial Sequence: Syntheticoligonucleotide
  source 1..20: mol_type = other DNA
ttagactccgcggagtctaa

SEQ ID NO: 13942 - DNA, 20 bp, synthetic construct
  misc_feature 1..20: note = Description of Artificial Sequence: Syntheticoligonucleotide
  source 1..20: mol_type = other DNA
atagactccgcggagtctat

SEQ ID NO: 13943 - DNA, 20 bp, synthetic construct
  misc_feature 1..20: note = Description of Artificial Sequence: Syntheticoligonucleotide
  source 1..20: mol_type = other DNA
gtagactccgcggagtctac

SEQ ID NO: 13944 - DNA, 20 bp, synthetic construct
  misc_feature 1..20: note = Description of Artificial Sequence: Syntheticoligonucleotide
  source 1..20: mol_type = other DNA
ctagactccgcggagtctag

SEQ ID NO: 13945 - DNA, 20 bp, synthetic construct
  misc_feature 1..20: note = Description of Artificial Sequence: Syntheticoligonucleotide
  source 1..20: mol_type = other DNA
ttggactccgcggagtccaa

SEQ ID NO: 13946 - DNA, 20 bp, synthetic construct
  misc_feature 1..20: note = Description of Artificial Sequence: Syntheticoligonucleotide
  source 1..20: mol_type = other DNA
atggactccgcggagtccat

SEQ ID NO: 13947 - DNA, 20 bp, synthetic construct
  misc_feature 1..20: note = Description of Artificial Sequence: Syntheticoligonucleotide
  source 1..20: mol_type = other DNA
gtggactccgcggagtccac

SEQ ID NO: 13948 - DNA, 20 bp, synthetic construct
  misc_feature 1..20: note = Description of Artificial Sequence: Syntheticoligonucleotide
  source 1..20: mol_type = other DNA
ctggactccgcggagtccag

SEQ ID NO: 13949 - DNA, 20 bp, synthetic construct
  misc_feature 1..20: note = Description of Artificial Sequence: Syntheticoligonucleotide
  source 1..20: mol_type = other DNA
tatgactcccgggagtcata

SEQ ID NO: 13950 - DNA, 20 bp, synthetic construct
  misc_feature 1..20: note = Description of Artificial Sequence: Syntheticoligonucleotide
  source 1..20: mol_type = other DNA
aatgactcccgggagtcatt

SEQ ID NO: 13951 - DNA, 20 bp, synthetic construct
  misc_feature 1..20: note = Description of Artificial Sequence: Syntheticoligonucleotide
  source 1..20: mol_type = other DNA
gatgactcccgggagtcatc

SEQ ID NO: 13952 - DNA, 20 bp, synthetic construct
  misc_feature 1..20: note = Description of Artificial Sequence: Syntheticoligonucleotide
  source 1..20: mol_type = other DNA
taagactcccgggagtctta

SEQ ID NO: 13953 - DNA, 20 bp, synthetic construct
  misc_feature 1..20: note = Description of Artificial Sequence: Syntheticoligonucleotide
  source 1..20: mol_type = other DNA
aaagactcccgggagtcttt

SEQ ID NO: 13954 - DNA, 20 bp, synthetic construct
  misc_feature 1..20: note = Description of Artificial Sequence: Syntheticoligonucleotide
  source 1..20: mol_type = other DNA
gaagactcccgggagtcttc

SEQ ID NO: 13955 - DNA, 20 bp, synthetic construct
  misc_feature 1..20: note = Description of Artificial Sequence: Syntheticoligonucleotide
  source 1..20: mol_type = other DNA
caagactcccgggagtcttg

SEQ ID NO: 13956 - DNA, 20 bp, synthetic construct
  misc_feature 1..20: note = Description of Artificial Sequence: Syntheticoligonucleotide
  source 1..20: mol_type = other DNA
taggactcccgggagtccta

SEQ ID NO: 13957 - DNA, 20 bp, synthetic construct
  misc_feature 1..20: note = Description of Artificial Sequence: Syntheticoligonucleotide
  source 1..20: mol_type = other DNA
aaggactcccgggagtcctt

SEQ ID NO: 13958 - DNA, 20 bp, synthetic construct
  misc_feature 1..20: note = Description of Artificial Sequence: Syntheticoligonucleotide
  source 1..20: mol_type = other DNA
gaggactcccgggagtcctc

SEQ ID NO: 13959 - DNA, 20 bp, synthetic construct
  misc_feature 1..20: note = Description of Artificial Sequence: Syntheticoligonucleotide
  source 1..20: mol_type = other DNA
caggactcccgggagtcctg

SEQ ID NO: 13960 - DNA, 20 bp, synthetic construct
  misc_feature 1..20: note = Description of Artificial Sequence: Syntheticoligonucleotide
  source 1..20: mol_type = other DNA
tacgactcccgggagtcgta

SEQ ID NO: 13961 - DNA, 20 bp, synthetic construct
  misc_feature 1..20: note = Description of Artificial Sequence: Syntheticoligonucleotide
  source 1..20: mol_type = other DNA
aacgactcccgggagtcgtt

SEQ ID NO: 13962 - DNA, 20 bp, synthetic construct
  misc_feature 1..20: note = Description of Artificial Sequence: Syntheticoligonucleotide
  source 1..20: mol_type = other DNA
gacgactcccgggagtcgtc

SEQ ID NO: 13963 - DNA, 20 bp, synthetic construct
  misc_feature 1..20: note = Description of Artificial Sequence: Syntheticoligonucleotide
  source 1..20: mol_type = other DNA
cacgactcccgggagtcgtg

SEQ ID NO: 13964 - DNA, 20 bp, synthetic construct
  misc_feature 1..20: note = Description of Artificial Sequence: Syntheticoligonucleotide
  source 1..20: mol_type = other DNA
tgtgactcccgggagtcaca

SEQ ID NO: 13965 - DNA, 20 bp, synthetic construct
  misc_feature 1..20: note = Description of Artificial Sequence: Syntheticoligonucleotide
  source 1..20: mol_type = other DNA
agtgactcccgggagtcact

SEQ ID NO: 13966 - DNA, 20 bp, synthetic construct
  misc_feature 1..20: note = Description of Artificial Sequence: Syntheticoligonucleotide
  source 1..20: mol_type = other DNA
ggtgactcccgggagtcacc

SEQ ID NO: 13967 - DNA, 20 bp, synthetic construct
  misc_feature 1..20: note = Description of Artificial Sequence: Syntheticoligonucleotide
  source 1..20: mol_type = other DNA
cgtgactcccgggagtcacg

SEQ ID NO: 13968 - DNA, 20 bp, synthetic construct
  misc_feature 1..20: note = Description of Artificial Sequence: Syntheticoligonucleotide
  source 1..20: mol_type = other DNA
tgagactcccgggagtctca

SEQ ID NO: 13969 - DNA, 20 bp, synthetic construct
  misc_feature 1..20: note = Description of Artificial Sequence: Syntheticoligonucleotide
  source 1..20: mol_type = other DNA
agagactcccgggagtctct

SEQ ID NO: 13970 - DNA, 20 bp, synthetic construct
  misc_feature 1..20: note = Description of Artificial Sequence: Syntheticoligonucleotide
  source 1..20: mol_type = other DNA
ggagactcccgggagtctcc

SEQ ID NO: 13971 - DNA, 20 bp, synthetic construct
  misc_feature 1..20: note = Description of Artificial Sequence: Syntheticoligonucleotide
  source 1..20: mol_type = other DNA
cgagactcccgggagtctcg

SEQ ID NO: 13972 - DNA, 20 bp, synthetic construct
  misc_feature 1..20: note = Description of Artificial Sequence: Syntheticoligonucleotide
  source 1..20: mol_type = other DNA
tgggactcccgggagtccca

SEQ ID NO: 13973 - DNA, 20 bp, synthetic construct
  misc_feature 1..20: note = Description of Artificial Sequence: Syntheticoligonucleotide
  source 1..20: mol_type = other DNA
agggactcccgggagtccct

SEQ ID NO: 13974 - DNA, 20 bp, synthetic construct
  misc_feature 1..20: note = Description of Artificial Sequence: Syntheticoligonucleotide
  source 1..20: mol_type = other DNA
cgggactcccgggagtcccg

SEQ ID NO: 13975 - DNA, 20 bp, synthetic construct
  misc_feature 1..20: note = Description of Artificial Sequence: Syntheticoligonucleotide
  source 1..20: mol_type = other DNA
tgcgactcccgggagtcgca

SEQ ID NO: 13976 - DNA, 20 bp, synthetic construct
  misc_feature 1..20: note = Description of Artificial Sequence: Syntheticoligonucleotide
  source 1..20: mol_type = other DNA
agcgactcccgggagtcgct

SEQ ID NO: 13977 - DNA, 20 bp, synthetic construct
  misc_feature 1..20: note = Description of Artificial Sequence: Syntheticoligonucleotide
  source 1..20: mol_type = other DNA
ggcgactcccgggagtcgcc

SEQ ID NO: 13978 - DNA, 20 bp, synthetic construct
  misc_feature 1..20: note = Description of Artificial Sequence: Syntheticoligonucleotide
  source 1..20: mol_type = other DNA
cgcgactcccgggagtcgcg

SEQ ID NO: 13979 - DNA, 20 bp, synthetic construct
  misc_feature 1..20: note = Description of Artificial Sequence: Syntheticoligonucleotide
  source 1..20: mol_type = other DNA
tctgactcccgggagtcaga

SEQ ID NO: 13980 - DNA, 20 bp, synthetic construct
  misc_feature 1..20: note = Description of Artificial Sequence: Syntheticoligonucleotide
  source 1..20: mol_type = other DNA
actgactcccgggagtcagt

SEQ ID NO: 13981 - DNA, 20 bp, synthetic construct
  misc_feature 1..20: note = Description of Artificial Sequence: Syntheticoligonucleotide
  source 1..20: mol_type = other DNA
gctgactcccgggagtcagc

SEQ ID NO: 13982 - DNA, 20 bp, synthetic construct
  misc_feature 1..20: note = Description of Artificial Sequence: Syntheticoligonucleotide
  source 1..20: mol_type = other DNA
cctgactcccgggagtcagg

SEQ ID NO: 13983 - DNA, 20 bp, synthetic construct
  misc_feature 1..20: note = Description of Artificial Sequence: Syntheticoligonucleotide
  source 1..20: mol_type = other DNA
tcagactcccgggagtctga

SEQ ID NO: 13984 - DNA, 20 bp, synthetic construct
  misc_feature 1..20: note = Description of Artificial Sequence: Syntheticoligonucleotide
  source 1..20: mol_type = other DNA
acagactcccgggagtctgt

SEQ ID NO: 13985 - DNA, 20 bp, synthetic construct
  misc_feature 1..20: note = Description of Artificial Sequence: Syntheticoligonucleotide
  source 1..20: mol_type = other DNA
gcagactcccgggagtctgc

SEQ ID NO: 13986 - DNA, 20 bp, synthetic construct
  misc_feature 1..20: note = Description of Artificial Sequence: Syntheticoligonucleotide
  source 1..20: mol_type = other DNA
ccagactcccgggagtctgg

SEQ ID NO: 13987 - DNA, 20 bp, synthetic construct
  misc_feature 1..20: note = Description of Artificial Sequence: Syntheticoligonucleotide
  source 1..20: mol_type = other DNA
tcggactcccgggagtccga

SEQ ID NO: 13988 - DNA, 20 bp, synthetic construct
  misc_feature 1..20: note = Description of Artificial Sequence: Syntheticoligonucleotide
  source 1..20: mol_type = other DNA
acggactcccgggagtccgt

SEQ ID NO: 13989 - DNA, 20 bp, synthetic construct
  misc_feature 1..20: note = Description of Artificial Sequence: Syntheticoligonucleotide
  source 1..20: mol_type = other DNA
gcggactcccgggagtccgc

SEQ ID NO: 13990 - DNA, 20 bp, synthetic construct
  misc_feature 1..20: note = Description of Artificial Sequence: Syntheticoligonucleotide
  source 1..20: mol_type = other DNA
ccggactcccgggagtccgg

SEQ ID NO: 13991 - DNA, 20 bp, synthetic construct
  misc_feature 1..20: note = Description of Artificial Sequence: Syntheticoligonucleotide
  source 1..20: mol_type = other DNA
tccgactcccgggagtcgga

SEQ ID NO: 13992 - DNA, 20 bp, synthetic construct
  misc_feature 1..20: note = Description of Artificial Sequence: Syntheticoligonucleotide
  source 1..20: mol_type = other DNA
accgactcccgggagtcggt

SEQ ID NO: 13993 - DNA, 20 bp, synthetic construct
  misc_feature 1..20: note = Description of Artificial Sequence: Syntheticoligonucleotide
  source 1..20: mol_type = other DNA
gccgactcccgggagtcggc

SEQ ID NO: 13994 - DNA, 20 bp, synthetic construct
  misc_feature 1..20: note = Description of Artificial Sequence: Syntheticoligonucleotide
  source 1..20: mol_type = other DNA
cccgactcccgggagtcggg

SEQ ID NO: 13995 - DNA, 20 bp, synthetic construct
  misc_feature 1..20: note = Description of Artificial Sequence: Syntheticoligonucleotide
  source 1..20: mol_type = other DNA
tttgactcccgggagtcaaa

SEQ ID NO: 13996 - DNA, 20 bp, synthetic construct
  misc_feature 1..20: note = Description of Artificial Sequence: Syntheticoligonucleotide
  source 1..20: mol_type = other DNA
attgactcccgggagtcaat

SEQ ID NO: 13997 - DNA, 20 bp, synthetic construct
  misc_feature 1..20: note = Description of Artificial Sequence: Syntheticoligonucleotide
  source 1..20: mol_type = other DNA
gttgactcccgggagtcaac

SEQ ID NO: 13998 - DNA, 20 bp, synthetic construct
  misc_feature 1..20: note = Description of Artificial Sequence: Syntheticoligonucleotide
  source 1..20: mol_type = other DNA
cttgactcccgggagtcaag

SEQ ID NO: 13999 - DNA, 20 bp, synthetic construct
  misc_feature 1..20: note = Description of Artificial Sequence: Syntheticoligonucleotide
  source 1..20: mol_type = other DNA
ttagactcccgggagtctaa

SEQ ID NO: 14000 - DNA, 20 bp, synthetic construct
  misc_feature 1..20: note = Description of Artificial Sequence: Syntheticoligonucleotide
  source 1..20: mol_type = other DNA
atagactcccgggagtctat

SEQ ID NO: 14001 - DNA, 20 bp, synthetic construct
  misc_feature 1..20: note = Description of Artificial Sequence: Syntheticoligonucleotide
  source 1..20: mol_type = other DNA
gtagactcccgggagtctac

SEQ ID NO: 14002 - DNA, 20 bp, synthetic construct
  misc_feature 1..20: note = Description of Artificial Sequence: Syntheticoligonucleotide
  source 1..20: mol_type = other DNA
ctagactcccgggagtctag

SEQ ID NO: 14003 - DNA, 20 bp, synthetic construct
  misc_feature 1..20: note = Description of Artificial Sequence: Syntheticoligonucleotide
  source 1..20: mol_type = other DNA
ttggactcccgggagtccaa

SEQ ID NO: 14004 - DNA, 20 bp, synthetic construct
  misc_feature 1..20: note = Description of Artificial Sequence: Syntheticoligonucleotide
  source 1..20: mol_type = other DNA
atggactcccgggagtccat

SEQ ID NO: 14005 - DNA, 20 bp, synthetic construct
  misc_feature 1..20: note = Description of Artificial Sequence: Syntheticoligonucleotide
  source 1..20: mol_type = other DNA
gtggactcccgggagtccac

SEQ ID NO: 14006 - DNA, 20 bp, synthetic construct
  misc_feature 1..20: note = Description of Artificial Sequence: Syntheticoligonucleotide
  source 1..20: mol_type = other DNA
ctggactcccgggagtccag

SEQ ID NO: 14007 - DNA, 20 bp, synthetic construct
  misc_feature 1..20: note = Description of Artificial Sequence: Syntheticoligonucleotide
  source 1..20: mol_type = other DNA
tatgactcggccgagtcata

SEQ ID NO: 14008 - DNA, 20 bp, synthetic construct
  misc_feature 1..20: note = Description of Artificial Sequence: Syntheticoligonucleotide
  source 1..20: mol_type = other DNA
aatgactcggccgagtcatt

SEQ ID NO: 14009 - DNA, 20 bp, synthetic construct
  misc_feature 1..20: note = Description of Artificial Sequence: Syntheticoligonucleotide
  source 1..20: mol_type = other DNA
gatgactcggccgagtcatc

SEQ ID NO: 14010 - DNA, 20 bp, synthetic construct
  misc_feature 1..20: note = Description of Artificial Sequence: Syntheticoligonucleotide
  source 1..20: mol_type = other DNA
taagactcggccgagtctta

SEQ ID NO: 14011 - DNA, 20 bp, synthetic construct
  misc_feature 1..20: note = Description of Artificial Sequence: Syntheticoligonucleotide
  source 1..20: mol_type = other DNA
aaagactcggccgagtcttt

SEQ ID NO: 14012 - DNA, 20 bp, synthetic construct
  misc_feature 1..20: note = Description of Artificial Sequence: Syntheticoligonucleotide
  source 1..20: mol_type = other DNA
gaagactcggccgagtcttc

SEQ ID NO: 14013 - DNA, 20 bp, synthetic construct
  misc_feature 1..20: note = Description of Artificial Sequence: Syntheticoligonucleotide
  source 1..20: mol_type = other DNA
caagactcggccgagtcttg

SEQ ID NO: 14014 - DNA, 20 bp, synthetic construct
  misc_feature 1..20: note = Description of Artificial Sequence: Syntheticoligonucleotide
  source 1..20: mol_type = other DNA
taggactcggccgagtccta

SEQ ID NO: 14015 - DNA, 20 bp, synthetic construct
  misc_feature 1..20: note = Description of Artificial Sequence: Syntheticoligonucleotide
  source 1..20: mol_type = other DNA
aaggactcggccgagtcctt

SEQ ID NO: 14016 - DNA, 20 bp, synthetic construct
  misc_feature 1..20: note = Description of Artificial Sequence: Syntheticoligonucleotide
  source 1..20: mol_type = other DNA
gaggactcggccgagtcctc

SEQ ID NO: 14017 - DNA, 20 bp, synthetic construct
  misc_feature 1..20: note = Description of Artificial Sequence: Syntheticoligonucleotide
  source 1..20: mol_type = other DNA
caggactcggccgagtcctg

SEQ ID NO: 14018 - DNA, 20 bp, synthetic construct
  misc_feature 1..20: note = Description of Artificial Sequence: Syntheticoligonucleotide
  source 1..20: mol_type = other DNA
tacgactcggccgagtcgta

SEQ ID NO: 14019 - DNA, 20 bp, synthetic construct
  misc_feature 1..20: note = Description of Artificial Sequence: Syntheticoligonucleotide
  source 1..20: mol_type = other DNA
aacgactcggccgagtcgtt

SEQ ID NO: 14020 - DNA, 20 bp, synthetic construct
  misc_feature 1..20: note = Description of Artificial Sequence: Syntheticoligonucleotide
  source 1..20: mol_type = other DNA
gacgactcggccgagtcgtc

SEQ ID NO: 14021 - DNA, 20 bp, synthetic construct
  misc_feature 1..20: note = Description of Artificial Sequence: Syntheticoligonucleotide
  source 1..20: mol_type = other DNA
cacgactcggccgagtcgtg

SEQ ID NO: 14022 - DNA, 20 bp, synthetic construct
  misc_feature 1..20: note = Description of Artificial Sequence: Syntheticoligonucleotide
  source 1..20: mol_type = other DNA
tgtgactcggccgagtcaca

SEQ ID NO: 14023 - DNA, 20 bp, synthetic construct
  misc_feature 1..20: note = Description of Artificial Sequence: Syntheticoligonucleotide
  source 1..20: mol_type = other DNA
agtgactcggccgagtcact

SEQ ID NO: 14024 - DNA, 20 bp, synthetic construct
  misc_feature 1..20: note = Description of Artificial Sequence: Syntheticoligonucleotide
  source 1..20: mol_type = other DNA
ggtgactcggccgagtcacc

SEQ ID NO: 14025 - DNA, 20 bp, synthetic construct
  misc_feature 1..20: note = Description of Artificial Sequence: Syntheticoligonucleotide
  source 1..20: mol_type = other DNA
cgtgactcggccgagtcacg

SEQ ID NO: 14026 - DNA, 20 bp, synthetic construct
  misc_feature 1..20: note = Description of Artificial Sequence: Syntheticoligonucleotide
  source 1..20: mol_type = other DNA
tgagactcggccgagtctca

SEQ ID NO: 14027 - DNA, 20 bp, synthetic construct
  misc_feature 1..20: note = Description of Artificial Sequence: Syntheticoligonucleotide
  source 1..20: mol_type = other DNA
agagactcggccgagtctct

SEQ ID NO: 14028 - DNA, 20 bp, synthetic construct
  misc_feature 1..20: note = Description of Artificial Sequence: Syntheticoligonucleotide
  source 1..20: mol_type = other DNA
ggagactcggccgagtctcc

SEQ ID NO: 14029 - DNA, 20 bp, synthetic construct
  misc_feature 1..20: note = Description of Artificial Sequence: Syntheticoligonucleotide
  source 1..20: mol_type = other DNA
cgagactcggccgagtctcg

SEQ ID NO: 14030 - DNA, 20 bp, synthetic construct
  misc_feature 1..20: note = Description of Artificial Sequence: Syntheticoligonucleotide
  source 1..20: mol_type = other DNA
tgggactcggccgagtccca

SEQ ID NO: 14031 - DNA, 20 bp, synthetic construct
  misc_feature 1..20: note = Description of Artificial Sequence: Syntheticoligonucleotide
  source 1..20: mol_type = other DNA
agggactcggccgagtccct

SEQ ID NO: 14032 - DNA, 20 bp, synthetic construct
  misc_feature 1..20: note = Description of Artificial Sequence: Syntheticoligonucleotide
  source 1..20: mol_type = other DNA
cgggactcggccgagtcccg

SEQ ID NO: 14033 - DNA, 20 bp, synthetic construct
  misc_feature 1..20: note = Description of Artificial Sequence: Syntheticoligonucleotide
  source 1..20: mol_type = other DNA
tgcgactcggccgagtcgca

SEQ ID NO: 14034 - DNA, 20 bp, synthetic construct
  misc_feature 1..20: note = Description of Artificial Sequence: Syntheticoligonucleotide
  source 1..20: mol_type = other DNA
agcgactcggccgagtcgct

SEQ ID NO: 14035 - DNA, 20 bp, synthetic construct
  misc_feature 1..20: note = Description of Artificial Sequence: Syntheticoligonucleotide
  source 1..20: mol_type = other DNA
ggcgactcggccgagtcgcc

SEQ ID NO: 14036 - DNA, 20 bp, synthetic construct
  misc_feature 1..20: note = Description of Artificial Sequence: Syntheticoligonucleotide
  source 1..20: mol_type = other DNA
cgcgactcggccgagtcgcg

SEQ ID NO: 14037 - DNA, 20 bp, synthetic construct
  misc_feature 1..20: note = Description of Artificial Sequence: Syntheticoligonucleotide
  source 1..20: mol_type = other DNA
tctgactcggccgagtcaga

SEQ ID NO: 14038 - DNA, 20 bp, synthetic construct
  misc_feature 1..20: note = Description of Artificial Sequence: Syntheticoligonucleotide
  source 1..20: mol_type = other DNA
actgactcggccgagtcagt

SEQ ID NO: 14039 - DNA, 20 bp, synthetic construct
  misc_feature 1..20: note = Description of Artificial Sequence: Syntheticoligonucleotide
  source 1..20: mol_type = other DNA
gctgactcggccgagtcagc

SEQ ID NO: 14040 - DNA, 20 bp, synthetic construct
  misc_feature 1..20: note = Description of Artificial Sequence: Syntheticoligonucleotide
  source 1..20: mol_type = other DNA
cctgactcggccgagtcagg

SEQ ID NO: 14041 - DNA, 20 bp, synthetic construct
  misc_feature 1..20: note = Description of Artificial Sequence: Syntheticoligonucleotide
  source 1..20: mol_type = other DNA
tcagactcggccgagtctga

SEQ ID NO: 14042 - DNA, 20 bp, synthetic construct
  misc_feature 1..20: note = Description of Artificial Sequence: Syntheticoligonucleotide
  source 1..20: mol_type = other DNA
acagactcggccgagtctgt

SEQ ID NO: 14043 - DNA, 20 bp, synthetic construct
  misc_feature 1..20: note = Description of Artificial Sequence: Syntheticoligonucleotide
  source 1..20: mol_type = other DNA
gcagactcggccgagtctgc

SEQ ID NO: 14044 - DNA, 20 bp, synthetic construct
  misc_feature 1..20: note = Description of Artificial Sequence: Syntheticoligonucleotide
  source 1..20: mol_type = other DNA
ccagactcggccgagtctgg

SEQ ID NO: 14045 - DNA, 20 bp, synthetic construct
  misc_feature 1..20: note = Description of Artificial Sequence: Syntheticoligonucleotide
  source 1..20: mol_type = other DNA
tcggactcggccgagtccga

SEQ ID NO: 14046 - DNA, 20 bp, synthetic construct
  misc_feature 1..20: note = Description of Artificial Sequence: Syntheticoligonucleotide
  source 1..20: mol_type = other DNA
acggactcggccgagtccgt

SEQ ID NO: 14047 - DNA, 20 bp, synthetic construct
  misc_feature 1..20: note = Description of Artificial Sequence: Syntheticoligonucleotide
  source 1..20: mol_type = other DNA
gcggactcggccgagtccgc

SEQ ID NO: 14048 - DNA, 20 bp, synthetic construct
  misc_feature 1..20: note = Description of Artificial Sequence: Syntheticoligonucleotide
  source 1..20: mol_type = other DNA
ccggactcggccgagtccgg

SEQ ID NO: 14049 - DNA, 20 bp, synthetic construct
  misc_feature 1..20: note = Description of Artificial Sequence: Syntheticoligonucleotide
  source 1..20: mol_type = other DNA
tccgactcggccgagtcgga

SEQ ID NO: 14050 - DNA, 20 bp, synthetic construct
  misc_feature 1..20: note = Description of Artificial Sequence: Syntheticoligonucleotide
  source 1..20: mol_type = other DNA
accgactcggccgagtcggt

SEQ ID NO: 14051 - DNA, 20 bp, synthetic construct
  misc_feature 1..20: note = Description of Artificial Sequence: Syntheticoligonucleotide
  source 1..20: mol_type = other DNA
gccgactcggccgagtcggc

SEQ ID NO: 14052 - DNA, 20 bp, synthetic construct
  misc_feature 1..20: note = Description of Artificial Sequence: Syntheticoligonucleotide
  source 1..20: mol_type = other DNA
cccgactcggccgagtcggg

SEQ ID NO: 14053 - DNA, 20 bp, synthetic construct
  misc_feature 1..20: note = Description of Artificial Sequence: Syntheticoligonucleotide
  source 1..20: mol_type = other DNA
tttgactcggccgagtcaaa

SEQ ID NO: 14054 - DNA, 20 bp, synthetic construct
  misc_feature 1..20: note = Description of Artificial Sequence: Syntheticoligonucleotide
  source 1..20: mol_type = other DNA
attgactcggccgagtcaat

SEQ ID NO: 14055 - DNA, 20 bp, synthetic construct
  misc_feature 1..20: note = Description of Artificial Sequence: Syntheticoligonucleotide
  source 1..20: mol_type = other DNA
gttgactcggccgagtcaac

SEQ ID NO: 14056 - DNA, 20 bp, synthetic construct
  misc_feature 1..20: note = Description of Artificial Sequence: Syntheticoligonucleotide
  source 1..20: mol_type = other DNA
cttgactcggccgagtcaag

SEQ ID NO: 14057 - DNA, 20 bp, synthetic construct
  misc_feature 1..20: note = Description of Artificial Sequence: Syntheticoligonucleotide
  source 1..20: mol_type = other DNA
ttagactcggccgagtctaa

SEQ ID NO: 14058 - DNA, 20 bp, synthetic construct
  misc_feature 1..20: note = Description of Artificial Sequence: Syntheticoligonucleotide
  source 1..20: mol_type = other DNA
atagactcggccgagtctat

SEQ ID NO: 14059 - DNA, 20 bp, synthetic construct
  misc_feature 1..20: note = Description of Artificial Sequence: Syntheticoligonucleotide
  source 1..20: mol_type = other DNA
gtagactcggccgagtctac

SEQ ID NO: 14060 - DNA, 20 bp, synthetic construct
  misc_feature 1..20: note = Description of Artificial Sequence: Syntheticoligonucleotide
  source 1..20: mol_type = other DNA
ctagactcggccgagtctag

SEQ ID NO: 14061 - DNA, 20 bp, synthetic construct
  misc_feature 1..20: note = Description of Artificial Sequence: Syntheticoligonucleotide
  source 1..20: mol_type = other DNA
ttggactcggccgagtccaa

SEQ ID NO: 14062 - DNA, 20 bp, synthetic construct
  misc_feature 1..20: note = Description of Artificial Sequence: Syntheticoligonucleotide
  source 1..20: mol_type = other DNA
atggactcggccgagtccat

SEQ ID NO: 14063 - DNA, 20 bp, synthetic construct
  misc_feature 1..20: note = Description of Artificial Sequence: Syntheticoligonucleotide
  source 1..20: mol_type = other DNA
gtggactcggccgagtccac

SEQ ID NO: 14064 - DNA, 20 bp, synthetic construct
  misc_feature 1..20: note = Description of Artificial Sequence: Syntheticoligonucleotide
  source 1..20: mol_type = other DNA
ctggactcggccgagtccag

SEQ ID NO: 14065 - DNA, 20 bp, synthetic construct
  misc_feature 1..20: note = Description of Artificial Sequence: Syntheticoligonucleotide
  source 1..20: mol_type = other DNA
aatgactctgcagagtcatt

SEQ ID NO: 14066 - DNA, 20 bp, synthetic construct
  misc_feature 1..20: note = Description of Artificial Sequence: Syntheticoligonucleotide
  source 1..20: mol_type = other DNA
gatgactctgcagagtcatc

SEQ ID NO: 14067 - DNA, 20 bp, synthetic construct
  misc_feature 1..20: note = Description of Artificial Sequence: Syntheticoligonucleotide
  source 1..20: mol_type = other DNA
aaagactctgcagagtcttt

SEQ ID NO: 14068 - DNA, 20 bp, synthetic construct
  misc_feature 1..20: note = Description of Artificial Sequence: Syntheticoligonucleotide
  source 1..20: mol_type = other DNA
gaagactctgcagagtcttc

SEQ ID NO: 14069 - DNA, 20 bp, synthetic construct
  misc_feature 1..20: note = Description of Artificial Sequence: Syntheticoligonucleotide
  source 1..20: mol_type = other DNA
caagactctgcagagtcttg

SEQ ID NO: 14070 - DNA, 20 bp, synthetic construct
  misc_feature 1..20: note = Description of Artificial Sequence: Syntheticoligonucleotide
  source 1..20: mol_type = other DNA
taggactctgcagagtccta

SEQ ID NO: 14071 - DNA, 20 bp, synthetic construct
  misc_feature 1..20: note = Description of Artificial Sequence: Syntheticoligonucleotide
  source 1..20: mol_type = other DNA
aaggactctgcagagtcctt

SEQ ID NO: 14072 - DNA, 20 bp, synthetic construct
  misc_feature 1..20: note = Description of Artificial Sequence: Syntheticoligonucleotide
  source 1..20: mol_type = other DNA
gaggactctgcagagtcctc

SEQ ID NO: 14073 - DNA, 20 bp, synthetic construct
  misc_feature 1..20: note = Description of Artificial Sequence: Syntheticoligonucleotide
  source 1..20: mol_type = other DNA
caggactctgcagagtcctg

SEQ ID NO: 14074 - DNA, 20 bp, synthetic construct
  misc_feature 1..20: note = Description of Artificial Sequence: Syntheticoligonucleotide
  source 1..20: mol_type = other DNA
tacgactctgcagagtcgta

SEQ ID NO: 14075 - DNA, 20 bp, synthetic construct
  misc_feature 1..20: note = Description of Artificial Sequence: Syntheticoligonucleotide
  source 1..20: mol_type = other DNA
aacgactctgcagagtcgtt

SEQ ID NO: 14076 - DNA, 20 bp, synthetic construct
  misc_feature 1..20: note = Description of Artificial Sequence: Syntheticoligonucleotide
  source 1..20: mol_type = other DNA
gacgactctgcagagtcgtc

SEQ ID NO: 14077 - DNA, 20 bp, synthetic construct
  misc_feature 1..20: note = Description of Artificial Sequence: Syntheticoligonucleotide
  source 1..20: mol_type = other DNA
cacgactctgcagagtcgtg

SEQ ID NO: 14078 - DNA, 20 bp, synthetic construct
  misc_feature 1..20: note = Description of Artificial Sequence: Syntheticoligonucleotide
  source 1..20: mol_type = other DNA
tgtgactctgcagagtcaca

SEQ ID NO: 14079 - DNA, 20 bp, synthetic construct
  misc_feature 1..20: note = Description of Artificial Sequence: Syntheticoligonucleotide
  source 1..20: mol_type = other DNA
agtgactctgcagagtcact

SEQ ID NO: 14080 - DNA, 20 bp, synthetic construct
  misc_feature 1..20: note = Description of Artificial Sequence: Syntheticoligonucleotide
  source 1..20: mol_type = other DNA
ggtgactctgcagagtcacc

SEQ ID NO: 14081 - DNA, 20 bp, synthetic construct
  misc_feature 1..20: note = Description of Artificial Sequence: Syntheticoligonucleotide
  source 1..20: mol_type = other DNA
cgtgactctgcagagtcacg

SEQ ID NO: 14082 - DNA, 20 bp, synthetic construct
  misc_feature 1..20: note = Description of Artificial Sequence: Syntheticoligonucleotide
  source 1..20: mol_type = other DNA
tgagactctgcagagtctca

SEQ ID NO: 14083 - DNA, 20 bp, synthetic construct
  misc_feature 1..20: note = Description of Artificial Sequence: Syntheticoligonucleotide
  source 1..20: mol_type = other DNA
agagactctgcagagtctct

SEQ ID NO: 14084 - DNA, 20 bp, synthetic construct
  misc_feature 1..20: note = Description of Artificial Sequence: Syntheticoligonucleotide
  source 1..20: mol_type = other DNA
ggagactctgcagagtctcc

SEQ ID NO: 14085 - DNA, 20 bp, synthetic construct
  misc_feature 1..20: note = Description of Artificial Sequence: Syntheticoligonucleotide
  source 1..20: mol_type = other DNA
cgagactctgcagagtctcg

SEQ ID NO: 14086 - DNA, 20 bp, synthetic construct
  misc_feature 1..20: note = Description of Artificial Sequence: Syntheticoligonucleotide
  source 1..20: mol_type = other DNA
tgggactctgcagagtccca

SEQ ID NO: 14087 - DNA, 20 bp, synthetic construct
  misc_feature 1..20: note = Description of Artificial Sequence: Syntheticoligonucleotide
  source 1..20: mol_type = other DNA
agggactctgcagagtccct

SEQ ID NO: 14088 - DNA, 20 bp, synthetic construct
  misc_feature 1..20: note = Description of Artificial Sequence: Syntheticoligonucleotide
  source 1..20: mol_type = other DNA
cgggactctgcagagtcccg

SEQ ID NO: 14089 - DNA, 20 bp, synthetic construct
  misc_feature 1..20: note = Description of Artificial Sequence: Syntheticoligonucleotide
  source 1..20: mol_type = other DNA
tgcgactctgcagagtcgca

SEQ ID NO: 14090 - DNA, 20 bp, synthetic construct
  misc_feature 1..20: note = Description of Artificial Sequence: Syntheticoligonucleotide
  source 1..20: mol_type = other DNA
agcgactctgcagagtcgct

SEQ ID NO: 14091 - DNA, 20 bp, synthetic construct
  misc_feature 1..20: note = Description of Artificial Sequence: Syntheticoligonucleotide
  source 1..20: mol_type = other DNA
ggcgactctgcagagtcgcc

SEQ ID NO: 14092 - DNA, 20 bp, synthetic construct
  misc_feature 1..20: note = Description of Artificial Sequence: Syntheticoligonucleotide
  source 1..20: mol_type = other DNA
cgcgactctgcagagtcgcg

SEQ ID NO: 14093 - DNA, 20 bp, synthetic construct
  misc_feature 1..20: note = Description of Artificial Sequence: Syntheticoligonucleotide
  source 1..20: mol_type = other DNA
tctgactctgcagagtcaga

SEQ ID NO: 14094 - DNA, 20 bp, synthetic construct
  misc_feature 1..20: note = Description of Artificial Sequence: Syntheticoligonucleotide
  source 1..20: mol_type = other DNA
actgactctgcagagtcagt

SEQ ID NO: 14095 - DNA, 20 bp, synthetic construct
  misc_feature 1..20: note = Description of Artificial Sequence: Syntheticoligonucleotide
  source 1..20: mol_type = other DNA
gctgactctgcagagtcagc

SEQ ID NO: 14096 - DNA, 20 bp, synthetic construct
  misc_feature 1..20: note = Description of Artificial Sequence: Syntheticoligonucleotide
  source 1..20: mol_type = other DNA
cctgactctgcagagtcagg

SEQ ID NO: 14097 - DNA, 20 bp, synthetic construct
  misc_feature 1..20: note = Description of Artificial Sequence: Syntheticoligonucleotide
  source 1..20: mol_type = other DNA
tcagactctgcagagtctga

SEQ ID NO: 14098 - DNA, 20 bp, synthetic construct
  misc_feature 1..20: note = Description of Artificial Sequence: Syntheticoligonucleotide
  source 1..20: mol_type = other DNA
acagactctgcagagtctgt

SEQ ID NO: 14099 - DNA, 20 bp, synthetic construct
  misc_feature 1..20: note = Description of Artificial Sequence: Syntheticoligonucleotide
  source 1..20: mol_type = other DNA
gcagactctgcagagtctgc

SEQ ID NO: 14100 - DNA, 20 bp, synthetic construct
  misc_feature 1..20: note = Description of Artificial Sequence: Syntheticoligonucleotide
  source 1..20: mol_type = other DNA
ccagactctgcagagtctgg

SEQ ID NO: 14101 - DNA, 20 bp, synthetic construct
  misc_feature 1..20: note = Description of Artificial Sequence: Syntheticoligonucleotide
  source 1..20: mol_type = other DNA
tcggactctgcagagtccga

SEQ ID NO: 14102 - DNA, 20 bp, synthetic construct
  misc_feature 1..20: note = Description of Artificial Sequence: Syntheticoligonucleotide
  source 1..20: mol_type = other DNA
acggactctgcagagtccgt

SEQ ID NO: 14103 - DNA, 20 bp, synthetic construct
  misc_feature 1..20: note = Description of Artificial Sequence: Syntheticoligonucleotide
  source 1..20: mol_type = other DNA
gcggactctgcagagtccgc

SEQ ID NO: 14104 - DNA, 20 bp, synthetic construct
  misc_feature 1..20: note = Description of Artificial Sequence: Syntheticoligonucleotide
  source 1..20: mol_type = other DNA
ccggactctgcagagtccgg

SEQ ID NO: 14105 - DNA, 20 bp, synthetic construct
  misc_feature 1..20: note = Description of Artificial Sequence: Syntheticoligonucleotide
  source 1..20: mol_type = other DNA
tccgactctgcagagtcgga

SEQ ID NO: 14106 - DNA, 20 bp, synthetic construct
  misc_feature 1..20: note = Description of Artificial Sequence: Syntheticoligonucleotide
  source 1..20: mol_type = other DNA
accgactctgcagagtcggt

SEQ ID NO: 14107 - DNA, 20 bp, synthetic construct
  misc_feature 1..20: note = Description of Artificial Sequence: Syntheticoligonucleotide
  source 1..20: mol_type = other DNA
gccgactctgcagagtcggc

SEQ ID NO: 14108 - DNA, 20 bp, synthetic construct
  misc_feature 1..20: note = Description of Artificial Sequence: Syntheticoligonucleotide
  source 1..20: mol_type = other DNA
cccgactctgcagagtcggg

SEQ ID NO: 14109 - DNA, 20 bp, synthetic construct
  misc_feature 1..20: note = Description of Artificial Sequence: Syntheticoligonucleotide
  source 1..20: mol_type = other DNA
tttgactctgcagagtcaaa

SEQ ID NO: 14110 - DNA, 20 bp, synthetic construct
  misc_feature 1..20: note = Description of Artificial Sequence: Syntheticoligonucleotide
  source 1..20: mol_type = other DNA
attgactctgcagagtcaat

SEQ ID NO: 14111 - DNA, 20 bp, synthetic construct
  misc_feature 1..20: note = Description of Artificial Sequence: Syntheticoligonucleotide
  source 1..20: mol_type = other DNA
gttgactctgcagagtcaac

SEQ ID NO: 14112 - DNA, 20 bp, synthetic construct
  misc_feature 1..20: note = Description of Artificial Sequence: Syntheticoligonucleotide
  source 1..20: mol_type = other DNA
cttgactctgcagagtcaag

SEQ ID NO: 14113 - DNA, 20 bp, synthetic construct
  misc_feature 1..20: note = Description of Artificial Sequence: Syntheticoligonucleotide
  source 1..20: mol_type = other DNA
gtagactctgcagagtctac

SEQ ID NO: 14114 - DNA, 20 bp, synthetic construct
  misc_feature 1..20: note = Description of Artificial Sequence: Syntheticoligonucleotide
  source 1..20: mol_type = other DNA
ctagactctgcagagtctag

SEQ ID NO: 14115 - DNA, 20 bp, synthetic construct
  misc_feature 1..20: note = Description of Artificial Sequence: Syntheticoligonucleotide
  source 1..20: mol_type = other DNA
ttggactctgcagagtccaa

SEQ ID NO: 14116 - DNA, 20 bp, synthetic construct
  misc_feature 1..20: note = Description of Artificial Sequence: Syntheticoligonucleotide
  source 1..20: mol_type = other DNA
atggactctgcagagtccat

SEQ ID NO: 14117 - DNA, 20 bp, synthetic construct
  misc_feature 1..20: note = Description of Artificial Sequence: Syntheticoligonucleotide
  source 1..20: mol_type = other DNA
gtggactctgcagagtccac

SEQ ID NO: 14118 - DNA, 20 bp, synthetic construct
  misc_feature 1..20: note = Description of Artificial Sequence: Syntheticoligonucleotide
  source 1..20: mol_type = other DNA
ctggactctgcagagtccag

SEQ ID NO: 14119 - DNA, 20 bp, synthetic construct
  misc_feature 1..20: note = Description of Artificial Sequence: Syntheticoligonucleotide
  source 1..20: mol_type = other DNA
taggactcagctgagtccta

SEQ ID NO: 14120 - DNA, 20 bp, synthetic construct
  misc_feature 1..20: note = Description of Artificial Sequence: Syntheticoligonucleotide
  source 1..20: mol_type = other DNA
tgtgactcagctgagtcaca

SEQ ID NO: 14121 - DNA, 20 bp, synthetic construct
  misc_feature 1..20: note = Description of Artificial Sequence: Syntheticoligonucleotide
  source 1..20: mol_type = other DNA
tgagactcagctgagtctca

SEQ ID NO: 14122 - DNA, 20 bp, synthetic construct
  misc_feature 1..20: note = Description of Artificial Sequence: Syntheticoligonucleotide
  source 1..20: mol_type = other DNA
tgggactcagctgagtccca

SEQ ID NO: 14123 - DNA, 20 bp, synthetic construct
  misc_feature 1..20: note = Description of Artificial Sequence: Syntheticoligonucleotide
  source 1..20: mol_type = other DNA
tgcgactcagctgagtcgca

SEQ ID NO: 14124 - DNA, 20 bp, synthetic construct
  misc_feature 1..20: note = Description of Artificial Sequence: Syntheticoligonucleotide
  source 1..20: mol_type = other DNA
tctgactcagctgagtcaga

SEQ ID NO: 14125 - DNA, 20 bp, synthetic construct
  misc_feature 1..20: note = Description of Artificial Sequence: Syntheticoligonucleotide
  source 1..20: mol_type = other DNA
tcagactcagctgagtctga

SEQ ID NO: 14126 - DNA, 20 bp, synthetic construct
  misc_feature 1..20: note = Description of Artificial Sequence: Syntheticoligonucleotide
  source 1..20: mol_type = other DNA
tcggactcagctgagtccga

SEQ ID NO: 14127 - DNA, 20 bp, synthetic construct
  misc_feature 1..20: note = Description of Artificial Sequence: Syntheticoligonucleotide
  source 1..20: mol_type = other DNA
tccgactcagctgagtcgga

SEQ ID NO: 14128 - DNA, 20 bp, synthetic construct
  misc_feature 1..20: note = Description of Artificial Sequence: Syntheticoligonucleotide
  source 1..20: mol_type = other DNA
tttgactcagctgagtcaaa

SEQ ID NO: 14129 - DNA, 20 bp, synthetic construct
  misc_feature 1..20: note = Description of Artificial Sequence: Syntheticoligonucleotide
  source 1..20: mol_type = other DNA
ttggactcagctgagtccaa

SEQ ID NO: 14130 - DNA, 20 bp, synthetic construct
  misc_feature 1..20: note = Description of Artificial Sequence: Syntheticoligonucleotide
  source 1..20: mol_type = other DNA
taggactctcgagagtccta

SEQ ID NO: 14131 - DNA, 20 bp, synthetic construct
  misc_feature 1..20: note = Description of Artificial Sequence: Syntheticoligonucleotide
  source 1..20: mol_type = other DNA
tacgactctcgagagtcgta

SEQ ID NO: 14132 - DNA, 20 bp, synthetic construct
  misc_feature 1..20: note = Description of Artificial Sequence: Syntheticoligonucleotide
  source 1..20: mol_type = other DNA
tgtgactctcgagagtcaca

SEQ ID NO: 14133 - DNA, 20 bp, synthetic construct
  misc_feature 1..20: note = Description of Artificial Sequence: Syntheticoligonucleotide
  source 1..20: mol_type = other DNA
tgagactctcgagagtctca

SEQ ID NO: 14134 - DNA, 20 bp, synthetic construct
  misc_feature 1..20: note = Description of Artificial Sequence: Syntheticoligonucleotide
  source 1..20: mol_type = other DNA
tgggactctcgagagtccca

SEQ ID NO: 14135 - DNA, 20 bp, synthetic construct
  misc_feature 1..20: note = Description of Artificial Sequence: Syntheticoligonucleotide
  source 1..20: mol_type = other DNA
tgcgactctcgagagtcgca

SEQ ID NO: 14136 - DNA, 20 bp, synthetic construct
  misc_feature 1..20: note = Description of Artificial Sequence: Syntheticoligonucleotide
  source 1..20: mol_type = other DNA
tctgactctcgagagtcaga

SEQ ID NO: 14137 - DNA, 20 bp, synthetic construct
  misc_feature 1..20: note = Description of Artificial Sequence: Syntheticoligonucleotide
  source 1..20: mol_type = other DNA
tcagactctcgagagtctga

SEQ ID NO: 14138 - DNA, 20 bp, synthetic construct
  misc_feature 1..20: note = Description of Artificial Sequence: Syntheticoligonucleotide
  source 1..20: mol_type = other DNA
tcggactctcgagagtccga

SEQ ID NO: 14139 - DNA, 20 bp, synthetic construct
  misc_feature 1..20: note = Description of Artificial Sequence: Syntheticoligonucleotide
  source 1..20: mol_type = other DNA
tttgactctcgagagtcaaa

SEQ ID NO: 14140 - DNA, 20 bp, synthetic construct
  misc_feature 1..20: note = Description of Artificial Sequence: Syntheticoligonucleotide
  source 1..20: mol_type = other DNA
ttggactctcgagagtccaa

SEQ ID NO: 14141 - DNA, 20 bp, synthetic construct
  misc_feature 1..20: note = Description of Artificial Sequence: Syntheticoligonucleotide
  source 1..20: mol_type = other DNA
tatgactcacgtgagtcata

SEQ ID NO: 14142 - DNA, 20 bp, synthetic construct
  misc_feature 1..20: note = Description of Artificial Sequence: Syntheticoligonucleotide
  source 1..20: mol_type = other DNA
taggactcacgtgagtccta

SEQ ID NO: 14143 - DNA, 20 bp, synthetic construct
  misc_feature 1..20: note = Description of Artificial Sequence: Syntheticoligonucleotide
  source 1..20: mol_type = other DNA
tacgactcacgtgagtcgta

SEQ ID NO: 14144 - DNA, 20 bp, synthetic construct
  misc_feature 1..20: note = Description of Artificial Sequence: Syntheticoligonucleotide
  source 1..20: mol_type = other DNA
tgtgactcacgtgagtcaca

SEQ ID NO: 14145 - DNA, 20 bp, synthetic construct
  misc_feature 1..20: note = Description of Artificial Sequence: Syntheticoligonucleotide
  source 1..20: mol_type = other DNA
tgagactcacgtgagtctca

SEQ ID NO: 14146 - DNA, 20 bp, synthetic construct
  misc_feature 1..20: note = Description of Artificial Sequence: Syntheticoligonucleotide
  source 1..20: mol_type = other DNA
tgggactcacgtgagtccca

SEQ ID NO: 14147 - DNA, 20 bp, synthetic construct
  misc_feature 1..20: note = Description of Artificial Sequence: Syntheticoligonucleotide
  source 1..20: mol_type = other DNA
tgcgactcacgtgagtcgca

SEQ ID NO: 14148 - DNA, 20 bp, synthetic construct
  misc_feature 1..20: note = Description of Artificial Sequence: Syntheticoligonucleotide
  source 1..20: mol_type = other DNA
tctgactcacgtgagtcaga

SEQ ID NO: 14149 - DNA, 20 bp, synthetic construct
  misc_feature 1..20: note = Description of Artificial Sequence: Syntheticoligonucleotide
  source 1..20: mol_type = other DNA
tcagactcacgtgagtctga

SEQ ID NO: 14150 - DNA, 20 bp, synthetic construct
  misc_feature 1..20: note = Description of Artificial Sequence: Syntheticoligonucleotide
  source 1..20: mol_type = other DNA
tcggactcacgtgagtccga

SEQ ID NO: 14151 - DNA, 20 bp, synthetic construct
  misc_feature 1..20: note = Description of Artificial Sequence: Syntheticoligonucleotide
  source 1..20: mol_type = other DNA
tccgactcacgtgagtcgga

SEQ ID NO: 14152 - DNA, 20 bp, synthetic construct
  misc_feature 1..20: note = Description of Artificial Sequence: Syntheticoligonucleotide
  source 1..20: mol_type = other DNA
tttgactcacgtgagtcaaa

SEQ ID NO: 14153 - DNA, 20 bp, synthetic construct
  misc_feature 1..20: note = Description of Artificial Sequence: Syntheticoligonucleotide
  source 1..20: mol_type = other DNA
ttggactcacgtgagtccaa

SEQ ID NO: 14154 - DNA, 20 bp, synthetic construct
  misc_feature 1..20: note = Description of Artificial Sequence: Syntheticoligonucleotide
  source 1..20: mol_type = other DNA
taggactccatggagtccta

SEQ ID NO: 14155 - DNA, 20 bp, synthetic construct
  misc_feature 1..20: note = Description of Artificial Sequence: Syntheticoligonucleotide
  source 1..20: mol_type = other DNA
tacgactccatggagtcgta

SEQ ID NO: 14156 - DNA, 20 bp, synthetic construct
  misc_feature 1..20: note = Description of Artificial Sequence: Syntheticoligonucleotide
  source 1..20: mol_type = other DNA
tgtgactccatggagtcaca

SEQ ID NO: 14157 - DNA, 20 bp, synthetic construct
  misc_feature 1..20: note = Description of Artificial Sequence: Syntheticoligonucleotide
  source 1..20: mol_type = other DNA
tgagactccatggagtctca

SEQ ID NO: 14158 - DNA, 20 bp, synthetic construct
  misc_feature 1..20: note = Description of Artificial Sequence: Syntheticoligonucleotide
  source 1..20: mol_type = other DNA
tgggactccatggagtccca

SEQ ID NO: 14159 - DNA, 20 bp, synthetic construct
  misc_feature 1..20: note = Description of Artificial Sequence: Syntheticoligonucleotide
  source 1..20: mol_type = other DNA
tgcgactccatggagtcgca

SEQ ID NO: 14160 - DNA, 20 bp, synthetic construct
  misc_feature 1..20: note = Description of Artificial Sequence: Syntheticoligonucleotide
  source 1..20: mol_type = other DNA
tctgactccatggagtcaga

SEQ ID NO: 14161 - DNA, 20 bp, synthetic construct
  misc_feature 1..20: note = Description of Artificial Sequence: Syntheticoligonucleotide
  source 1..20: mol_type = other DNA
tcagactccatggagtctga

SEQ ID NO: 14162 - DNA, 20 bp, synthetic construct
  misc_feature 1..20: note = Description of Artificial Sequence: Syntheticoligonucleotide
  source 1..20: mol_type = other DNA
tcggactccatggagtccga

SEQ ID NO: 14163 - DNA, 20 bp, synthetic construct
  misc_feature 1..20: note = Description of Artificial Sequence: Syntheticoligonucleotide
  source 1..20: mol_type = other DNA
tccgactccatggagtcgga

SEQ ID NO: 14164 - DNA, 20 bp, synthetic construct
  misc_feature 1..20: note = Description of Artificial Sequence: Syntheticoligonucleotide
  source 1..20: mol_type = other DNA
tttgactccatggagtcaaa

SEQ ID NO: 14165 - DNA, 20 bp, synthetic construct
  misc_feature 1..20: note = Description of Artificial Sequence: Syntheticoligonucleotide
  source 1..20: mol_type = other DNA
ttggactccatggagtccaa

SEQ ID NO: 14166 - DNA, 20 bp, synthetic construct
  misc_feature 1..20: note = Description of Artificial Sequence: Syntheticoligonucleotide
  source 1..20: mol_type = other DNA
taggactcgtacgagtccta

SEQ ID NO: 14167 - DNA, 20 bp, synthetic construct
  misc_feature 1..20: note = Description of Artificial Sequence: Syntheticoligonucleotide
  source 1..20: mol_type = other DNA
tacgactcgtacgagtcgta

SEQ ID NO: 14168 - DNA, 20 bp, synthetic construct
  misc_feature 1..20: note = Description of Artificial Sequence: Syntheticoligonucleotide
  source 1..20: mol_type = other DNA
tgtgactcgtacgagtcaca

SEQ ID NO: 14169 - DNA, 20 bp, synthetic construct
  misc_feature 1..20: note = Description of Artificial Sequence: Syntheticoligonucleotide
  source 1..20: mol_type = other DNA
tgagactcgtacgagtctca

SEQ ID NO: 14170 - DNA, 20 bp, synthetic construct
  misc_feature 1..20: note = Description of Artificial Sequence: Syntheticoligonucleotide
  source 1..20: mol_type = other DNA
tgggactcgtacgagtccca

SEQ ID NO: 14171 - DNA, 20 bp, synthetic construct
  misc_feature 1..20: note = Description of Artificial Sequence: Syntheticoligonucleotide
  source 1..20: mol_type = other DNA
tgcgactcgtacgagtcgca

SEQ ID NO: 14172 - DNA, 20 bp, synthetic construct
  misc_feature 1..20: note = Description of Artificial Sequence: Syntheticoligonucleotide
  source 1..20: mol_type = other DNA
tctgactcgtacgagtcaga

SEQ ID NO: 14173 - DNA, 20 bp, synthetic construct
  misc_feature 1..20: note = Description of Artificial Sequence: Syntheticoligonucleotide
  source 1..20: mol_type = other DNA
tcagactcgtacgagtctga

SEQ ID NO: 14174 - DNA, 20 bp, synthetic construct
  misc_feature 1..20: note = Description of Artificial Sequence: Syntheticoligonucleotide
  source 1..20: mol_type = other DNA
tcggactcgtacgagtccga

SEQ ID NO: 14175 - DNA, 20 bp, synthetic construct
  misc_feature 1..20: note = Description of Artificial Sequence: Syntheticoligonucleotide
  source 1..20: mol_type = other DNA
tccgactcgtacgagtcgga

SEQ ID NO: 14176 - DNA, 20 bp, synthetic construct
  misc_feature 1..20: note = Description of Artificial Sequence: Syntheticoligonucleotide
  source 1..20: mol_type = other DNA
tttgactcgtacgagtcaaa

SEQ ID NO: 14177 - DNA, 20 bp, synthetic construct
  misc_feature 1..20: note = Description of Artificial Sequence: Syntheticoligonucleotide
  source 1..20: mol_type = other DNA
ttggactcgtacgagtccaa

SEQ ID NO: 14178 - DNA, 20 bp, synthetic construct
  misc_feature 1..20: note = Description of Artificial Sequence: Syntheticoligonucleotide
  source 1..20: mol_type = other DNA
taggactcctaggagtccta

SEQ ID NO: 14179 - DNA, 20 bp, synthetic construct
  misc_feature 1..20: note = Description of Artificial Sequence: Syntheticoligonucleotide
  source 1..20: mol_type = other DNA
tacgactcctaggagtcgta

SEQ ID NO: 14180 - DNA, 20 bp, synthetic construct
  misc_feature 1..20: note = Description of Artificial Sequence: Syntheticoligonucleotide
  source 1..20: mol_type = other DNA
tgtgactcctaggagtcaca

SEQ ID NO: 14181 - DNA, 20 bp, synthetic construct
  misc_feature 1..20: note = Description of Artificial Sequence: Syntheticoligonucleotide
  source 1..20: mol_type = other DNA
tgagactcctaggagtctca

SEQ ID NO: 14182 - DNA, 20 bp, synthetic construct
  misc_feature 1..20: note = Description of Artificial Sequence: Syntheticoligonucleotide
  source 1..20: mol_type = other DNA
tgggactcctaggagtccca

SEQ ID NO: 14183 - DNA, 20 bp, synthetic construct
  misc_feature 1..20: note = Description of Artificial Sequence: Syntheticoligonucleotide
  source 1..20: mol_type = other DNA
tgcgactcctaggagtcgca

SEQ ID NO: 14184 - DNA, 20 bp, synthetic construct
  misc_feature 1..20: note = Description of Artificial Sequence: Syntheticoligonucleotide
  source 1..20: mol_type = other DNA
tctgactcctaggagtcaga

SEQ ID NO: 14185 - DNA, 20 bp, synthetic construct
  misc_feature 1..20: note = Description of Artificial Sequence: Syntheticoligonucleotide
  source 1..20: mol_type = other DNA
tcagactcctaggagtctga

SEQ ID NO: 14186 - DNA, 20 bp, synthetic construct
  misc_feature 1..20: note = Description of Artificial Sequence: Syntheticoligonucleotide
  source 1..20: mol_type = other DNA
tcggactcctaggagtccga

SEQ ID NO: 14187 - DNA, 20 bp, synthetic construct
  misc_feature 1..20: note = Description of Artificial Sequence: Syntheticoligonucleotide
  source 1..20: mol_type = other DNA
tccgactcctaggagtcgga

SEQ ID NO: 14188 - DNA, 20 bp, synthetic construct
  misc_feature 1..20: note = Description of Artificial Sequence: Syntheticoligonucleotide
  source 1..20: mol_type = other DNA
tttgactcctaggagtcaaa

SEQ ID NO: 14189 - DNA, 20 bp, synthetic construct
  misc_feature 1..20: note = Description of Artificial Sequence: Syntheticoligonucleotide
  source 1..20: mol_type = other DNA
ttggactcctaggagtccaa

SEQ ID NO: 14190 - DNA, 20 bp, synthetic construct
  misc_feature 1..20: note = Description of Artificial Sequence: Syntheticoligonucleotide
  source 1..20: mol_type = other DNA
aatgactcagctgagtcatt

SEQ ID NO: 14191 - DNA, 20 bp, synthetic construct
  misc_feature 1..20: note = Description of Artificial Sequence: Syntheticoligonucleotide
  source 1..20: mol_type = other DNA
aaagactcagctgagtcttt

SEQ ID NO: 14192 - DNA, 20 bp, synthetic construct
  misc_feature 1..20: note = Description of Artificial Sequence: Syntheticoligonucleotide
  source 1..20: mol_type = other DNA
aaggactcagctgagtcctt

SEQ ID NO: 14193 - DNA, 20 bp, synthetic construct
  misc_feature 1..20: note = Description of Artificial Sequence: Syntheticoligonucleotide
  source 1..20: mol_type = other DNA
agtgactcagctgagtcact

SEQ ID NO: 14194 - DNA, 20 bp, synthetic construct
  misc_feature 1..20: note = Description of Artificial Sequence: Syntheticoligonucleotide
  source 1..20: mol_type = other DNA
agagactcagctgagtctct

SEQ ID NO: 14195 - DNA, 20 bp, synthetic construct
  misc_feature 1..20: note = Description of Artificial Sequence: Syntheticoligonucleotide
  source 1..20: mol_type = other DNA
agggactcagctgagtccct

SEQ ID NO: 14196 - DNA, 20 bp, synthetic construct
  misc_feature 1..20: note = Description of Artificial Sequence: Syntheticoligonucleotide
  source 1..20: mol_type = other DNA
agcgactcagctgagtcgct

SEQ ID NO: 14197 - DNA, 20 bp, synthetic construct
  misc_feature 1..20: note = Description of Artificial Sequence: Syntheticoligonucleotide
  source 1..20: mol_type = other DNA
actgactcagctgagtcagt

SEQ ID NO: 14198 - DNA, 20 bp, synthetic construct
  misc_feature 1..20: note = Description of Artificial Sequence: Syntheticoligonucleotide
  source 1..20: mol_type = other DNA
acagactcagctgagtctgt

SEQ ID NO: 14199 - DNA, 20 bp, synthetic construct
  misc_feature 1..20: note = Description of Artificial Sequence: Syntheticoligonucleotide
  source 1..20: mol_type = other DNA
acggactcagctgagtccgt

SEQ ID NO: 14200 - DNA, 20 bp, synthetic construct
  misc_feature 1..20: note = Description of Artificial Sequence: Syntheticoligonucleotide
  source 1..20: mol_type = other DNA
accgactcagctgagtcggt

SEQ ID NO: 14201 - DNA, 20 bp, synthetic construct
  misc_feature 1..20: note = Description of Artificial Sequence: Syntheticoligonucleotide
  source 1..20: mol_type = other DNA
attgactcagctgagtcaat

SEQ ID NO: 14202 - DNA, 20 bp, synthetic construct
  misc_feature 1..20: note = Description of Artificial Sequence: Syntheticoligonucleotide
  source 1..20: mol_type = other DNA
atggactcagctgagtccat

SEQ ID NO: 14203 - DNA, 20 bp, synthetic construct
  misc_feature 1..20: note = Description of Artificial Sequence: Syntheticoligonucleotide
  source 1..20: mol_type = other DNA
aatgactctcgagagtcatt

SEQ ID NO: 14204 - DNA, 20 bp, synthetic construct
  misc_feature 1..20: note = Description of Artificial Sequence: Syntheticoligonucleotide
  source 1..20: mol_type = other DNA
aaagactctcgagagtcttt

SEQ ID NO: 14205 - DNA, 20 bp, synthetic construct
  misc_feature 1..20: note = Description of Artificial Sequence: Syntheticoligonucleotide
  source 1..20: mol_type = other DNA
aaggactctcgagagtcctt

SEQ ID NO: 14206 - DNA, 20 bp, synthetic construct
  misc_feature 1..20: note = Description of Artificial Sequence: Syntheticoligonucleotide
  source 1..20: mol_type = other DNA
aacgactctcgagagtcgtt

SEQ ID NO: 14207 - DNA, 20 bp, synthetic construct
  misc_feature 1..20: note = Description of Artificial Sequence: Syntheticoligonucleotide
  source 1..20: mol_type = other DNA
agtgactctcgagagtcact

SEQ ID NO: 14208 - DNA, 20 bp, synthetic construct
  misc_feature 1..20: note = Description of Artificial Sequence: Syntheticoligonucleotide
  source 1..20: mol_type = other DNA
agagactctcgagagtctct

SEQ ID NO: 14209 - DNA, 20 bp, synthetic construct
  misc_feature 1..20: note = Description of Artificial Sequence: Syntheticoligonucleotide
  source 1..20: mol_type = other DNA
agggactctcgagagtccct

SEQ ID NO: 14210 - DNA, 20 bp, synthetic construct
  misc_feature 1..20: note = Description of Artificial Sequence: Syntheticoligonucleotide
  source 1..20: mol_type = other DNA
agcgactctcgagagtcgct

SEQ ID NO: 14211 - DNA, 20 bp, synthetic construct
  misc_feature 1..20: note = Description of Artificial Sequence: Syntheticoligonucleotide
  source 1..20: mol_type = other DNA
actgactctcgagagtcagt

SEQ ID NO: 14212 - DNA, 20 bp, synthetic construct
  misc_feature 1..20: note = Description of Artificial Sequence: Syntheticoligonucleotide
  source 1..20: mol_type = other DNA
acagactctcgagagtctgt

SEQ ID NO: 14213 - DNA, 20 bp, synthetic construct
  misc_feature 1..20: note = Description of Artificial Sequence: Syntheticoligonucleotide
  source 1..20: mol_type = other DNA
acggactctcgagagtccgt

SEQ ID NO: 14214 - DNA, 20 bp, synthetic construct
  misc_feature 1..20: note = Description of Artificial Sequence: Syntheticoligonucleotide
  source 1..20: mol_type = other DNA
attgactctcgagagtcaat

SEQ ID NO: 14215 - DNA, 20 bp, synthetic construct
  misc_feature 1..20: note = Description of Artificial Sequence: Syntheticoligonucleotide
  source 1..20: mol_type = other DNA
atggactctcgagagtccat

SEQ ID NO: 14216 - DNA, 20 bp, synthetic construct
  misc_feature 1..20: note = Description of Artificial Sequence: Syntheticoligonucleotide
  source 1..20: mol_type = other DNA
aatgactcacgtgagtcatt

SEQ ID NO: 14217 - DNA, 20 bp, synthetic construct
  misc_feature 1..20: note = Description of Artificial Sequence: Syntheticoligonucleotide
  source 1..20: mol_type = other DNA
aaagactcacgtgagtcttt

SEQ ID NO: 14218 - DNA, 20 bp, synthetic construct
  misc_feature 1..20: note = Description of Artificial Sequence: Syntheticoligonucleotide
  source 1..20: mol_type = other DNA
aaggactcacgtgagtcctt

SEQ ID NO: 14219 - DNA, 20 bp, synthetic construct
  misc_feature 1..20: note = Description of Artificial Sequence: Syntheticoligonucleotide
  source 1..20: mol_type = other DNA
aacgactcacgtgagtcgtt

SEQ ID NO: 14220 - DNA, 20 bp, synthetic construct
  misc_feature 1..20: note = Description of Artificial Sequence: Syntheticoligonucleotide
  source 1..20: mol_type = other DNA
agtgactcacgtgagtcact

SEQ ID NO: 14221 - DNA, 20 bp, synthetic construct
  misc_feature 1..20: note = Description of Artificial Sequence: Syntheticoligonucleotide
  source 1..20: mol_type = other DNA
agagactcacgtgagtctct

SEQ ID NO: 14222 - DNA, 20 bp, synthetic construct
  misc_feature 1..20: note = Description of Artificial Sequence: Syntheticoligonucleotide
  source 1..20: mol_type = other DNA
agggactcacgtgagtccct

SEQ ID NO: 14223 - DNA, 20 bp, synthetic construct
  misc_feature 1..20: note = Description of Artificial Sequence: Syntheticoligonucleotide
  source 1..20: mol_type = other DNA
agcgactcacgtgagtcgct

SEQ ID NO: 14224 - DNA, 20 bp, synthetic construct
  misc_feature 1..20: note = Description of Artificial Sequence: Syntheticoligonucleotide
  source 1..20: mol_type = other DNA
actgactcacgtgagtcagt

SEQ ID NO: 14225 - DNA, 20 bp, synthetic construct
  misc_feature 1..20: note = Description of Artificial Sequence: Syntheticoligonucleotide
  source 1..20: mol_type = other DNA
acagactcacgtgagtctgt

SEQ ID NO: 14226 - DNA, 20 bp, synthetic construct
  misc_feature 1..20: note = Description of Artificial Sequence: Syntheticoligonucleotide
  source 1..20: mol_type = other DNA
acggactcacgtgagtccgt

SEQ ID NO: 14227 - DNA, 20 bp, synthetic construct
  misc_feature 1..20: note = Description of Artificial Sequence: Syntheticoligonucleotide
  source 1..20: mol_type = other DNA
accgactcacgtgagtcggt

SEQ ID NO: 14228 - DNA, 20 bp, synthetic construct
  misc_feature 1..20: note = Description of Artificial Sequence: Syntheticoligonucleotide
  source 1..20: mol_type = other DNA
attgactcacgtgagtcaat

SEQ ID NO: 14229 - DNA, 20 bp, synthetic construct
  misc_feature 1..20: note = Description of Artificial Sequence: Syntheticoligonucleotide
  source 1..20: mol_type = other DNA
atggactcacgtgagtccat

SEQ ID NO: 14230 - DNA, 20 bp, synthetic construct
  misc_feature 1..20: note = Description of Artificial Sequence: Syntheticoligonucleotide
  source 1..20: mol_type = other DNA
aatgactccatggagtcatt

SEQ ID NO: 14231 - DNA, 20 bp, synthetic construct
  misc_feature 1..20: note = Description of Artificial Sequence: Syntheticoligonucleotide
  source 1..20: mol_type = other DNA
aaagactccatggagtcttt

SEQ ID NO: 14232 - DNA, 20 bp, synthetic construct
  misc_feature 1..20: note = Description of Artificial Sequence: Syntheticoligonucleotide
  source 1..20: mol_type = other DNA
aaggactccatggagtcctt

SEQ ID NO: 14233 - DNA, 20 bp, synthetic construct
  misc_feature 1..20: note = Description of Artificial Sequence: Syntheticoligonucleotide
  source 1..20: mol_type = other DNA
aacgactccatggagtcgtt

SEQ ID NO: 14234 - DNA, 20 bp, synthetic construct
  misc_feature 1..20: note = Description of Artificial Sequence: Syntheticoligonucleotide
  source 1..20: mol_type = other DNA
agtgactccatggagtcact

SEQ ID NO: 14235 - DNA, 20 bp, synthetic construct
  misc_feature 1..20: note = Description of Artificial Sequence: Syntheticoligonucleotide
  source 1..20: mol_type = other DNA
agagactccatggagtctct

SEQ ID NO: 14236 - DNA, 20 bp, synthetic construct
  misc_feature 1..20: note = Description of Artificial Sequence: Syntheticoligonucleotide
  source 1..20: mol_type = other DNA
agggactccatggagtccct

SEQ ID NO: 14237 - DNA, 20 bp, synthetic construct
  misc_feature 1..20: note = Description of Artificial Sequence: Syntheticoligonucleotide
  source 1..20: mol_type = other DNA
agcgactccatggagtcgct

SEQ ID NO: 14238 - DNA, 20 bp, synthetic construct
  misc_feature 1..20: note = Description of Artificial Sequence: Syntheticoligonucleotide
  source 1..20: mol_type = other DNA
actgactccatggagtcagt

SEQ ID NO: 14239 - DNA, 20 bp, synthetic construct
  misc_feature 1..20: note = Description of Artificial Sequence: Syntheticoligonucleotide
  source 1..20: mol_type = other DNA
acagactccatggagtctgt

SEQ ID NO: 14240 - DNA, 20 bp, synthetic construct
  misc_feature 1..20: note = Description of Artificial Sequence: Syntheticoligonucleotide
  source 1..20: mol_type = other DNA
acggactccatggagtccgt

SEQ ID NO: 14241 - DNA, 20 bp, synthetic construct
  misc_feature 1..20: note = Description of Artificial Sequence: Syntheticoligonucleotide
  source 1..20: mol_type = other DNA
accgactccatggagtcggt

SEQ ID NO: 14242 - DNA, 20 bp, synthetic construct
  misc_feature 1..20: note = Description of Artificial Sequence: Syntheticoligonucleotide
  source 1..20: mol_type = other DNA
attgactccatggagtcaat

SEQ ID NO: 14243 - DNA, 20 bp, synthetic construct
  misc_feature 1..20: note = Description of Artificial Sequence: Syntheticoligonucleotide
  source 1..20: mol_type = other DNA
atggactccatggagtccat

SEQ ID NO: 14244 - DNA, 20 bp, synthetic construct
  misc_feature 1..20: note = Description of Artificial Sequence: Syntheticoligonucleotide
  source 1..20: mol_type = other DNA
aatgactcgtacgagtcatt

SEQ ID NO: 14245 - DNA, 20 bp, synthetic construct
  misc_feature 1..20: note = Description of Artificial Sequence: Syntheticoligonucleotide
  source 1..20: mol_type = other DNA
aaagactcgtacgagtcttt

SEQ ID NO: 14246 - DNA, 20 bp, synthetic construct
  misc_feature 1..20: note = Description of Artificial Sequence: Syntheticoligonucleotide
  source 1..20: mol_type = other DNA
aaggactcgtacgagtcctt

SEQ ID NO: 14247 - DNA, 20 bp, synthetic construct
  misc_feature 1..20: note = Description of Artificial Sequence: Syntheticoligonucleotide
  source 1..20: mol_type = other DNA
aacgactcgtacgagtcgtt

SEQ ID NO: 14248 - DNA, 20 bp, synthetic construct
  misc_feature 1..20: note = Description of Artificial Sequence: Syntheticoligonucleotide
  source 1..20: mol_type = other DNA
agtgactcgtacgagtcact

SEQ ID NO: 14249 - DNA, 20 bp, synthetic construct
  misc_feature 1..20: note = Description of Artificial Sequence: Syntheticoligonucleotide
  source 1..20: mol_type = other DNA
agagactcgtacgagtctct

SEQ ID NO: 14250 - DNA, 20 bp, synthetic construct
  misc_feature 1..20: note = Description of Artificial Sequence: Syntheticoligonucleotide
  source 1..20: mol_type = other DNA
agggactcgtacgagtccct

SEQ ID NO: 14251 - DNA, 20 bp, synthetic construct
  misc_feature 1..20: note = Description of Artificial Sequence: Syntheticoligonucleotide
  source 1..20: mol_type = other DNA
agcgactcgtacgagtcgct

SEQ ID NO: 14252 - DNA, 20 bp, synthetic construct
  misc_feature 1..20: note = Description of Artificial Sequence: Syntheticoligonucleotide
  source 1..20: mol_type = other DNA
actgactcgtacgagtcagt

SEQ ID NO: 14253 - DNA, 20 bp, synthetic construct
  misc_feature 1..20: note = Description of Artificial Sequence: Syntheticoligonucleotide
  source 1..20: mol_type = other DNA
acagactcgtacgagtctgt

SEQ ID NO: 14254 - DNA, 20 bp, synthetic construct
  misc_feature 1..20: note = Description of Artificial Sequence: Syntheticoligonucleotide
  source 1..20: mol_type = other DNA
acggactcgtacgagtccgt

SEQ ID NO: 14255 - DNA, 20 bp, synthetic construct
  misc_feature 1..20: note = Description of Artificial Sequence: Syntheticoligonucleotide
  source 1..20: mol_type = other DNA
accgactcgtacgagtcggt

SEQ ID NO: 14256 - DNA, 20 bp, synthetic construct
  misc_feature 1..20: note = Description of Artificial Sequence: Syntheticoligonucleotide
  source 1..20: mol_type = other DNA
attgactcgtacgagtcaat

SEQ ID NO: 14257 - DNA, 20 bp, synthetic construct
  misc_feature 1..20: note = Description of Artificial Sequence: Syntheticoligonucleotide
  source 1..20: mol_type = other DNA
atggactcgtacgagtccat

SEQ ID NO: 14258 - DNA, 20 bp, synthetic construct
  misc_feature 1..20: note = Description of Artificial Sequence: Syntheticoligonucleotide
  source 1..20: mol_type = other DNA
aaggactcctaggagtcctt

SEQ ID NO: 14259 - DNA, 20 bp, synthetic construct
  misc_feature 1..20: note = Description of Artificial Sequence: Syntheticoligonucleotide
  source 1..20: mol_type = other DNA
aacgactcctaggagtcgtt

SEQ ID NO: 14260 - DNA, 20 bp, synthetic construct
  misc_feature 1..20: note = Description of Artificial Sequence: Syntheticoligonucleotide
  source 1..20: mol_type = other DNA
agtgactcctaggagtcact

SEQ ID NO: 14261 - DNA, 20 bp, synthetic construct
  misc_feature 1..20: note = Description of Artificial Sequence: Syntheticoligonucleotide
  source 1..20: mol_type = other DNA
agagactcctaggagtctct

SEQ ID NO: 14262 - DNA, 20 bp, synthetic construct
  misc_feature 1..20: note = Description of Artificial Sequence: Syntheticoligonucleotide
  source 1..20: mol_type = other DNA
agggactcctaggagtccct

SEQ ID NO: 14263 - DNA, 20 bp, synthetic construct
  misc_feature 1..20: note = Description of Artificial Sequence: Syntheticoligonucleotide
  source 1..20: mol_type = other DNA
agcgactcctaggagtcgct

SEQ ID NO: 14264 - DNA, 20 bp, synthetic construct
  misc_feature 1..20: note = Description of Artificial Sequence: Syntheticoligonucleotide
  source 1..20: mol_type = other DNA
actgactcctaggagtcagt

SEQ ID NO: 14265 - DNA, 20 bp, synthetic construct
  misc_feature 1..20: note = Description of Artificial Sequence: Syntheticoligonucleotide
  source 1..20: mol_type = other DNA
acagactcctaggagtctgt

SEQ ID NO: 14266 - DNA, 20 bp, synthetic construct
  misc_feature 1..20: note = Description of Artificial Sequence: Syntheticoligonucleotide
  source 1..20: mol_type = other DNA
acggactcctaggagtccgt

SEQ ID NO: 14267 - DNA, 20 bp, synthetic construct
  misc_feature 1..20: note = Description of Artificial Sequence: Syntheticoligonucleotide
  source 1..20: mol_type = other DNA
accgactcctaggagtcggt

SEQ ID NO: 14268 - DNA, 20 bp, synthetic construct
  misc_feature 1..20: note = Description of Artificial Sequence: Syntheticoligonucleotide
  source 1..20: mol_type = other DNA
atggactcctaggagtccat

SEQ ID NO: 14269 - DNA, 20 bp, synthetic construct
  misc_feature 1..20: note = Description of Artificial Sequence: Syntheticoligonucleotide
  source 1..20: mol_type = other DNA
gatgactcagctgagtcatc

SEQ ID NO: 14270 - DNA, 20 bp, synthetic construct
  misc_feature 1..20: note = Description of Artificial Sequence: Syntheticoligonucleotide
  source 1..20: mol_type = other DNA
gaagactcagctgagtcttc

SEQ ID NO: 14271 - DNA, 20 bp, synthetic construct
  misc_feature 1..20: note = Description of Artificial Sequence: Syntheticoligonucleotide
  source 1..20: mol_type = other DNA
gaggactcagctgagtcctc

SEQ ID NO: 14272 - DNA, 20 bp, synthetic construct
  misc_feature 1..20: note = Description of Artificial Sequence: Syntheticoligonucleotide
  source 1..20: mol_type = other DNA
ggtgactcagctgagtcacc

SEQ ID NO: 14273 - DNA, 20 bp, synthetic construct
  misc_feature 1..20: note = Description of Artificial Sequence: Syntheticoligonucleotide
  source 1..20: mol_type = other DNA
ggagactcagctgagtctcc

SEQ ID NO: 14274 - DNA, 20 bp, synthetic construct
  misc_feature 1..20: note = Description of Artificial Sequence: Syntheticoligonucleotide
  source 1..20: mol_type = other DNA
ggcgactcagctgagtcgcc

SEQ ID NO: 14275 - DNA, 20 bp, synthetic construct
  misc_feature 1..20: note = Description of Artificial Sequence: Syntheticoligonucleotide
  source 1..20: mol_type = other DNA
gctgactcagctgagtcagc

SEQ ID NO: 14276 - DNA, 20 bp, synthetic construct
  misc_feature 1..20: note = Description of Artificial Sequence: Syntheticoligonucleotide
  source 1..20: mol_type = other DNA
gcagactcagctgagtctgc

SEQ ID NO: 14277 - DNA, 20 bp, synthetic construct
  misc_feature 1..20: note = Description of Artificial Sequence: Syntheticoligonucleotide
  source 1..20: mol_type = other DNA
gcggactcagctgagtccgc

SEQ ID NO: 14278 - DNA, 20 bp, synthetic construct
  misc_feature 1..20: note = Description of Artificial Sequence: Syntheticoligonucleotide
  source 1..20: mol_type = other DNA
gccgactcagctgagtcggc

SEQ ID NO: 14279 - DNA, 20 bp, synthetic construct
  misc_feature 1..20: note = Description of Artificial Sequence: Syntheticoligonucleotide
  source 1..20: mol_type = other DNA
gttgactcagctgagtcaac

SEQ ID NO: 14280 - DNA, 20 bp, synthetic construct
  misc_feature 1..20: note = Description of Artificial Sequence: Syntheticoligonucleotide
  source 1..20: mol_type = other DNA
gtagactcagctgagtctac

SEQ ID NO: 14281 - DNA, 20 bp, synthetic construct
  misc_feature 1..20: note = Description of Artificial Sequence: Syntheticoligonucleotide
  source 1..20: mol_type = other DNA
gtggactcagctgagtccac

SEQ ID NO: 14282 - DNA, 20 bp, synthetic construct
  misc_feature 1..20: note = Description of Artificial Sequence: Syntheticoligonucleotide
  source 1..20: mol_type = other DNA
gatgactctcgagagtcatc

SEQ ID NO: 14283 - DNA, 20 bp, synthetic construct
  misc_feature 1..20: note = Description of Artificial Sequence: Syntheticoligonucleotide
  source 1..20: mol_type = other DNA
gaagactctcgagagtcttc

SEQ ID NO: 14284 - DNA, 20 bp, synthetic construct
  misc_feature 1..20: note = Description of Artificial Sequence: Syntheticoligonucleotide
  source 1..20: mol_type = other DNA
gaggactctcgagagtcctc

SEQ ID NO: 14285 - DNA, 20 bp, synthetic construct
  misc_feature 1..20: note = Description of Artificial Sequence: Syntheticoligonucleotide
  source 1..20: mol_type = other DNA
gacgactctcgagagtcgtc

SEQ ID NO: 14286 - DNA, 20 bp, synthetic construct
  misc_feature 1..20: note = Description of Artificial Sequence: Syntheticoligonucleotide
  source 1..20: mol_type = other DNA
ggtgactctcgagagtcacc

SEQ ID NO: 14287 - DNA, 20 bp, synthetic construct
  misc_feature 1..20: note = Description of Artificial Sequence: Syntheticoligonucleotide
  source 1..20: mol_type = other DNA
ggagactctcgagagtctcc

SEQ ID NO: 14288 - DNA, 20 bp, synthetic construct
  misc_feature 1..20: note = Description of Artificial Sequence: Syntheticoligonucleotide
  source 1..20: mol_type = other DNA
ggcgactctcgagagtcgcc

SEQ ID NO: 14289 - DNA, 20 bp, synthetic construct
  misc_feature 1..20: note = Description of Artificial Sequence: Syntheticoligonucleotide
  source 1..20: mol_type = other DNA
gctgactctcgagagtcagc

SEQ ID NO: 14290 - DNA, 20 bp, synthetic construct
  misc_feature 1..20: note = Description of Artificial Sequence: Syntheticoligonucleotide
  source 1..20: mol_type = other DNA
gcagactctcgagagtctgc

SEQ ID NO: 14291 - DNA, 20 bp, synthetic construct
  misc_feature 1..20: note = Description of Artificial Sequence: Syntheticoligonucleotide
  source 1..20: mol_type = other DNA
gcggactctcgagagtccgc

SEQ ID NO: 14292 - DNA, 20 bp, synthetic construct
  misc_feature 1..20: note = Description of Artificial Sequence: Syntheticoligonucleotide
  source 1..20: mol_type = other DNA
gttgactctcgagagtcaac

SEQ ID NO: 14293 - DNA, 20 bp, synthetic construct
  misc_feature 1..20: note = Description of Artificial Sequence: Syntheticoligonucleotide
  source 1..20: mol_type = other DNA
gtagactctcgagagtctac

SEQ ID NO: 14294 - DNA, 20 bp, synthetic construct
  misc_feature 1..20: note = Description of Artificial Sequence: Syntheticoligonucleotide
  source 1..20: mol_type = other DNA
gtggactctcgagagtccac

SEQ ID NO: 14295 - DNA, 20 bp, synthetic construct
  misc_feature 1..20: note = Description of Artificial Sequence: Syntheticoligonucleotide
  source 1..20: mol_type = other DNA
gatgactcacgtgagtcatc

SEQ ID NO: 14296 - DNA, 20 bp, synthetic construct
  misc_feature 1..20: note = Description of Artificial Sequence: Syntheticoligonucleotide
  source 1..20: mol_type = other DNA
gaagactcacgtgagtcttc

SEQ ID NO: 14297 - DNA, 20 bp, synthetic construct
  misc_feature 1..20: note = Description of Artificial Sequence: Syntheticoligonucleotide
  source 1..20: mol_type = other DNA
gaggactcacgtgagtcctc

SEQ ID NO: 14298 - DNA, 20 bp, synthetic construct
  misc_feature 1..20: note = Description of Artificial Sequence: Syntheticoligonucleotide
  source 1..20: mol_type = other DNA
gacgactcacgtgagtcgtc

SEQ ID NO: 14299 - DNA, 20 bp, synthetic construct
  misc_feature 1..20: note = Description of Artificial Sequence: Syntheticoligonucleotide
  source 1..20: mol_type = other DNA
ggtgactcacgtgagtcacc

SEQ ID NO: 14300 - DNA, 20 bp, synthetic construct
  misc_feature 1..20: note = Description of Artificial Sequence: Syntheticoligonucleotide
  source 1..20: mol_type = other DNA
ggagactcacgtgagtctcc

SEQ ID NO: 14301 - DNA, 20 bp, synthetic construct
  misc_feature 1..20: note = Description of Artificial Sequence: Syntheticoligonucleotide
  source 1..20: mol_type = other DNA
ggcgactcacgtgagtcgcc

SEQ ID NO: 14302 - DNA, 20 bp, synthetic construct
  misc_feature 1..20: note = Description of Artificial Sequence: Syntheticoligonucleotide
  source 1..20: mol_type = other DNA
gctgactcacgtgagtcagc

SEQ ID NO: 14303 - DNA, 20 bp, synthetic construct
  misc_feature 1..20: note = Description of Artificial Sequence: Syntheticoligonucleotide
  source 1..20: mol_type = other DNA
gcagactcacgtgagtctgc

SEQ ID NO: 14304 - DNA, 20 bp, synthetic construct
  misc_feature 1..20: note = Description of Artificial Sequence: Syntheticoligonucleotide
  source 1..20: mol_type = other DNA
gcggactcacgtgagtccgc

SEQ ID NO: 14305 - DNA, 20 bp, synthetic construct
  misc_feature 1..20: note = Description of Artificial Sequence: Syntheticoligonucleotide
  source 1..20: mol_type = other DNA
gccgactcacgtgagtcggc

SEQ ID NO: 14306 - DNA, 20 bp, synthetic construct
  misc_feature 1..20: note = Description of Artificial Sequence: Syntheticoligonucleotide
  source 1..20: mol_type = other DNA
gttgactcacgtgagtcaac

SEQ ID NO: 14307 - DNA, 20 bp, synthetic construct
  misc_feature 1..20: note = Description of Artificial Sequence: Syntheticoligonucleotide
  source 1..20: mol_type = other DNA
gtagactcacgtgagtctac

SEQ ID NO: 14308 - DNA, 20 bp, synthetic construct
  misc_feature 1..20: note = Description of Artificial Sequence: Syntheticoligonucleotide
  source 1..20: mol_type = other DNA
gtggactcacgtgagtccac

SEQ ID NO: 14309 - DNA, 20 bp, synthetic construct
  misc_feature 1..20: note = Description of Artificial Sequence: Syntheticoligonucleotide
  source 1..20: mol_type = other DNA
gatgactccatggagtcatc

SEQ ID NO: 14310 - DNA, 20 bp, synthetic construct
  misc_feature 1..20: note = Description of Artificial Sequence: Syntheticoligonucleotide
  source 1..20: mol_type = other DNA
gaagactccatggagtcttc

SEQ ID NO: 14311 - DNA, 20 bp, synthetic construct
  misc_feature 1..20: note = Description of Artificial Sequence: Syntheticoligonucleotide
  source 1..20: mol_type = other DNA
gaggactccatggagtcctc

SEQ ID NO: 14312 - DNA, 20 bp, synthetic construct
  misc_feature 1..20: note = Description of Artificial Sequence: Syntheticoligonucleotide
  source 1..20: mol_type = other DNA
gacgactccatggagtcgtc

SEQ ID NO: 14313 - DNA, 20 bp, synthetic construct
  misc_feature 1..20: note = Description of Artificial Sequence: Syntheticoligonucleotide
  source 1..20: mol_type = other DNA
ggtgactccatggagtcacc

SEQ ID NO: 14314 - DNA, 20 bp, synthetic construct
  misc_feature 1..20: note = Description of Artificial Sequence: Syntheticoligonucleotide
  source 1..20: mol_type = other DNA
ggagactccatggagtctcc

SEQ ID NO: 14315 - DNA, 20 bp, synthetic construct
  misc_feature 1..20: note = Description of Artificial Sequence: Syntheticoligonucleotide
  source 1..20: mol_type = other DNA
ggcgactccatggagtcgcc

SEQ ID NO: 14316 - DNA, 20 bp, synthetic construct
  misc_feature 1..20: note = Description of Artificial Sequence: Syntheticoligonucleotide
  source 1..20: mol_type = other DNA
gctgactccatggagtcagc

SEQ ID NO: 14317 - DNA, 20 bp, synthetic construct
  misc_feature 1..20: note = Description of Artificial Sequence: Syntheticoligonucleotide
  source 1..20: mol_type = other DNA
gcagactccatggagtctgc

SEQ ID NO: 14318 - DNA, 20 bp, synthetic construct
  misc_feature 1..20: note = Description of Artificial Sequence: Syntheticoligonucleotide
  source 1..20: mol_type = other DNA
gcggactccatggagtccgc

SEQ ID NO: 14319 - DNA, 20 bp, synthetic construct
  misc_feature 1..20: note = Description of Artificial Sequence: Syntheticoligonucleotide
  source 1..20: mol_type = other DNA
gccgactccatggagtcggc

SEQ ID NO: 14320 - DNA, 20 bp, synthetic construct
  misc_feature 1..20: note = Description of Artificial Sequence: Syntheticoligonucleotide
  source 1..20: mol_type = other DNA
gttgactccatggagtcaac

SEQ ID NO: 14321 - DNA, 20 bp, synthetic construct
  misc_feature 1..20: note = Description of Artificial Sequence: Syntheticoligonucleotide
  source 1..20: mol_type = other DNA
gtagactccatggagtctac

SEQ ID NO: 14322 - DNA, 20 bp, synthetic construct
  misc_feature 1..20: note = Description of Artificial Sequence: Syntheticoligonucleotide
  source 1..20: mol_type = other DNA
gtggactccatggagtccac

SEQ ID NO: 14323 - DNA, 20 bp, synthetic construct
  misc_feature 1..20: note = Description of Artificial Sequence: Syntheticoligonucleotide
  source 1..20: mol_type = other DNA
gatgactcgtacgagtcatc

SEQ ID NO: 14324 - DNA, 20 bp, synthetic construct
  misc_feature 1..20: note = Description of Artificial Sequence: Syntheticoligonucleotide
  source 1..20: mol_type = other DNA
gaagactcgtacgagtcttc

SEQ ID NO: 14325 - DNA, 20 bp, synthetic construct
  misc_feature 1..20: note = Description of Artificial Sequence: Syntheticoligonucleotide
  source 1..20: mol_type = other DNA
gaggactcgtacgagtcctc

SEQ ID NO: 14326 - DNA, 20 bp, synthetic construct
  misc_feature 1..20: note = Description of Artificial Sequence: Syntheticoligonucleotide
  source 1..20: mol_type = other DNA
gacgactcgtacgagtcgtc

SEQ ID NO: 14327 - DNA, 20 bp, synthetic construct
  misc_feature 1..20: note = Description of Artificial Sequence: Syntheticoligonucleotide
  source 1..20: mol_type = other DNA
ggtgactcgtacgagtcacc

SEQ ID NO: 14328 - DNA, 20 bp, synthetic construct
  misc_feature 1..20: note = Description of Artificial Sequence: Syntheticoligonucleotide
  source 1..20: mol_type = other DNA
ggagactcgtacgagtctcc

SEQ ID NO: 14329 - DNA, 20 bp, synthetic construct
  misc_feature 1..20: note = Description of Artificial Sequence: Syntheticoligonucleotide
  source 1..20: mol_type = other DNA
ggcgactcgtacgagtcgcc

SEQ ID NO: 14330 - DNA, 20 bp, synthetic construct
  misc_feature 1..20: note = Description of Artificial Sequence: Syntheticoligonucleotide
  source 1..20: mol_type = other DNA
gctgactcgtacgagtcagc

SEQ ID NO: 14331 - DNA, 20 bp, synthetic construct
  misc_feature 1..20: note = Description of Artificial Sequence: Syntheticoligonucleotide
  source 1..20: mol_type = other DNA
gcagactcgtacgagtctgc

SEQ ID NO: 14332 - DNA, 20 bp, synthetic construct
  misc_feature 1..20: note = Description of Artificial Sequence: Syntheticoligonucleotide
  source 1..20: mol_type = other DNA
gcggactcgtacgagtccgc

SEQ ID NO: 14333 - DNA, 20 bp, synthetic construct
  misc_feature 1..20: note = Description of Artificial Sequence: Syntheticoligonucleotide
  source 1..20: mol_type = other DNA
gccgactcgtacgagtcggc

SEQ ID NO: 14334 - DNA, 20 bp, synthetic construct
  misc_feature 1..20: note = Description of Artificial Sequence: Syntheticoligonucleotide
  source 1..20: mol_type = other DNA
gttgactcgtacgagtcaac

SEQ ID NO: 14335 - DNA, 20 bp, synthetic construct
  misc_feature 1..20: note = Description of Artificial Sequence: Syntheticoligonucleotide
  source 1..20: mol_type = other DNA
gtagactcgtacgagtctac

SEQ ID NO: 14336 - DNA, 20 bp, synthetic construct
  misc_feature 1..20: note = Description of Artificial Sequence: Syntheticoligonucleotide
  source 1..20: mol_type = other DNA
gtggactcgtacgagtccac

SEQ ID NO: 14337 - DNA, 20 bp, synthetic construct
  misc_feature 1..20: note = Description of Artificial Sequence: Syntheticoligonucleotide
  source 1..20: mol_type = other DNA
gatgactcctaggagtcatc

SEQ ID NO: 14338 - DNA, 20 bp, synthetic construct
  misc_feature 1..20: note = Description of Artificial Sequence: Syntheticoligonucleotide
  source 1..20: mol_type = other DNA
gaagactcctaggagtcttc

SEQ ID NO: 14339 - DNA, 20 bp, synthetic construct
  misc_feature 1..20: note = Description of Artificial Sequence: Syntheticoligonucleotide
  source 1..20: mol_type = other DNA
gaggactcctaggagtcctc

SEQ ID NO: 14340 - DNA, 20 bp, synthetic construct
  misc_feature 1..20: note = Description of Artificial Sequence: Syntheticoligonucleotide
  source 1..20: mol_type = other DNA
gacgactcctaggagtcgtc

SEQ ID NO: 14341 - DNA, 20 bp, synthetic construct
  misc_feature 1..20: note = Description of Artificial Sequence: Syntheticoligonucleotide
  source 1..20: mol_type = other DNA
ggtgactcctaggagtcacc

SEQ ID NO: 14342 - DNA, 20 bp, synthetic construct
  misc_feature 1..20: note = Description of Artificial Sequence: Syntheticoligonucleotide
  source 1..20: mol_type = other DNA
ggagactcctaggagtctcc

SEQ ID NO: 14343 - DNA, 20 bp, synthetic construct
  misc_feature 1..20: note = Description of Artificial Sequence: Syntheticoligonucleotide
  source 1..20: mol_type = other DNA
ggcgactcctaggagtcgcc

SEQ ID NO: 14344 - DNA, 20 bp, synthetic construct
  misc_feature 1..20: note = Description of Artificial Sequence: Syntheticoligonucleotide
  source 1..20: mol_type = other DNA
gctgactcctaggagtcagc

SEQ ID NO: 14345 - DNA, 20 bp, synthetic construct
  misc_feature 1..20: note = Description of Artificial Sequence: Syntheticoligonucleotide
  source 1..20: mol_type = other DNA
gcagactcctaggagtctgc

SEQ ID NO: 14346 - DNA, 20 bp, synthetic construct
  misc_feature 1..20: note = Description of Artificial Sequence: Syntheticoligonucleotide
  source 1..20: mol_type = other DNA
gcggactcctaggagtccgc

SEQ ID NO: 14347 - DNA, 20 bp, synthetic construct
  misc_feature 1..20: note = Description of Artificial Sequence: Syntheticoligonucleotide
  source 1..20: mol_type = other DNA
gccgactcctaggagtcggc

SEQ ID NO: 14348 - DNA, 20 bp, synthetic construct
  misc_feature 1..20: note = Description of Artificial Sequence: Syntheticoligonucleotide
  source 1..20: mol_type = other DNA
gttgactcctaggagtcaac

SEQ ID NO: 14349 - DNA, 20 bp, synthetic construct
  misc_feature 1..20: note = Description of Artificial Sequence: Syntheticoligonucleotide
  source 1..20: mol_type = other DNA
gtagactcctaggagtctac

SEQ ID NO: 14350 - DNA, 20 bp, synthetic construct
  misc_feature 1..20: note = Description of Artificial Sequence: Syntheticoligonucleotide
  source 1..20: mol_type = other DNA
gtggactcctaggagtccac

SEQ ID NO: 14351 - DNA, 20 bp, synthetic construct
  misc_feature 1..20: note = Description of Artificial Sequence: Syntheticoligonucleotide
  source 1..20: mol_type = other DNA
caagactcagctgagtcttg

SEQ ID NO: 14352 - DNA, 20 bp, synthetic construct
  misc_feature 1..20: note = Description of Artificial Sequence: Syntheticoligonucleotide
  source 1..20: mol_type = other DNA
caggactcagctgagtcctg

SEQ ID NO: 14353 - DNA, 20 bp, synthetic construct
  misc_feature 1..20: note = Description of Artificial Sequence: Syntheticoligonucleotide
  source 1..20: mol_type = other DNA
cgtgactcagctgagtcacg

SEQ ID NO: 14354 - DNA, 20 bp, synthetic construct
  misc_feature 1..20: note = Description of Artificial Sequence: Syntheticoligonucleotide
  source 1..20: mol_type = other DNA
cgagactcagctgagtctcg

SEQ ID NO: 14355 - DNA, 20 bp, synthetic construct
  misc_feature 1..20: note = Description of Artificial Sequence: Syntheticoligonucleotide
  source 1..20: mol_type = other DNA
cgggactcagctgagtcccg

SEQ ID NO: 14356 - DNA, 20 bp, synthetic construct
  misc_feature 1..20: note = Description of Artificial Sequence: Syntheticoligonucleotide
  source 1..20: mol_type = other DNA
cgcgactcagctgagtcgcg

SEQ ID NO: 14357 - DNA, 20 bp, synthetic construct
  misc_feature 1..20: note = Description of Artificial Sequence: Syntheticoligonucleotide
  source 1..20: mol_type = other DNA
cctgactcagctgagtcagg

SEQ ID NO: 14358 - DNA, 20 bp, synthetic construct
  misc_feature 1..20: note = Description of Artificial Sequence: Syntheticoligonucleotide
  source 1..20: mol_type = other DNA
ccagactcagctgagtctgg

SEQ ID NO: 14359 - DNA, 20 bp, synthetic construct
  misc_feature 1..20: note = Description of Artificial Sequence: Syntheticoligonucleotide
  source 1..20: mol_type = other DNA
ccggactcagctgagtccgg

SEQ ID NO: 14360 - DNA, 20 bp, synthetic construct
  misc_feature 1..20: note = Description of Artificial Sequence: Syntheticoligonucleotide
  source 1..20: mol_type = other DNA
cccgactcagctgagtcggg

SEQ ID NO: 14361 - DNA, 20 bp, synthetic construct
  misc_feature 1..20: note = Description of Artificial Sequence: Syntheticoligonucleotide
  source 1..20: mol_type = other DNA
cttgactcagctgagtcaag

SEQ ID NO: 14362 - DNA, 20 bp, synthetic construct
  misc_feature 1..20: note = Description of Artificial Sequence: Syntheticoligonucleotide
  source 1..20: mol_type = other DNA
ctagactcagctgagtctag

SEQ ID NO: 14363 - DNA, 20 bp, synthetic construct
  misc_feature 1..20: note = Description of Artificial Sequence: Syntheticoligonucleotide
  source 1..20: mol_type = other DNA
ctggactcagctgagtccag

SEQ ID NO: 14364 - DNA, 20 bp, synthetic construct
  misc_feature 1..20: note = Description of Artificial Sequence: Syntheticoligonucleotide
  source 1..20: mol_type = other DNA
caagactctcgagagtcttg

SEQ ID NO: 14365 - DNA, 20 bp, synthetic construct
  misc_feature 1..20: note = Description of Artificial Sequence: Syntheticoligonucleotide
  source 1..20: mol_type = other DNA
caggactctcgagagtcctg

SEQ ID NO: 14366 - DNA, 20 bp, synthetic construct
  misc_feature 1..20: note = Description of Artificial Sequence: Syntheticoligonucleotide
  source 1..20: mol_type = other DNA
cacgactctcgagagtcgtg

SEQ ID NO: 14367 - DNA, 20 bp, synthetic construct
  misc_feature 1..20: note = Description of Artificial Sequence: Syntheticoligonucleotide
  source 1..20: mol_type = other DNA
cgtgactctcgagagtcacg

SEQ ID NO: 14368 - DNA, 20 bp, synthetic construct
  misc_feature 1..20: note = Description of Artificial Sequence: Syntheticoligonucleotide
  source 1..20: mol_type = other DNA
cgagactctcgagagtctcg

SEQ ID NO: 14369 - DNA, 20 bp, synthetic construct
  misc_feature 1..20: note = Description of Artificial Sequence: Syntheticoligonucleotide
  source 1..20: mol_type = other DNA
cgggactctcgagagtcccg

SEQ ID NO: 14370 - DNA, 20 bp, synthetic construct
  misc_feature 1..20: note = Description of Artificial Sequence: Syntheticoligonucleotide
  source 1..20: mol_type = other DNA
cgcgactctcgagagtcgcg

SEQ ID NO: 14371 - DNA, 20 bp, synthetic construct
  misc_feature 1..20: note = Description of Artificial Sequence: Syntheticoligonucleotide
  source 1..20: mol_type = other DNA
cctgactctcgagagtcagg

SEQ ID NO: 14372 - DNA, 20 bp, synthetic construct
  misc_feature 1..20: note = Description of Artificial Sequence: Syntheticoligonucleotide
  source 1..20: mol_type = other DNA
ccagactctcgagagtctgg

SEQ ID NO: 14373 - DNA, 20 bp, synthetic construct
  misc_feature 1..20: note = Description of Artificial Sequence: Syntheticoligonucleotide
  source 1..20: mol_type = other DNA
ccggactctcgagagtccgg

SEQ ID NO: 14374 - DNA, 20 bp, synthetic construct
  misc_feature 1..20: note = Description of Artificial Sequence: Syntheticoligonucleotide
  source 1..20: mol_type = other DNA
cttgactctcgagagtcaag

SEQ ID NO: 14375 - DNA, 20 bp, synthetic construct
  misc_feature 1..20: note = Description of Artificial Sequence: Syntheticoligonucleotide
  source 1..20: mol_type = other DNA
ctagactctcgagagtctag

SEQ ID NO: 14376 - DNA, 20 bp, synthetic construct
  misc_feature 1..20: note = Description of Artificial Sequence: Syntheticoligonucleotide
  source 1..20: mol_type = other DNA
ctggactctcgagagtccag

SEQ ID NO: 14377 - DNA, 20 bp, synthetic construct
  misc_feature 1..20: note = Description of Artificial Sequence: Syntheticoligonucleotide
  source 1..20: mol_type = other DNA
caagactcacgtgagtcttg

SEQ ID NO: 14378 - DNA, 20 bp, synthetic construct
  misc_feature 1..20: note = Description of Artificial Sequence: Syntheticoligonucleotide
  source 1..20: mol_type = other DNA
caggactcacgtgagtcctg

SEQ ID NO: 14379 - DNA, 20 bp, synthetic construct
  misc_feature 1..20: note = Description of Artificial Sequence: Syntheticoligonucleotide
  source 1..20: mol_type = other DNA
cacgactcacgtgagtcgtg

SEQ ID NO: 14380 - DNA, 20 bp, synthetic construct
  misc_feature 1..20: note = Description of Artificial Sequence: Syntheticoligonucleotide
  source 1..20: mol_type = other DNA
cgtgactcacgtgagtcacg

SEQ ID NO: 14381 - DNA, 20 bp, synthetic construct
  misc_feature 1..20: note = Description of Artificial Sequence: Syntheticoligonucleotide
  source 1..20: mol_type = other DNA
cgagactcacgtgagtctcg

SEQ ID NO: 14382 - DNA, 20 bp, synthetic construct
  misc_feature 1..20: note = Description of Artificial Sequence: Syntheticoligonucleotide
  source 1..20: mol_type = other DNA
cgggactcacgtgagtcccg

SEQ ID NO: 14383 - DNA, 20 bp, synthetic construct
  misc_feature 1..20: note = Description of Artificial Sequence: Syntheticoligonucleotide
  source 1..20: mol_type = other DNA
cgcgactcacgtgagtcgcg

SEQ ID NO: 14384 - DNA, 20 bp, synthetic construct
  misc_feature 1..20: note = Description of Artificial Sequence: Syntheticoligonucleotide
  source 1..20: mol_type = other DNA
cctgactcacgtgagtcagg

SEQ ID NO: 14385 - DNA, 20 bp, synthetic construct
  misc_feature 1..20: note = Description of Artificial Sequence: Syntheticoligonucleotide
  source 1..20: mol_type = other DNA
ccagactcacgtgagtctgg

SEQ ID NO: 14386 - DNA, 20 bp, synthetic construct
  misc_feature 1..20: note = Description of Artificial Sequence: Syntheticoligonucleotide
  source 1..20: mol_type = other DNA
ccggactcacgtgagtccgg

SEQ ID NO: 14387 - DNA, 20 bp, synthetic construct
  misc_feature 1..20: note = Description of Artificial Sequence: Syntheticoligonucleotide
  source 1..20: mol_type = other DNA
cccgactcacgtgagtcggg

SEQ ID NO: 14388 - DNA, 20 bp, synthetic construct
  misc_feature 1..20: note = Description of Artificial Sequence: Syntheticoligonucleotide
  source 1..20: mol_type = other DNA
cttgactcacgtgagtcaag

SEQ ID NO: 14389 - DNA, 20 bp, synthetic construct
  misc_feature 1..20: note = Description of Artificial Sequence: Syntheticoligonucleotide
  source 1..20: mol_type = other DNA
ctagactcacgtgagtctag

SEQ ID NO: 14390 - DNA, 20 bp, synthetic construct
  misc_feature 1..20: note = Description of Artificial Sequence: Syntheticoligonucleotide
  source 1..20: mol_type = other DNA
ctggactcacgtgagtccag

SEQ ID NO: 14391 - DNA, 20 bp, synthetic construct
  misc_feature 1..20: note = Description of Artificial Sequence: Syntheticoligonucleotide
  source 1..20: mol_type = other DNA
caagactccatggagtcttg

SEQ ID NO: 14392 - DNA, 20 bp, synthetic construct
  misc_feature 1..20: note = Description of Artificial Sequence: Syntheticoligonucleotide
  source 1..20: mol_type = other DNA
caggactccatggagtcctg

SEQ ID NO: 14393 - DNA, 20 bp, synthetic construct
  misc_feature 1..20: note = Description of Artificial Sequence: Syntheticoligonucleotide
  source 1..20: mol_type = other DNA
cacgactccatggagtcgtg

SEQ ID NO: 14394 - DNA, 20 bp, synthetic construct
  misc_feature 1..20: note = Description of Artificial Sequence: Syntheticoligonucleotide
  source 1..20: mol_type = other DNA
cgtgactccatggagtcacg

SEQ ID NO: 14395 - DNA, 20 bp, synthetic construct
  misc_feature 1..20: note = Description of Artificial Sequence: Syntheticoligonucleotide
  source 1..20: mol_type = other DNA
cgagactccatggagtctcg

SEQ ID NO: 14396 - DNA, 20 bp, synthetic construct
  misc_feature 1..20: note = Description of Artificial Sequence: Syntheticoligonucleotide
  source 1..20: mol_type = other DNA
cgggactccatggagtcccg

SEQ ID NO: 14397 - DNA, 20 bp, synthetic construct
  misc_feature 1..20: note = Description of Artificial Sequence: Syntheticoligonucleotide
  source 1..20: mol_type = other DNA
cgcgactccatggagtcgcg

SEQ ID NO: 14398 - DNA, 20 bp, synthetic construct
  misc_feature 1..20: note = Description of Artificial Sequence: Syntheticoligonucleotide
  source 1..20: mol_type = other DNA
cctgactccatggagtcagg

SEQ ID NO: 14399 - DNA, 20 bp, synthetic construct
  misc_feature 1..20: note = Description of Artificial Sequence: Syntheticoligonucleotide
  source 1..20: mol_type = other DNA
ccagactccatggagtctgg

SEQ ID NO: 14400 - DNA, 20 bp, synthetic construct
  misc_feature 1..20: note = Description of Artificial Sequence: Syntheticoligonucleotide
  source 1..20: mol_type = other DNA
ccggactccatggagtccgg

SEQ ID NO: 14401 - DNA, 20 bp, synthetic construct
  misc_feature 1..20: note = Description of Artificial Sequence: Syntheticoligonucleotide
  source 1..20: mol_type = other DNA
cccgactccatggagtcggg

SEQ ID NO: 14402 - DNA, 20 bp, synthetic construct
  misc_feature 1..20: note = Description of Artificial Sequence: Syntheticoligonucleotide
  source 1..20: mol_type = other DNA
cttgactccatggagtcaag

SEQ ID NO: 14403 - DNA, 20 bp, synthetic construct
  misc_feature 1..20: note = Description of Artificial Sequence: Syntheticoligonucleotide
  source 1..20: mol_type = other DNA
ctagactccatggagtctag

SEQ ID NO: 14404 - DNA, 20 bp, synthetic construct
  misc_feature 1..20: note = Description of Artificial Sequence: Syntheticoligonucleotide
  source 1..20: mol_type = other DNA
ctggactccatggagtccag

SEQ ID NO: 14405 - DNA, 20 bp, synthetic construct
  misc_feature 1..20: note = Description of Artificial Sequence: Syntheticoligonucleotide
  source 1..20: mol_type = other DNA
caagactcgtacgagtcttg

SEQ ID NO: 14406 - DNA, 20 bp, synthetic construct
  misc_feature 1..20: note = Description of Artificial Sequence: Syntheticoligonucleotide
  source 1..20: mol_type = other DNA
caggactcgtacgagtcctg

SEQ ID NO: 14407 - DNA, 20 bp, synthetic construct
  misc_feature 1..20: note = Description of Artificial Sequence: Syntheticoligonucleotide
  source 1..20: mol_type = other DNA
cacgactcgtacgagtcgtg

SEQ ID NO: 14408 - DNA, 20 bp, synthetic construct
  misc_feature 1..20: note = Description of Artificial Sequence: Syntheticoligonucleotide
  source 1..20: mol_type = other DNA
cgtgactcgtacgagtcacg

SEQ ID NO: 14409 - DNA, 20 bp, synthetic construct
  misc_feature 1..20: note = Description of Artificial Sequence: Syntheticoligonucleotide
  source 1..20: mol_type = other DNA
cgagactcgtacgagtctcg

SEQ ID NO: 14410 - DNA, 20 bp, synthetic construct
  misc_feature 1..20: note = Description of Artificial Sequence: Syntheticoligonucleotide
  source 1..20: mol_type = other DNA
cgggactcgtacgagtcccg

SEQ ID NO: 14411 - DNA, 20 bp, synthetic construct
  misc_feature 1..20: note = Description of Artificial Sequence: Syntheticoligonucleotide
  source 1..20: mol_type = other DNA
cgcgactcgtacgagtcgcg

SEQ ID NO: 14412 - DNA, 20 bp, synthetic construct
  misc_feature 1..20: note = Description of Artificial Sequence: Syntheticoligonucleotide
  source 1..20: mol_type = other DNA
cctgactcgtacgagtcagg

SEQ ID NO: 14413 - DNA, 20 bp, synthetic construct
  misc_feature 1..20: note = Description of Artificial Sequence: Syntheticoligonucleotide
  source 1..20: mol_type = other DNA
ccagactcgtacgagtctgg

SEQ ID NO: 14414 - DNA, 20 bp, synthetic construct
  misc_feature 1..20: note = Description of Artificial Sequence: Syntheticoligonucleotide
  source 1..20: mol_type = other DNA
ccggactcgtacgagtccgg

SEQ ID NO: 14415 - DNA, 20 bp, synthetic construct
  misc_feature 1..20: note = Description of Artificial Sequence: Syntheticoligonucleotide
  source 1..20: mol_type = other DNA
cccgactcgtacgagtcggg

SEQ ID NO: 14416 - DNA, 20 bp, synthetic construct
  misc_feature 1..20: note = Description of Artificial Sequence: Syntheticoligonucleotide
  source 1..20: mol_type = other DNA
cttgactcgtacgagtcaag

SEQ ID NO: 14417 - DNA, 20 bp, synthetic construct
  misc_feature 1..20: note = Description of Artificial Sequence: Syntheticoligonucleotide
  source 1..20: mol_type = other DNA
ctagactcgtacgagtctag

SEQ ID NO: 14418 - DNA, 20 bp, synthetic construct
  misc_feature 1..20: note = Description of Artificial Sequence: Syntheticoligonucleotide
  source 1..20: mol_type = other DNA
ctggactcgtacgagtccag

SEQ ID NO: 14419 - DNA, 20 bp, synthetic construct
  misc_feature 1..20: note = Description of Artificial Sequence: Syntheticoligonucleotide
  source 1..20: mol_type = other DNA
caagactcctaggagtcttg

SEQ ID NO: 14420 - DNA, 20 bp, synthetic construct
  misc_feature 1..20: note = Description of Artificial Sequence: Syntheticoligonucleotide
  source 1..20: mol_type = other DNA
caggactcctaggagtcctg

SEQ ID NO: 14421 - DNA, 20 bp, synthetic construct
  misc_feature 1..20: note = Description of Artificial Sequence: Syntheticoligonucleotide
  source 1..20: mol_type = other DNA
cacgactcctaggagtcgtg

SEQ ID NO: 14422 - DNA, 20 bp, synthetic construct
  misc_feature 1..20: note = Description of Artificial Sequence: Syntheticoligonucleotide
  source 1..20: mol_type = other DNA
cgtgactcctaggagtcacg

SEQ ID NO: 14423 - DNA, 20 bp, synthetic construct
  misc_feature 1..20: note = Description of Artificial Sequence: Syntheticoligonucleotide
  source 1..20: mol_type = other DNA
cgagactcctaggagtctcg

SEQ ID NO: 14424 - DNA, 20 bp, synthetic construct
  misc_feature 1..20: note = Description of Artificial Sequence: Syntheticoligonucleotide
  source 1..20: mol_type = other DNA
cgggactcctaggagtcccg

SEQ ID NO: 14425 - DNA, 20 bp, synthetic construct
  misc_feature 1..20: note = Description of Artificial Sequence: Syntheticoligonucleotide
  source 1..20: mol_type = other DNA
cgcgactcctaggagtcgcg

SEQ ID NO: 14426 - DNA, 20 bp, synthetic construct
  misc_feature 1..20: note = Description of Artificial Sequence: Syntheticoligonucleotide
  source 1..20: mol_type = other DNA
cctgactcctaggagtcagg

SEQ ID NO: 14427 - DNA, 20 bp, synthetic construct
  misc_feature 1..20: note = Description of Artificial Sequence: Syntheticoligonucleotide
  source 1..20: mol_type = other DNA
ccagactcctaggagtctgg

SEQ ID NO: 14428 - DNA, 20 bp, synthetic construct
  misc_feature 1..20: note = Description of Artificial Sequence: Syntheticoligonucleotide
  source 1..20: mol_type = other DNA
ccggactcctaggagtccgg

SEQ ID NO: 14429 - DNA, 20 bp, synthetic construct
  misc_feature 1..20: note = Description of Artificial Sequence: Syntheticoligonucleotide
  source 1..20: mol_type = other DNA
cccgactcctaggagtcggg

SEQ ID NO: 14430 - DNA, 20 bp, synthetic construct
  misc_feature 1..20: note = Description of Artificial Sequence: Syntheticoligonucleotide
  source 1..20: mol_type = other DNA
cttgactcctaggagtcaag

SEQ ID NO: 14431 - DNA, 20 bp, synthetic construct
  misc_feature 1..20: note = Description of Artificial Sequence: Syntheticoligonucleotide
  source 1..20: mol_type = other DNA
ctagactcctaggagtctag

SEQ ID NO: 14432 - DNA, 20 bp, synthetic construct
  misc_feature 1..20: note = Description of Artificial Sequence: Syntheticoligonucleotide
  source 1..20: mol_type = other DNA
ctggactcctaggagtccag

SEQ ID NO: 14433 - DNA, 18 bp, synthetic construct
  misc_feature 1..18: note = Description of Artificial Sequence: Syntheticoligonucleotide
  source 1..18: mol_type = other DNA
atgactccgcggagtcat

SEQ ID NO: 14434 - DNA, 18 bp, synthetic construct
  misc_feature 1..18: note = Description of Artificial Sequence: Syntheticoligonucleotide
  source 1..18: mol_type = other DNA
aagactccgcggagtctt

SEQ ID NO: 14435 - DNA, 18 bp, synthetic construct
  misc_feature 1..18: note = Description of Artificial Sequence: Syntheticoligonucleotide
  source 1..18: mol_type = other DNA
aggactccgcggagtcct

SEQ ID NO: 14436 - DNA, 18 bp, synthetic construct
  misc_feature 1..18: note = Description of Artificial Sequence: Syntheticoligonucleotide
  source 1..18: mol_type = other DNA
acgactccgcggagtcgt

SEQ ID NO: 14437 - DNA, 18 bp, synthetic construct
  misc_feature 1..18: note = Description of Artificial Sequence: Syntheticoligonucleotide
  source 1..18: mol_type = other DNA
gtgactccgcggagtcac

SEQ ID NO: 14438 - DNA, 18 bp, synthetic construct
  misc_feature 1..18: note = Description of Artificial Sequence: Syntheticoligonucleotide
  source 1..18: mol_type = other DNA
gagactccgcggagtctc

SEQ ID NO: 14439 - DNA, 18 bp, synthetic construct
  misc_feature 1..18: note = Description of Artificial Sequence: Syntheticoligonucleotide
  source 1..18: mol_type = other DNA
gggactccgcggagtccc

SEQ ID NO: 14440 - DNA, 18 bp, synthetic construct
  misc_feature 1..18: note = Description of Artificial Sequence: Syntheticoligonucleotide
  source 1..18: mol_type = other DNA
gcgactccgcggagtcgc

SEQ ID NO: 14441 - DNA, 18 bp, synthetic construct
  misc_feature 1..18: note = Description of Artificial Sequence: Syntheticoligonucleotide
  source 1..18: mol_type = other DNA
ctgactccgcggagtcag

SEQ ID NO: 14442 - DNA, 18 bp, synthetic construct
  misc_feature 1..18: note = Description of Artificial Sequence: Syntheticoligonucleotide
  source 1..18: mol_type = other DNA
cagactccgcggagtctg

SEQ ID NO: 14443 - DNA, 18 bp, synthetic construct
  misc_feature 1..18: note = Description of Artificial Sequence: Syntheticoligonucleotide
  source 1..18: mol_type = other DNA
cggactccgcggagtccg

SEQ ID NO: 14444 - DNA, 18 bp, synthetic construct
  misc_feature 1..18: note = Description of Artificial Sequence: Syntheticoligonucleotide
  source 1..18: mol_type = other DNA
ccgactccgcggagtcgg

SEQ ID NO: 14445 - DNA, 18 bp, synthetic construct
  misc_feature 1..18: note = Description of Artificial Sequence: Syntheticoligonucleotide
  source 1..18: mol_type = other DNA
ttgactccgcggagtcaa

SEQ ID NO: 14446 - DNA, 18 bp, synthetic construct
  misc_feature 1..18: note = Description of Artificial Sequence: Syntheticoligonucleotide
  source 1..18: mol_type = other DNA
tagactccgcggagtcta

SEQ ID NO: 14447 - DNA, 18 bp, synthetic construct
  misc_feature 1..18: note = Description of Artificial Sequence: Syntheticoligonucleotide
  source 1..18: mol_type = other DNA
tggactccgcggagtcca

SEQ ID NO: 14448 - DNA, 18 bp, synthetic construct
  misc_feature 1..18: note = Description of Artificial Sequence: Syntheticoligonucleotide
  source 1..18: mol_type = other DNA
atgactcccgggagtcat

SEQ ID NO: 14449 - DNA, 18 bp, synthetic construct
  misc_feature 1..18: note = Description of Artificial Sequence: Syntheticoligonucleotide
  source 1..18: mol_type = other DNA
aagactcccgggagtctt

SEQ ID NO: 14450 - DNA, 18 bp, synthetic construct
  misc_feature 1..18: note = Description of Artificial Sequence: Syntheticoligonucleotide
  source 1..18: mol_type = other DNA
aggactcccgggagtcct

SEQ ID NO: 14451 - DNA, 18 bp, synthetic construct
  misc_feature 1..18: note = Description of Artificial Sequence: Syntheticoligonucleotide
  source 1..18: mol_type = other DNA
acgactcccgggagtcgt

SEQ ID NO: 14452 - DNA, 18 bp, synthetic construct
  misc_feature 1..18: note = Description of Artificial Sequence: Syntheticoligonucleotide
  source 1..18: mol_type = other DNA
gtgactcccgggagtcac

SEQ ID NO: 14453 - DNA, 18 bp, synthetic construct
  misc_feature 1..18: note = Description of Artificial Sequence: Syntheticoligonucleotide
  source 1..18: mol_type = other DNA
gagactcccgggagtctc

SEQ ID NO: 14454 - DNA, 18 bp, synthetic construct
  misc_feature 1..18: note = Description of Artificial Sequence: Syntheticoligonucleotide
  source 1..18: mol_type = other DNA
gggactcccgggagtccc

SEQ ID NO: 14455 - DNA, 18 bp, synthetic construct
  misc_feature 1..18: note = Description of Artificial Sequence: Syntheticoligonucleotide
  source 1..18: mol_type = other DNA
gcgactcccgggagtcgc

SEQ ID NO: 14456 - DNA, 18 bp, synthetic construct
  misc_feature 1..18: note = Description of Artificial Sequence: Syntheticoligonucleotide
  source 1..18: mol_type = other DNA
ctgactcccgggagtcag

SEQ ID NO: 14457 - DNA, 18 bp, synthetic construct
  misc_feature 1..18: note = Description of Artificial Sequence: Syntheticoligonucleotide
  source 1..18: mol_type = other DNA
cagactcccgggagtctg

SEQ ID NO: 14458 - DNA, 18 bp, synthetic construct
  misc_feature 1..18: note = Description of Artificial Sequence: Syntheticoligonucleotide
  source 1..18: mol_type = other DNA
cggactcccgggagtccg

SEQ ID NO: 14459 - DNA, 18 bp, synthetic construct
  misc_feature 1..18: note = Description of Artificial Sequence: Syntheticoligonucleotide
  source 1..18: mol_type = other DNA
ccgactcccgggagtcgg

SEQ ID NO: 14460 - DNA, 18 bp, synthetic construct
  misc_feature 1..18: note = Description of Artificial Sequence: Syntheticoligonucleotide
  source 1..18: mol_type = other DNA
ttgactcccgggagtcaa

SEQ ID NO: 14461 - DNA, 18 bp, synthetic construct
  misc_feature 1..18: note = Description of Artificial Sequence: Syntheticoligonucleotide
  source 1..18: mol_type = other DNA
tagactcccgggagtcta

SEQ ID NO: 14462 - DNA, 18 bp, synthetic construct
  misc_feature 1..18: note = Description of Artificial Sequence: Syntheticoligonucleotide
  source 1..18: mol_type = other DNA
tggactcccgggagtcca

SEQ ID NO: 14463 - DNA, 18 bp, synthetic construct
  misc_feature 1..18: note = Description of Artificial Sequence: Syntheticoligonucleotide
  source 1..18: mol_type = other DNA
atgactcggccgagtcat

SEQ ID NO: 14464 - DNA, 18 bp, synthetic construct
  misc_feature 1..18: note = Description of Artificial Sequence: Syntheticoligonucleotide
  source 1..18: mol_type = other DNA
aagactcggccgagtctt

SEQ ID NO: 14465 - DNA, 18 bp, synthetic construct
  misc_feature 1..18: note = Description of Artificial Sequence: Syntheticoligonucleotide
  source 1..18: mol_type = other DNA
aggactcggccgagtcct

SEQ ID NO: 14466 - DNA, 18 bp, synthetic construct
  misc_feature 1..18: note = Description of Artificial Sequence: Syntheticoligonucleotide
  source 1..18: mol_type = other DNA
acgactcggccgagtcgt

SEQ ID NO: 14467 - DNA, 18 bp, synthetic construct
  misc_feature 1..18: note = Description of Artificial Sequence: Syntheticoligonucleotide
  source 1..18: mol_type = other DNA
gtgactcggccgagtcac

SEQ ID NO: 14468 - DNA, 18 bp, synthetic construct
  misc_feature 1..18: note = Description of Artificial Sequence: Syntheticoligonucleotide
  source 1..18: mol_type = other DNA
gagactcggccgagtctc

SEQ ID NO: 14469 - DNA, 18 bp, synthetic construct
  misc_feature 1..18: note = Description of Artificial Sequence: Syntheticoligonucleotide
  source 1..18: mol_type = other DNA
gggactcggccgagtccc

SEQ ID NO: 14470 - DNA, 18 bp, synthetic construct
  misc_feature 1..18: note = Description of Artificial Sequence: Syntheticoligonucleotide
  source 1..18: mol_type = other DNA
gcgactcggccgagtcgc

SEQ ID NO: 14471 - DNA, 18 bp, synthetic construct
  misc_feature 1..18: note = Description of Artificial Sequence: Syntheticoligonucleotide
  source 1..18: mol_type = other DNA
ctgactcggccgagtcag

SEQ ID NO: 14472 - DNA, 18 bp, synthetic construct
  misc_feature 1..18: note = Description of Artificial Sequence: Syntheticoligonucleotide
  source 1..18: mol_type = other DNA
cagactcggccgagtctg

SEQ ID NO: 14473 - DNA, 18 bp, synthetic construct
  misc_feature 1..18: note = Description of Artificial Sequence: Syntheticoligonucleotide
  source 1..18: mol_type = other DNA
cggactcggccgagtccg

SEQ ID NO: 14474 - DNA, 18 bp, synthetic construct
  misc_feature 1..18: note = Description of Artificial Sequence: Syntheticoligonucleotide
  source 1..18: mol_type = other DNA
ccgactcggccgagtcgg

SEQ ID NO: 14475 - DNA, 18 bp, synthetic construct
  misc_feature 1..18: note = Description of Artificial Sequence: Syntheticoligonucleotide
  source 1..18: mol_type = other DNA
ttgactcggccgagtcaa

SEQ ID NO: 14476 - DNA, 18 bp, synthetic construct
  misc_feature 1..18: note = Description of Artificial Sequence: Syntheticoligonucleotide
  source 1..18: mol_type = other DNA
tagactcggccgagtcta

SEQ ID NO: 14477 - DNA, 18 bp, synthetic construct
  misc_feature 1..18: note = Description of Artificial Sequence: Syntheticoligonucleotide
  source 1..18: mol_type = other DNA
tggactcggccgagtcca

SEQ ID NO: 14478 - DNA, 18 bp, synthetic construct
  misc_feature 1..18: note = Description of Artificial Sequence: Syntheticoligonucleotide
  source 1..18: mol_type = other DNA
atgactcgcgcgagtcat

SEQ ID NO: 14479 - DNA, 18 bp, synthetic construct
  misc_feature 1..18: note = Description of Artificial Sequence: Syntheticoligonucleotide
  source 1..18: mol_type = other DNA
aagactcgcgcgagtctt

SEQ ID NO: 14480 - DNA, 18 bp, synthetic construct
  misc_feature 1..18: note = Description of Artificial Sequence: Syntheticoligonucleotide
  source 1..18: mol_type = other DNA
aggactcgcgcgagtcct

SEQ ID NO: 14481 - DNA, 18 bp, synthetic construct
  misc_feature 1..18: note = Description of Artificial Sequence: Syntheticoligonucleotide
  source 1..18: mol_type = other DNA
acgactcgcgcgagtcgt

SEQ ID NO: 14482 - DNA, 18 bp, synthetic construct
  misc_feature 1..18: note = Description of Artificial Sequence: Syntheticoligonucleotide
  source 1..18: mol_type = other DNA
gtgactcgcgcgagtcac

SEQ ID NO: 14483 - DNA, 18 bp, synthetic construct
  misc_feature 1..18: note = Description of Artificial Sequence: Syntheticoligonucleotide
  source 1..18: mol_type = other DNA
gagactcgcgcgagtctc

SEQ ID NO: 14484 - DNA, 18 bp, synthetic construct
  misc_feature 1..18: note = Description of Artificial Sequence: Syntheticoligonucleotide
  source 1..18: mol_type = other DNA
gggactcgcgcgagtccc

SEQ ID NO: 14485 - DNA, 18 bp, synthetic construct
  misc_feature 1..18: note = Description of Artificial Sequence: Syntheticoligonucleotide
  source 1..18: mol_type = other DNA
gcgactcgcgcgagtcgc

SEQ ID NO: 14486 - DNA, 18 bp, synthetic construct
  misc_feature 1..18: note = Description of Artificial Sequence: Syntheticoligonucleotide
  source 1..18: mol_type = other DNA
ctgactcgcgcgagtcag

SEQ ID NO: 14487 - DNA, 18 bp, synthetic construct
  misc_feature 1..18: note = Description of Artificial Sequence: Syntheticoligonucleotide
  source 1..18: mol_type = other DNA
cagactcgcgcgagtctg

SEQ ID NO: 14488 - DNA, 18 bp, synthetic construct
  misc_feature 1..18: note = Description of Artificial Sequence: Syntheticoligonucleotide
  source 1..18: mol_type = other DNA
cggactcgcgcgagtccg

SEQ ID NO: 14489 - DNA, 18 bp, synthetic construct
  misc_feature 1..18: note = Description of Artificial Sequence: Syntheticoligonucleotide
  source 1..18: mol_type = other DNA
ccgactcgcgcgagtcgg

SEQ ID NO: 14490 - DNA, 18 bp, synthetic construct
  misc_feature 1..18: note = Description of Artificial Sequence: Syntheticoligonucleotide
  source 1..18: mol_type = other DNA
ttgactcgcgcgagtcaa

SEQ ID NO: 14491 - DNA, 18 bp, synthetic construct
  misc_feature 1..18: note = Description of Artificial Sequence: Syntheticoligonucleotide
  source 1..18: mol_type = other DNA
tagactcgcgcgagtcta

SEQ ID NO: 14492 - DNA, 18 bp, synthetic construct
  misc_feature 1..18: note = Description of Artificial Sequence: Syntheticoligonucleotide
  source 1..18: mol_type = other DNA
tggactcgcgcgagtcca

SEQ ID NO: 14493 - DNA, 18 bp, synthetic construct
  misc_feature 1..18: note = Description of Artificial Sequence: Syntheticoligonucleotide
  source 1..18: mol_type = other DNA
aggactctgcagagtcct

SEQ ID NO: 14494 - DNA, 18 bp, synthetic construct
  misc_feature 1..18: note = Description of Artificial Sequence: Syntheticoligonucleotide
  source 1..18: mol_type = other DNA
acgactctgcagagtcgt

SEQ ID NO: 14495 - DNA, 18 bp, synthetic construct
  misc_feature 1..18: note = Description of Artificial Sequence: Syntheticoligonucleotide
  source 1..18: mol_type = other DNA
gtgactctgcagagtcac

SEQ ID NO: 14496 - DNA, 18 bp, synthetic construct
  misc_feature 1..18: note = Description of Artificial Sequence: Syntheticoligonucleotide
  source 1..18: mol_type = other DNA
gagactctgcagagtctc

SEQ ID NO: 14497 - DNA, 18 bp, synthetic construct
  misc_feature 1..18: note = Description of Artificial Sequence: Syntheticoligonucleotide
  source 1..18: mol_type = other DNA
gggactctgcagagtccc

SEQ ID NO: 14498 - DNA, 18 bp, synthetic construct
  misc_feature 1..18: note = Description of Artificial Sequence: Syntheticoligonucleotide
  source 1..18: mol_type = other DNA
gcgactctgcagagtcgc

SEQ ID NO: 14499 - DNA, 18 bp, synthetic construct
  misc_feature 1..18: note = Description of Artificial Sequence: Syntheticoligonucleotide
  source 1..18: mol_type = other DNA
ctgactctgcagagtcag

SEQ ID NO: 14500 - DNA, 18 bp, synthetic construct
  misc_feature 1..18: note = Description of Artificial Sequence: Syntheticoligonucleotide
  source 1..18: mol_type = other DNA
cagactctgcagagtctg

SEQ ID NO: 14501 - DNA, 18 bp, synthetic construct
  misc_feature 1..18: note = Description of Artificial Sequence: Syntheticoligonucleotide
  source 1..18: mol_type = other DNA
cggactctgcagagtccg

SEQ ID NO: 14502 - DNA, 18 bp, synthetic construct
  misc_feature 1..18: note = Description of Artificial Sequence: Syntheticoligonucleotide
  source 1..18: mol_type = other DNA
ccgactctgcagagtcgg

SEQ ID NO: 14503 - DNA, 18 bp, synthetic construct
  misc_feature 1..18: note = Description of Artificial Sequence: Syntheticoligonucleotide
  source 1..18: mol_type = other DNA
ttgactctgcagagtcaa

SEQ ID NO: 14504 - DNA, 18 bp, synthetic construct
  misc_feature 1..18: note = Description of Artificial Sequence: Syntheticoligonucleotide
  source 1..18: mol_type = other DNA
tggactctgcagagtcca

SEQ ID NO: 14505 - DNA, 18 bp, synthetic construct
  misc_feature 1..18: note = Description of Artificial Sequence: Syntheticoligonucleotide
  source 1..18: mol_type = other DNA
aggactcagctgagtcct

SEQ ID NO: 14506 - DNA, 18 bp, synthetic construct
  misc_feature 1..18: note = Description of Artificial Sequence: Syntheticoligonucleotide
  source 1..18: mol_type = other DNA
acgactcagctgagtcgt

SEQ ID NO: 14507 - DNA, 18 bp, synthetic construct
  misc_feature 1..18: note = Description of Artificial Sequence: Syntheticoligonucleotide
  source 1..18: mol_type = other DNA
gtgactcagctgagtcac

SEQ ID NO: 14508 - DNA, 18 bp, synthetic construct
  misc_feature 1..18: note = Description of Artificial Sequence: Syntheticoligonucleotide
  source 1..18: mol_type = other DNA
gagactcagctgagtctc

SEQ ID NO: 14509 - DNA, 18 bp, synthetic construct
  misc_feature 1..18: note = Description of Artificial Sequence: Syntheticoligonucleotide
  source 1..18: mol_type = other DNA
gggactcagctgagtccc

SEQ ID NO: 14510 - DNA, 18 bp, synthetic construct
  misc_feature 1..18: note = Description of Artificial Sequence: Syntheticoligonucleotide
  source 1..18: mol_type = other DNA
gcgactcagctgagtcgc

SEQ ID NO: 14511 - DNA, 18 bp, synthetic construct
  misc_feature 1..18: note = Description of Artificial Sequence: Syntheticoligonucleotide
  source 1..18: mol_type = other DNA
ctgactcagctgagtcag

SEQ ID NO: 14512 - DNA, 18 bp, synthetic construct
  misc_feature 1..18: note = Description of Artificial Sequence: Syntheticoligonucleotide
  source 1..18: mol_type = other DNA
cagactcagctgagtctg

SEQ ID NO: 14513 - DNA, 18 bp, synthetic construct
  misc_feature 1..18: note = Description of Artificial Sequence: Syntheticoligonucleotide
  source 1..18: mol_type = other DNA
cggactcagctgagtccg

SEQ ID NO: 14514 - DNA, 18 bp, synthetic construct
  misc_feature 1..18: note = Description of Artificial Sequence: Syntheticoligonucleotide
  source 1..18: mol_type = other DNA
ccgactcagctgagtcgg

SEQ ID NO: 14515 - DNA, 18 bp, synthetic construct
  misc_feature 1..18: note = Description of Artificial Sequence: Syntheticoligonucleotide
  source 1..18: mol_type = other DNA
ttgactcagctgagtcaa

SEQ ID NO: 14516 - DNA, 18 bp, synthetic construct
  misc_feature 1..18: note = Description of Artificial Sequence: Syntheticoligonucleotide
  source 1..18: mol_type = other DNA
tggactcagctgagtcca

SEQ ID NO: 14517 - DNA, 18 bp, synthetic construct
  misc_feature 1..18: note = Description of Artificial Sequence: Syntheticoligonucleotide
  source 1..18: mol_type = other DNA
aggactctcgagagtcct

SEQ ID NO: 14518 - DNA, 18 bp, synthetic construct
  misc_feature 1..18: note = Description of Artificial Sequence: Syntheticoligonucleotide
  source 1..18: mol_type = other DNA
acgactctcgagagtcgt

SEQ ID NO: 14519 - DNA, 18 bp, synthetic construct
  misc_feature 1..18: note = Description of Artificial Sequence: Syntheticoligonucleotide
  source 1..18: mol_type = other DNA
gtgactctcgagagtcac

SEQ ID NO: 14520 - DNA, 18 bp, synthetic construct
  misc_feature 1..18: note = Description of Artificial Sequence: Syntheticoligonucleotide
  source 1..18: mol_type = other DNA
gggactctcgagagtccc

SEQ ID NO: 14521 - DNA, 18 bp, synthetic construct
  misc_feature 1..18: note = Description of Artificial Sequence: Syntheticoligonucleotide
  source 1..18: mol_type = other DNA
gcgactctcgagagtcgc

SEQ ID NO: 14522 - DNA, 18 bp, synthetic construct
  misc_feature 1..18: note = Description of Artificial Sequence: Syntheticoligonucleotide
  source 1..18: mol_type = other DNA
ctgactctcgagagtcag

SEQ ID NO: 14523 - DNA, 18 bp, synthetic construct
  misc_feature 1..18: note = Description of Artificial Sequence: Syntheticoligonucleotide
  source 1..18: mol_type = other DNA
cagactctcgagagtctg

SEQ ID NO: 14524 - DNA, 18 bp, synthetic construct
  misc_feature 1..18: note = Description of Artificial Sequence: Syntheticoligonucleotide
  source 1..18: mol_type = other DNA
cggactctcgagagtccg

SEQ ID NO: 14525 - DNA, 18 bp, synthetic construct
  misc_feature 1..18: note = Description of Artificial Sequence: Syntheticoligonucleotide
  source 1..18: mol_type = other DNA
ccgactctcgagagtcgg

SEQ ID NO: 14526 - DNA, 18 bp, synthetic construct
  misc_feature 1..18: note = Description of Artificial Sequence: Syntheticoligonucleotide
  source 1..18: mol_type = other DNA
tggactctcgagagtcca

SEQ ID NO: 14527 - DNA, 18 bp, synthetic construct
  misc_feature 1..18: note = Description of Artificial Sequence: Syntheticoligonucleotide
  source 1..18: mol_type = other DNA
aggactctcgagagtcct

SEQ ID NO: 14528 - DNA, 18 bp, synthetic construct
  misc_feature 1..18: note = Description of Artificial Sequence: Syntheticoligonucleotide
  source 1..18: mol_type = other DNA
acgactctcgagagtcgt

SEQ ID NO: 14529 - DNA, 18 bp, synthetic construct
  misc_feature 1..18: note = Description of Artificial Sequence: Syntheticoligonucleotide
  source 1..18: mol_type = other DNA
gtgactctcgagagtcac

SEQ ID NO: 14530 - DNA, 18 bp, synthetic construct
  misc_feature 1..18: note = Description of Artificial Sequence: Syntheticoligonucleotide
  source 1..18: mol_type = other DNA
gggactctcgagagtccc

SEQ ID NO: 14531 - DNA, 18 bp, synthetic construct
  misc_feature 1..18: note = Description of Artificial Sequence: Syntheticoligonucleotide
  source 1..18: mol_type = other DNA
gcgactctcgagagtcgc

SEQ ID NO: 14532 - DNA, 18 bp, synthetic construct
  misc_feature 1..18: note = Description of Artificial Sequence: Syntheticoligonucleotide
  source 1..18: mol_type = other DNA
ctgactctcgagagtcag

SEQ ID NO: 14533 - DNA, 18 bp, synthetic construct
  misc_feature 1..18: note = Description of Artificial Sequence: Syntheticoligonucleotide
  source 1..18: mol_type = other DNA
cagactctcgagagtctg

SEQ ID NO: 14534 - DNA, 18 bp, synthetic construct
  misc_feature 1..18: note = Description of Artificial Sequence: Syntheticoligonucleotide
  source 1..18: mol_type = other DNA
cggactctcgagagtccg

SEQ ID NO: 14535 - DNA, 18 bp, synthetic construct
  misc_feature 1..18: note = Description of Artificial Sequence: Syntheticoligonucleotide
  source 1..18: mol_type = other DNA
ccgactctcgagagtcgg

SEQ ID NO: 14536 - DNA, 18 bp, synthetic construct
  misc_feature 1..18: note = Description of Artificial Sequence: Syntheticoligonucleotide
  source 1..18: mol_type = other DNA
tggactctcgagagtcca

SEQ ID NO: 14537 - DNA, 18 bp, synthetic construct
  misc_feature 1..18: note = Description of Artificial Sequence: Syntheticoligonucleotide
  source 1..18: mol_type = other DNA
atgactcacgtgagtcat

SEQ ID NO: 14538 - DNA, 18 bp, synthetic construct
  misc_feature 1..18: note = Description of Artificial Sequence: Syntheticoligonucleotide
  source 1..18: mol_type = other DNA
aggactcacgtgagtcct

SEQ ID NO: 14539 - DNA, 18 bp, synthetic construct
  misc_feature 1..18: note = Description of Artificial Sequence: Syntheticoligonucleotide
  source 1..18: mol_type = other DNA
acgactcacgtgagtcgt

SEQ ID NO: 14540 - DNA, 18 bp, synthetic construct
  misc_feature 1..18: note = Description of Artificial Sequence: Syntheticoligonucleotide
  source 1..18: mol_type = other DNA
gtgactcacgtgagtcac

SEQ ID NO: 14541 - DNA, 18 bp, synthetic construct
  misc_feature 1..18: note = Description of Artificial Sequence: Syntheticoligonucleotide
  source 1..18: mol_type = other DNA
gagactcacgtgagtctc

SEQ ID NO: 14542 - DNA, 18 bp, synthetic construct
  misc_feature 1..18: note = Description of Artificial Sequence: Syntheticoligonucleotide
  source 1..18: mol_type = other DNA
gggactcacgtgagtccc

SEQ ID NO: 14543 - DNA, 18 bp, synthetic construct
  misc_feature 1..18: note = Description of Artificial Sequence: Syntheticoligonucleotide
  source 1..18: mol_type = other DNA
gcgactcacgtgagtcgc

SEQ ID NO: 14544 - DNA, 18 bp, synthetic construct
  misc_feature 1..18: note = Description of Artificial Sequence: Syntheticoligonucleotide
  source 1..18: mol_type = other DNA
ctgactcacgtgagtcag

SEQ ID NO: 14545 - DNA, 18 bp, synthetic construct
  misc_feature 1..18: note = Description of Artificial Sequence: Syntheticoligonucleotide
  source 1..18: mol_type = other DNA
cagactcacgtgagtctg

SEQ ID NO: 14546 - DNA, 18 bp, synthetic construct
  misc_feature 1..18: note = Description of Artificial Sequence: Syntheticoligonucleotide
  source 1..18: mol_type = other DNA
cggactcacgtgagtccg

SEQ ID NO: 14547 - DNA, 18 bp, synthetic construct
  misc_feature 1..18: note = Description of Artificial Sequence: Syntheticoligonucleotide
  source 1..18: mol_type = other DNA
ccgactcacgtgagtcgg

SEQ ID NO: 14548 - DNA, 18 bp, synthetic construct
  misc_feature 1..18: note = Description of Artificial Sequence: Syntheticoligonucleotide
  source 1..18: mol_type = other DNA
ttgactcacgtgagtcaa

SEQ ID NO: 14549 - DNA, 18 bp, synthetic construct
  misc_feature 1..18: note = Description of Artificial Sequence: Syntheticoligonucleotide
  source 1..18: mol_type = other DNA
tggactcacgtgagtcca

SEQ ID NO: 14550 - DNA, 18 bp, synthetic construct
  misc_feature 1..18: note = Description of Artificial Sequence: Syntheticoligonucleotide
  source 1..18: mol_type = other DNA
aggactccatggagtcct

SEQ ID NO: 14551 - DNA, 18 bp, synthetic construct
  misc_feature 1..18: note = Description of Artificial Sequence: Syntheticoligonucleotide
  source 1..18: mol_type = other DNA
acgactccatggagtcgt

SEQ ID NO: 14552 - DNA, 18 bp, synthetic construct
  misc_feature 1..18: note = Description of Artificial Sequence: Syntheticoligonucleotide
  source 1..18: mol_type = other DNA
gtgactccatggagtcac

SEQ ID NO: 14553 - DNA, 18 bp, synthetic construct
  misc_feature 1..18: note = Description of Artificial Sequence: Syntheticoligonucleotide
  source 1..18: mol_type = other DNA
gagactccatggagtctc

SEQ ID NO: 14554 - DNA, 18 bp, synthetic construct
  misc_feature 1..18: note = Description of Artificial Sequence: Syntheticoligonucleotide
  source 1..18: mol_type = other DNA
gggactccatggagtccc

SEQ ID NO: 14555 - DNA, 18 bp, synthetic construct
  misc_feature 1..18: note = Description of Artificial Sequence: Syntheticoligonucleotide
  source 1..18: mol_type = other DNA
gcgactccatggagtcgc

SEQ ID NO: 14556 - DNA, 18 bp, synthetic construct
  misc_feature 1..18: note = Description of Artificial Sequence: Syntheticoligonucleotide
  source 1..18: mol_type = other DNA
ctgactccatggagtcag

SEQ ID NO: 14557 - DNA, 18 bp, synthetic construct
  misc_feature 1..18: note = Description of Artificial Sequence: Syntheticoligonucleotide
  source 1..18: mol_type = other DNA
cagactccatggagtctg

SEQ ID NO: 14558 - DNA, 18 bp, synthetic construct
  misc_feature 1..18: note = Description of Artificial Sequence: Syntheticoligonucleotide
  source 1..18: mol_type = other DNA
cggactccatggagtccg

SEQ ID NO: 14559 - DNA, 18 bp, synthetic construct
  misc_feature 1..18: note = Description of Artificial Sequence: Syntheticoligonucleotide
  source 1..18: mol_type = other DNA
ccgactccatggagtcgg

SEQ ID NO: 14560 - DNA, 18 bp, synthetic construct
  misc_feature 1..18: note = Description of Artificial Sequence: Syntheticoligonucleotide
  source 1..18: mol_type = other DNA
ttgactccatggagtcaa

SEQ ID NO: 14561 - DNA, 18 bp, synthetic construct
  misc_feature 1..18: note = Description of Artificial Sequence: Syntheticoligonucleotide
  source 1..18: mol_type = other DNA
tggactccatggagtcca

SEQ ID NO: 14562 - DNA, 18 bp, synthetic construct
  misc_feature 1..18: note = Description of Artificial Sequence: Syntheticoligonucleotide
  source 1..18: mol_type = other DNA
aggactcgtacgagtcct

SEQ ID NO: 14563 - DNA, 18 bp, synthetic construct
  misc_feature 1..18: note = Description of Artificial Sequence: Syntheticoligonucleotide
  source 1..18: mol_type = other DNA
acgactcgtacgagtcgt

SEQ ID NO: 14564 - DNA, 18 bp, synthetic construct
  misc_feature 1..18: note = Description of Artificial Sequence: Syntheticoligonucleotide
  source 1..18: mol_type = other DNA
gtgactcgtacgagtcac

SEQ ID NO: 14565 - DNA, 18 bp, synthetic construct
  misc_feature 1..18: note = Description of Artificial Sequence: Syntheticoligonucleotide
  source 1..18: mol_type = other DNA
gagactcgtacgagtctc

SEQ ID NO: 14566 - DNA, 18 bp, synthetic construct
  misc_feature 1..18: note = Description of Artificial Sequence: Syntheticoligonucleotide
  source 1..18: mol_type = other DNA
gggactcgtacgagtccc

SEQ ID NO: 14567 - DNA, 18 bp, synthetic construct
  misc_feature 1..18: note = Description of Artificial Sequence: Syntheticoligonucleotide
  source 1..18: mol_type = other DNA
gcgactcgtacgagtcgc

SEQ ID NO: 14568 - DNA, 18 bp, synthetic construct
  misc_feature 1..18: note = Description of Artificial Sequence: Syntheticoligonucleotide
  source 1..18: mol_type = other DNA
ctgactcgtacgagtcag

SEQ ID NO: 14569 - DNA, 18 bp, synthetic construct
  misc_feature 1..18: note = Description of Artificial Sequence: Syntheticoligonucleotide
  source 1..18: mol_type = other DNA
cagactcgtacgagtctg

SEQ ID NO: 14570 - DNA, 18 bp, synthetic construct
  misc_feature 1..18: note = Description of Artificial Sequence: Syntheticoligonucleotide
  source 1..18: mol_type = other DNA
cggactcgtacgagtccg

SEQ ID NO: 14571 - DNA, 18 bp, synthetic construct
  misc_feature 1..18: note = Description of Artificial Sequence: Syntheticoligonucleotide
  source 1..18: mol_type = other DNA
ccgactcgtacgagtcgg

SEQ ID NO: 14572 - DNA, 18 bp, synthetic construct
  misc_feature 1..18: note = Description of Artificial Sequence: Syntheticoligonucleotide
  source 1..18: mol_type = other DNA
tggactcgtacgagtcca

SEQ ID NO: 14573 - DNA, 18 bp, synthetic construct
  misc_feature 1..18: note = Description of Artificial Sequence: Syntheticoligonucleotide
  source 1..18: mol_type = other DNA
aggactcctaggagtcct

SEQ ID NO: 14574 - DNA, 18 bp, synthetic construct
  misc_feature 1..18: note = Description of Artificial Sequence: Syntheticoligonucleotide
  source 1..18: mol_type = other DNA
acgactcctaggagtcgt

SEQ ID NO: 14575 - DNA, 18 bp, synthetic construct
  misc_feature 1..18: note = Description of Artificial Sequence: Syntheticoligonucleotide
  source 1..18: mol_type = other DNA
gtgactcctaggagtcac

SEQ ID NO: 14576 - DNA, 18 bp, synthetic construct
  misc_feature 1..18: note = Description of Artificial Sequence: Syntheticoligonucleotide
  source 1..18: mol_type = other DNA
gggactcctaggagtccc

SEQ ID NO: 14577 - DNA, 18 bp, synthetic construct
  misc_feature 1..18: note = Description of Artificial Sequence: Syntheticoligonucleotide
  source 1..18: mol_type = other DNA
gcgactcctaggagtcgc

SEQ ID NO: 14578 - DNA, 18 bp, synthetic construct
  misc_feature 1..18: note = Description of Artificial Sequence: Syntheticoligonucleotide
  source 1..18: mol_type = other DNA
cggactcctaggagtccg

SEQ ID NO: 14579 - DNA, 18 bp, synthetic construct
  misc_feature 1..18: note = Description of Artificial Sequence: Syntheticoligonucleotide
  source 1..18: mol_type = other DNA
ccgactcctaggagtcgg

SEQ ID NO: 14580 - DNA, 18 bp, synthetic construct
  misc_feature 1..18: note = Description of Artificial Sequence: Syntheticoligonucleotide
  source 1..18: mol_type = other DNA
tggactcctaggagtcca

SEQ ID NO: 14581 - DNA, 16 bp, synthetic construct
  misc_feature 1..16: note = Description of Artificial Sequence: Syntheticoligonucleotide
  source 1..16: mol_type = other DNA
tgactccgcggagtca

SEQ ID NO: 14582 - DNA, 16 bp, synthetic construct
  misc_feature 1..16: note = Description of Artificial Sequence: Syntheticoligonucleotide
  source 1..16: mol_type = other DNA
agactccgcggagtct

SEQ ID NO: 14583 - DNA, 16 bp, synthetic construct
  misc_feature 1..16: note = Description of Artificial Sequence: Syntheticoligonucleotide
  source 1..16: mol_type = other DNA
ggactccgcggagtcc

SEQ ID NO: 14584 - DNA, 16 bp, synthetic construct
  misc_feature 1..16: note = Description of Artificial Sequence: Syntheticoligonucleotide
  source 1..16: mol_type = other DNA
cgactccgcggagtcg

SEQ ID NO: 14585 - DNA, 16 bp, synthetic construct
  misc_feature 1..16: note = Description of Artificial Sequence: Syntheticoligonucleotide
  source 1..16: mol_type = other DNA
tgactcggccgagtca

SEQ ID NO: 14586 - DNA, 16 bp, synthetic construct
  misc_feature 1..16: note = Description of Artificial Sequence: Syntheticoligonucleotide
  source 1..16: mol_type = other DNA
agactcggccgagtct

SEQ ID NO: 14587 - DNA, 16 bp, synthetic construct
  misc_feature 1..16: note = Description of Artificial Sequence: Syntheticoligonucleotide
  source 1..16: mol_type = other DNA
ggactcggccgagtcc

SEQ ID NO: 14588 - DNA, 16 bp, synthetic construct
  misc_feature 1..16: note = Description of Artificial Sequence: Syntheticoligonucleotide
  source 1..16: mol_type = other DNA
cgactcggccgagtcg

SEQ ID NO: 14589 - DNA, 16 bp, synthetic construct
  misc_feature 1..16: note = Description of Artificial Sequence: Syntheticoligonucleotide
  source 1..16: mol_type = other DNA
tgactcgcgcgagtca

SEQ ID NO: 14590 - DNA, 16 bp, synthetic construct
  misc_feature 1..16: note = Description of Artificial Sequence: Syntheticoligonucleotide
  source 1..16: mol_type = other DNA
agactcgcgcgagtct

SEQ ID NO: 14591 - DNA, 16 bp, synthetic construct
  misc_feature 1..16: note = Description of Artificial Sequence: Syntheticoligonucleotide
  source 1..16: mol_type = other DNA
ggactcgcgcgagtcc

SEQ ID NO: 14592 - DNA, 16 bp, synthetic construct
  misc_feature 1..16: note = Description of Artificial Sequence: Syntheticoligonucleotide
  source 1..16: mol_type = other DNA
cgactcgcgcgagtcg

SEQ ID NO: 14593 - DNA, 16 bp, synthetic construct
  misc_feature 1..16: note = Description of Artificial Sequence: Syntheticoligonucleotide
  source 1..16: mol_type = other DNA
tgactcccgggagtca

SEQ ID NO: 14594 - DNA, 16 bp, synthetic construct
  misc_feature 1..16: note = Description of Artificial Sequence: Syntheticoligonucleotide
  source 1..16: mol_type = other DNA
agactcccgggagtct

SEQ ID NO: 14595 - DNA, 16 bp, synthetic construct
  misc_feature 1..16: note = Description of Artificial Sequence: Syntheticoligonucleotide
  source 1..16: mol_type = other DNA
ggactcccgggagtcc

SEQ ID NO: 14596 - DNA, 16 bp, synthetic construct
  misc_feature 1..16: note = Description of Artificial Sequence: Syntheticoligonucleotide
  source 1..16: mol_type = other DNA
cgactcccgggagtcg

SEQ ID NO: 14597 - DNA, 16 bp, synthetic construct
  misc_feature 1..16: note = Description of Artificial Sequence: Syntheticoligonucleotide
  source 1..16: mol_type = other DNA
ggactctgcagagtcc

SEQ ID NO: 14598 - DNA, 16 bp, synthetic construct
  misc_feature 1..16: note = Description of Artificial Sequence: Syntheticoligonucleotide
  source 1..16: mol_type = other DNA
cgactctgcagagtcg

SEQ ID NO: 14599 - DNA, 16 bp, synthetic construct
  misc_feature 1..16: note = Description of Artificial Sequence: Syntheticoligonucleotide
  source 1..16: mol_type = other DNA
ggactcagctgagtcc

SEQ ID NO: 14600 - DNA, 16 bp, synthetic construct
  misc_feature 1..16: note = Description of Artificial Sequence: Syntheticoligonucleotide
  source 1..16: mol_type = other DNA
cgactcagctgagtcg

SEQ ID NO: 14601 - DNA, 16 bp, synthetic construct
  misc_feature 1..16: note = Description of Artificial Sequence: Syntheticoligonucleotide
  source 1..16: mol_type = other DNA
ggactctcgagagtcc

SEQ ID NO: 14602 - DNA, 16 bp, synthetic construct
  misc_feature 1..16: note = Description of Artificial Sequence: Syntheticoligonucleotide
  source 1..16: mol_type = other DNA
cgactctcgagagtcg

SEQ ID NO: 14603 - DNA, 16 bp, synthetic construct
  misc_feature 1..16: note = Description of Artificial Sequence: Syntheticoligonucleotide
  source 1..16: mol_type = other DNA
ggactcacgtgagtcc

SEQ ID NO: 14604 - DNA, 16 bp, synthetic construct
  misc_feature 1..16: note = Description of Artificial Sequence: Syntheticoligonucleotide
  source 1..16: mol_type = other DNA
cgactcacgtgagtcg

SEQ ID NO: 14605 - DNA, 16 bp, synthetic construct
  misc_feature 1..16: note = Description of Artificial Sequence: Syntheticoligonucleotide
  source 1..16: mol_type = other DNA
ggactccatggagtcc

SEQ ID NO: 14606 - DNA, 16 bp, synthetic construct
  misc_feature 1..16: note = Description of Artificial Sequence: Syntheticoligonucleotide
  source 1..16: mol_type = other DNA
cgactccatggagtcg

SEQ ID NO: 14607 - DNA, 16 bp, synthetic construct
  misc_feature 1..16: note = Description of Artificial Sequence: Syntheticoligonucleotide
  source 1..16: mol_type = other DNA
ggactcgtacgagtcc

SEQ ID NO: 14608 - DNA, 16 bp, synthetic construct
  misc_feature 1..16: note = Description of Artificial Sequence: Syntheticoligonucleotide
  source 1..16: mol_type = other DNA
cgactcgtacgagtcg

SEQ ID NO: 14609 - DNA, 16 bp, synthetic construct
  misc_feature 1..16: note = Description of Artificial Sequence: Syntheticoligonucleotide
  source 1..16: mol_type = other DNA
ggactcctaggagtcc

SEQ ID NO: 14610 - DNA, 16 bp, synthetic construct
  misc_feature 1..16: note = Description of Artificial Sequence: Syntheticoligonucleotide
  source 1..16: mol_type = other DNA
cgactcctaggagtcg

SEQ ID NO: 14611 - DNA, 19 bp, synthetic construct
  misc_feature 1..19: note = Description of Artificial Sequence: Syntheticoligonucleotide
  source 1..19: mol_type = other DNA
tcagactcgcgagtctgaa

SEQ ID NO: 14612 - DNA, 19 bp, synthetic construct
  misc_feature 1..19: note = Description of Artificial Sequence: Syntheticoligonucleotide
  source 1..19: mol_type = other DNA
tcagactcgcgagtctgat

SEQ ID NO: 14613 - DNA, 19 bp, synthetic construct
  misc_feature 1..19: note = Description of Artificial Sequence: Syntheticoligonucleotide
  source 1..19: mol_type = other DNA
tcagactcgcgagtctgac

SEQ ID NO: 14614 - DNA, 19 bp, synthetic construct
  misc_feature 1..19: note = Description of Artificial Sequence: Syntheticoligonucleotide
  source 1..19: mol_type = other DNA
tcagactcgcgagtctgag

SEQ ID NO: 14615 - DNA, 19 bp, synthetic construct
  misc_feature 1..19: note = Description of Artificial Sequence: Syntheticoligonucleotide
  source 1..19: mol_type = other DNA
acagactcgcgagtctgta

SEQ ID NO: 14616 - DNA, 19 bp, synthetic construct
  misc_feature 1..19: note = Description of Artificial Sequence: Syntheticoligonucleotide
  source 1..19: mol_type = other DNA
acagactcgcgagtctgtt

SEQ ID NO: 14617 - DNA, 19 bp, synthetic construct
  misc_feature 1..19: note = Description of Artificial Sequence: Syntheticoligonucleotide
  source 1..19: mol_type = other DNA
acagactcgcgagtctgtc

SEQ ID NO: 14618 - DNA, 19 bp, synthetic construct
  misc_feature 1..19: note = Description of Artificial Sequence: Syntheticoligonucleotide
  source 1..19: mol_type = other DNA
acagactcgcgagtctgtg

SEQ ID NO: 14619 - DNA, 19 bp, synthetic construct
  misc_feature 1..19: note = Description of Artificial Sequence: Syntheticoligonucleotide
  source 1..19: mol_type = other DNA
gcagactcgcgagtctgct

SEQ ID NO: 14620 - DNA, 19 bp, synthetic construct
  misc_feature 1..19: note = Description of Artificial Sequence: Syntheticoligonucleotide
  source 1..19: mol_type = other DNA
gcagactcgcgagtctgcc

SEQ ID NO: 14621 - DNA, 19 bp, synthetic construct
  misc_feature 1..19: note = Description of Artificial Sequence: Syntheticoligonucleotide
  source 1..19: mol_type = other DNA
gcagactcgcgagtctgcg

SEQ ID NO: 14622 - DNA, 19 bp, synthetic construct
  misc_feature 1..19: note = Description of Artificial Sequence: Syntheticoligonucleotide
  source 1..19: mol_type = other DNA
ccagactcgcgagtctgga

SEQ ID NO: 14623 - DNA, 19 bp, synthetic construct
  misc_feature 1..19: note = Description of Artificial Sequence: Syntheticoligonucleotide
  source 1..19: mol_type = other DNA
ccagactcgcgagtctggt

SEQ ID NO: 14624 - DNA, 19 bp, synthetic construct
  misc_feature 1..19: note = Description of Artificial Sequence: Syntheticoligonucleotide
  source 1..19: mol_type = other DNA
ccagactcgcgagtctggc

SEQ ID NO: 14625 - DNA, 19 bp, synthetic construct
  misc_feature 1..19: note = Description of Artificial Sequence: Syntheticoligonucleotide
  source 1..19: mol_type = other DNA
ccagactcgcgagtctggg

SEQ ID NO: 14626 - DNA, 19 bp, synthetic construct
  misc_feature 1..19: note = Description of Artificial Sequence: Syntheticoligonucleotide
  source 1..19: mol_type = other DNA
tctgactcgcgagtcagaa

SEQ ID NO: 14627 - DNA, 19 bp, synthetic construct
  misc_feature 1..19: note = Description of Artificial Sequence: Syntheticoligonucleotide
  source 1..19: mol_type = other DNA
tctgactcgcgagtcagat

SEQ ID NO: 14628 - DNA, 19 bp, synthetic construct
  misc_feature 1..19: note = Description of Artificial Sequence: Syntheticoligonucleotide
  source 1..19: mol_type = other DNA
tctgactcgcgagtcagac

SEQ ID NO: 14629 - DNA, 19 bp, synthetic construct
  misc_feature 1..19: note = Description of Artificial Sequence: Syntheticoligonucleotide
  source 1..19: mol_type = other DNA
tctgactcgcgagtcagag

SEQ ID NO: 14630 - DNA, 19 bp, synthetic construct
  misc_feature 1..19: note = Description of Artificial Sequence: Syntheticoligonucleotide
  source 1..19: mol_type = other DNA
actgactcgcgagtcagta

SEQ ID NO: 14631 - DNA, 19 bp, synthetic construct
  misc_feature 1..19: note = Description of Artificial Sequence: Syntheticoligonucleotide
  source 1..19: mol_type = other DNA
actgactcgcgagtcagtt

SEQ ID NO: 14632 - DNA, 19 bp, synthetic construct
  misc_feature 1..19: note = Description of Artificial Sequence: Syntheticoligonucleotide
  source 1..19: mol_type = other DNA
actgactcgcgagtcagtc

SEQ ID NO: 14633 - DNA, 19 bp, synthetic construct
  misc_feature 1..19: note = Description of Artificial Sequence: Syntheticoligonucleotide
  source 1..19: mol_type = other DNA
actgactcgcgagtcagtg

SEQ ID NO: 14634 - DNA, 19 bp, synthetic construct
  misc_feature 1..19: note = Description of Artificial Sequence: Syntheticoligonucleotide
  source 1..19: mol_type = other DNA
gctgactcgcgagtcagca

SEQ ID NO: 14635 - DNA, 19 bp, synthetic construct
  misc_feature 1..19: note = Description of Artificial Sequence: Syntheticoligonucleotide
  source 1..19: mol_type = other DNA
gctgactcgcgagtcagcc

SEQ ID NO: 14636 - DNA, 19 bp, synthetic construct
  misc_feature 1..19: note = Description of Artificial Sequence: Syntheticoligonucleotide
  source 1..19: mol_type = other DNA
gctgactcgcgagtcagcg

SEQ ID NO: 14637 - DNA, 19 bp, synthetic construct
  misc_feature 1..19: note = Description of Artificial Sequence: Syntheticoligonucleotide
  source 1..19: mol_type = other DNA
cctgactcgcgagtcagga

SEQ ID NO: 14638 - DNA, 19 bp, synthetic construct
  misc_feature 1..19: note = Description of Artificial Sequence: Syntheticoligonucleotide
  source 1..19: mol_type = other DNA
cctgactcgcgagtcaggt

SEQ ID NO: 14639 - DNA, 19 bp, synthetic construct
  misc_feature 1..19: note = Description of Artificial Sequence: Syntheticoligonucleotide
  source 1..19: mol_type = other DNA
cctgactcgcgagtcaggc

SEQ ID NO: 14640 - DNA, 19 bp, synthetic construct
  misc_feature 1..19: note = Description of Artificial Sequence: Syntheticoligonucleotide
  source 1..19: mol_type = other DNA
cctgactcgcgagtcaggg

SEQ ID NO: 14641 - DNA, 19 bp, synthetic construct
  misc_feature 1..19: note = Description of Artificial Sequence: Syntheticoligonucleotide
  source 1..19: mol_type = other DNA
tacgactcgcgagtcgtaa

SEQ ID NO: 14642 - DNA, 19 bp, synthetic construct
  misc_feature 1..19: note = Description of Artificial Sequence: Syntheticoligonucleotide
  source 1..19: mol_type = other DNA
tacgactcgcgagtcgtat

SEQ ID NO: 14643 - DNA, 19 bp, synthetic construct
  misc_feature 1..19: note = Description of Artificial Sequence: Syntheticoligonucleotide
  source 1..19: mol_type = other DNA
tacgactcgcgagtcgtag

SEQ ID NO: 14644 - DNA, 19 bp, synthetic construct
  misc_feature 1..19: note = Description of Artificial Sequence: Syntheticoligonucleotide
  source 1..19: mol_type = other DNA
aacgactcgcgagtcgtta

SEQ ID NO: 14645 - DNA, 19 bp, synthetic construct
  misc_feature 1..19: note = Description of Artificial Sequence: Syntheticoligonucleotide
  source 1..19: mol_type = other DNA
aacgactcgcgagtcgttt

SEQ ID NO: 14646 - DNA, 19 bp, synthetic construct
  misc_feature 1..19: note = Description of Artificial Sequence: Syntheticoligonucleotide
  source 1..19: mol_type = other DNA
aacgactcgcgagtcgttc

SEQ ID NO: 14647 - DNA, 19 bp, synthetic construct
  misc_feature 1..19: note = Description of Artificial Sequence: Syntheticoligonucleotide
  source 1..19: mol_type = other DNA
aacgactcgcgagtcgttg

SEQ ID NO: 14648 - DNA, 19 bp, synthetic construct
  misc_feature 1..19: note = Description of Artificial Sequence: Syntheticoligonucleotide
  source 1..19: mol_type = other DNA
gacgactcgcgagtcgtca

SEQ ID NO: 14649 - DNA, 19 bp, synthetic construct
  misc_feature 1..19: note = Description of Artificial Sequence: Syntheticoligonucleotide
  source 1..19: mol_type = other DNA
gacgactcgcgagtcgtct

SEQ ID NO: 14650 - DNA, 19 bp, synthetic construct
  misc_feature 1..19: note = Description of Artificial Sequence: Syntheticoligonucleotide
  source 1..19: mol_type = other DNA
gacgactcgcgagtcgtcc

SEQ ID NO: 14651 - DNA, 19 bp, synthetic construct
  misc_feature 1..19: note = Description of Artificial Sequence: Syntheticoligonucleotide
  source 1..19: mol_type = other DNA
gacgactcgcgagtcgtcg

SEQ ID NO: 14652 - DNA, 19 bp, synthetic construct
  misc_feature 1..19: note = Description of Artificial Sequence: Syntheticoligonucleotide
  source 1..19: mol_type = other DNA
cacgactcgcgagtcgtga

SEQ ID NO: 14653 - DNA, 19 bp, synthetic construct
  misc_feature 1..19: note = Description of Artificial Sequence: Syntheticoligonucleotide
  source 1..19: mol_type = other DNA
cacgactcgcgagtcgtgt

SEQ ID NO: 14654 - DNA, 19 bp, synthetic construct
  misc_feature 1..19: note = Description of Artificial Sequence: Syntheticoligonucleotide
  source 1..19: mol_type = other DNA
cacgactcgcgagtcgtgc

SEQ ID NO: 14655 - DNA, 19 bp, synthetic construct
  misc_feature 1..19: note = Description of Artificial Sequence: Syntheticoligonucleotide
  source 1..19: mol_type = other DNA
cacgactcgcgagtcgtgg

SEQ ID NO: 14656 - DNA, 19 bp, synthetic construct
  misc_feature 1..19: note = Description of Artificial Sequence: Syntheticoligonucleotide
  source 1..19: mol_type = other DNA
tccgactcgcgagtcggaa

SEQ ID NO: 14657 - DNA, 19 bp, synthetic construct
  misc_feature 1..19: note = Description of Artificial Sequence: Syntheticoligonucleotide
  source 1..19: mol_type = other DNA
tccgactcgcgagtcggat

SEQ ID NO: 14658 - DNA, 19 bp, synthetic construct
  misc_feature 1..19: note = Description of Artificial Sequence: Syntheticoligonucleotide
  source 1..19: mol_type = other DNA
tccgactcgcgagtcggac

SEQ ID NO: 14659 - DNA, 19 bp, synthetic construct
  misc_feature 1..19: note = Description of Artificial Sequence: Syntheticoligonucleotide
  source 1..19: mol_type = other DNA
tccgactcgcgagtcggag

SEQ ID NO: 14660 - DNA, 19 bp, synthetic construct
  misc_feature 1..19: note = Description of Artificial Sequence: Syntheticoligonucleotide
  source 1..19: mol_type = other DNA
accgactcgcgagtcggta

SEQ ID NO: 14661 - DNA, 19 bp, synthetic construct
  misc_feature 1..19: note = Description of Artificial Sequence: Syntheticoligonucleotide
  source 1..19: mol_type = other DNA
accgactcgcgagtcggtt

SEQ ID NO: 14662 - DNA, 19 bp, synthetic construct
  misc_feature 1..19: note = Description of Artificial Sequence: Syntheticoligonucleotide
  source 1..19: mol_type = other DNA
accgactcgcgagtcggtc

SEQ ID NO: 14663 - DNA, 19 bp, synthetic construct
  misc_feature 1..19: note = Description of Artificial Sequence: Syntheticoligonucleotide
  source 1..19: mol_type = other DNA
accgactcgcgagtcggtg

SEQ ID NO: 14664 - DNA, 19 bp, synthetic construct
  misc_feature 1..19: note = Description of Artificial Sequence: Syntheticoligonucleotide
  source 1..19: mol_type = other DNA
gccgactcgcgagtcggca

SEQ ID NO: 14665 - DNA, 19 bp, synthetic construct
  misc_feature 1..19: note = Description of Artificial Sequence: Syntheticoligonucleotide
  source 1..19: mol_type = other DNA
gccgactcgcgagtcggct

SEQ ID NO: 14666 - DNA, 19 bp, synthetic construct
  misc_feature 1..19: note = Description of Artificial Sequence: Syntheticoligonucleotide
  source 1..19: mol_type = other DNA
gccgactcgcgagtcggcg

SEQ ID NO: 14667 - DNA, 19 bp, synthetic construct
  misc_feature 1..19: note = Description of Artificial Sequence: Syntheticoligonucleotide
  source 1..19: mol_type = other DNA
cccgactcgcgagtcggga

SEQ ID NO: 14668 - DNA, 19 bp, synthetic construct
  misc_feature 1..19: note = Description of Artificial Sequence: Syntheticoligonucleotide
  source 1..19: mol_type = other DNA
cccgactcgcgagtcgggt

SEQ ID NO: 14669 - DNA, 19 bp, synthetic construct
  misc_feature 1..19: note = Description of Artificial Sequence: Syntheticoligonucleotide
  source 1..19: mol_type = other DNA
cccgactcgcgagtcgggc

SEQ ID NO: 14670 - DNA, 19 bp, synthetic construct
  misc_feature 1..19: note = Description of Artificial Sequence: Syntheticoligonucleotide
  source 1..19: mol_type = other DNA
tgagactcgcgagtctcaa

SEQ ID NO: 14671 - DNA, 19 bp, synthetic construct
  misc_feature 1..19: note = Description of Artificial Sequence: Syntheticoligonucleotide
  source 1..19: mol_type = other DNA
tgagactcgcgagtctcat

SEQ ID NO: 14672 - DNA, 19 bp, synthetic construct
  misc_feature 1..19: note = Description of Artificial Sequence: Syntheticoligonucleotide
  source 1..19: mol_type = other DNA
tgagactcgcgagtctcac

SEQ ID NO: 14673 - DNA, 19 bp, synthetic construct
  misc_feature 1..19: note = Description of Artificial Sequence: Syntheticoligonucleotide
  source 1..19: mol_type = other DNA
tgagactcgcgagtctcag

SEQ ID NO: 14674 - DNA, 19 bp, synthetic construct
  misc_feature 1..19: note = Description of Artificial Sequence: Syntheticoligonucleotide
  source 1..19: mol_type = other DNA
agagactcgcgagtctcta

SEQ ID NO: 14675 - DNA, 19 bp, synthetic construct
  misc_feature 1..19: note = Description of Artificial Sequence: Syntheticoligonucleotide
  source 1..19: mol_type = other DNA
agagactcgcgagtctctt

SEQ ID NO: 14676 - DNA, 19 bp, synthetic construct
  misc_feature 1..19: note = Description of Artificial Sequence: Syntheticoligonucleotide
  source 1..19: mol_type = other DNA
agagactcgcgagtctctc

SEQ ID NO: 14677 - DNA, 19 bp, synthetic construct
  misc_feature 1..19: note = Description of Artificial Sequence: Syntheticoligonucleotide
  source 1..19: mol_type = other DNA
agagactcgcgagtctctg

SEQ ID NO: 14678 - DNA, 19 bp, synthetic construct
  misc_feature 1..19: note = Description of Artificial Sequence: Syntheticoligonucleotide
  source 1..19: mol_type = other DNA
ggagactcgcgagtctcca

SEQ ID NO: 14679 - DNA, 19 bp, synthetic construct
  misc_feature 1..19: note = Description of Artificial Sequence: Syntheticoligonucleotide
  source 1..19: mol_type = other DNA
ggagactcgcgagtctcct

SEQ ID NO: 14680 - DNA, 19 bp, synthetic construct
  misc_feature 1..19: note = Description of Artificial Sequence: Syntheticoligonucleotide
  source 1..19: mol_type = other DNA
ggagactcgcgagtctccc

SEQ ID NO: 14681 - DNA, 19 bp, synthetic construct
  misc_feature 1..19: note = Description of Artificial Sequence: Syntheticoligonucleotide
  source 1..19: mol_type = other DNA
ggagactcgcgagtctccg

SEQ ID NO: 14682 - DNA, 19 bp, synthetic construct
  misc_feature 1..19: note = Description of Artificial Sequence: Syntheticoligonucleotide
  source 1..19: mol_type = other DNA
cgagactcgcgagtctcgt

SEQ ID NO: 14683 - DNA, 19 bp, synthetic construct
  misc_feature 1..19: note = Description of Artificial Sequence: Syntheticoligonucleotide
  source 1..19: mol_type = other DNA
cgagactcgcgagtctcgc

SEQ ID NO: 14684 - DNA, 19 bp, synthetic construct
  misc_feature 1..19: note = Description of Artificial Sequence: Syntheticoligonucleotide
  source 1..19: mol_type = other DNA
cgagactcgcgagtctcgg

SEQ ID NO: 14685 - DNA, 19 bp, synthetic construct
  misc_feature 1..19: note = Description of Artificial Sequence: Syntheticoligonucleotide
  source 1..19: mol_type = other DNA
tgtgactcgcgagtcacaa

SEQ ID NO: 14686 - DNA, 19 bp, synthetic construct
  misc_feature 1..19: note = Description of Artificial Sequence: Syntheticoligonucleotide
  source 1..19: mol_type = other DNA
tgtgactcgcgagtcacat

SEQ ID NO: 14687 - DNA, 19 bp, synthetic construct
  misc_feature 1..19: note = Description of Artificial Sequence: Syntheticoligonucleotide
  source 1..19: mol_type = other DNA
tgtgactcgcgagtcacac

SEQ ID NO: 14688 - DNA, 19 bp, synthetic construct
  misc_feature 1..19: note = Description of Artificial Sequence: Syntheticoligonucleotide
  source 1..19: mol_type = other DNA
tgtgactcgcgagtcacag

SEQ ID NO: 14689 - DNA, 19 bp, synthetic construct
  misc_feature 1..19: note = Description of Artificial Sequence: Syntheticoligonucleotide
  source 1..19: mol_type = other DNA
agtgactcgcgagtcacta

SEQ ID NO: 14690 - DNA, 19 bp, synthetic construct
  misc_feature 1..19: note = Description of Artificial Sequence: Syntheticoligonucleotide
  source 1..19: mol_type = other DNA
agtgactcgcgagtcactt

SEQ ID NO: 14691 - DNA, 19 bp, synthetic construct
  misc_feature 1..19: note = Description of Artificial Sequence: Syntheticoligonucleotide
  source 1..19: mol_type = other DNA
agtgactcgcgagtcactc

SEQ ID NO: 14692 - DNA, 19 bp, synthetic construct
  misc_feature 1..19: note = Description of Artificial Sequence: Syntheticoligonucleotide
  source 1..19: mol_type = other DNA
agtgactcgcgagtcactg

SEQ ID NO: 14693 - DNA, 19 bp, synthetic construct
  misc_feature 1..19: note = Description of Artificial Sequence: Syntheticoligonucleotide
  source 1..19: mol_type = other DNA
ggtgactcgcgagtcacca

SEQ ID NO: 14694 - DNA, 19 bp, synthetic construct
  misc_feature 1..19: note = Description of Artificial Sequence: Syntheticoligonucleotide
  source 1..19: mol_type = other DNA
ggtgactcgcgagtcacct

SEQ ID NO: 14695 - DNA, 19 bp, synthetic construct
  misc_feature 1..19: note = Description of Artificial Sequence: Syntheticoligonucleotide
  source 1..19: mol_type = other DNA
ggtgactcgcgagtcaccc

SEQ ID NO: 14696 - DNA, 19 bp, synthetic construct
  misc_feature 1..19: note = Description of Artificial Sequence: Syntheticoligonucleotide
  source 1..19: mol_type = other DNA
ggtgactcgcgagtcaccg

SEQ ID NO: 14697 - DNA, 19 bp, synthetic construct
  misc_feature 1..19: note = Description of Artificial Sequence: Syntheticoligonucleotide
  source 1..19: mol_type = other DNA
cgtgactcgcgagtcacga

SEQ ID NO: 14698 - DNA, 19 bp, synthetic construct
  misc_feature 1..19: note = Description of Artificial Sequence: Syntheticoligonucleotide
  source 1..19: mol_type = other DNA
cgtgactcgcgagtcacgc

SEQ ID NO: 14699 - DNA, 19 bp, synthetic construct
  misc_feature 1..19: note = Description of Artificial Sequence: Syntheticoligonucleotide
  source 1..19: mol_type = other DNA
cgtgactcgcgagtcacgg

SEQ ID NO: 14700 - DNA, 19 bp, synthetic construct
  misc_feature 1..19: note = Description of Artificial Sequence: Syntheticoligonucleotide
  source 1..19: mol_type = other DNA
taggactcgcgagtcctaa

SEQ ID NO: 14701 - DNA, 19 bp, synthetic construct
  misc_feature 1..19: note = Description of Artificial Sequence: Syntheticoligonucleotide
  source 1..19: mol_type = other DNA
taggactcgcgagtcctat

SEQ ID NO: 14702 - DNA, 19 bp, synthetic construct
  misc_feature 1..19: note = Description of Artificial Sequence: Syntheticoligonucleotide
  source 1..19: mol_type = other DNA
taggactcgcgagtcctac

SEQ ID NO: 14703 - DNA, 19 bp, synthetic construct
  misc_feature 1..19: note = Description of Artificial Sequence: Syntheticoligonucleotide
  source 1..19: mol_type = other DNA
aaggactcgcgagtcctta

SEQ ID NO: 14704 - DNA, 19 bp, synthetic construct
  misc_feature 1..19: note = Description of Artificial Sequence: Syntheticoligonucleotide
  source 1..19: mol_type = other DNA
aaggactcgcgagtccttt

SEQ ID NO: 14705 - DNA, 19 bp, synthetic construct
  misc_feature 1..19: note = Description of Artificial Sequence: Syntheticoligonucleotide
  source 1..19: mol_type = other DNA
aaggactcgcgagtccttc

SEQ ID NO: 14706 - DNA, 19 bp, synthetic construct
  misc_feature 1..19: note = Description of Artificial Sequence: Syntheticoligonucleotide
  source 1..19: mol_type = other DNA
aaggactcgcgagtccttg

SEQ ID NO: 14707 - DNA, 19 bp, synthetic construct
  misc_feature 1..19: note = Description of Artificial Sequence: Syntheticoligonucleotide
  source 1..19: mol_type = other DNA
gaggactcgcgagtcctca

SEQ ID NO: 14708 - DNA, 19 bp, synthetic construct
  misc_feature 1..19: note = Description of Artificial Sequence: Syntheticoligonucleotide
  source 1..19: mol_type = other DNA
gaggactcgcgagtcctct

SEQ ID NO: 14709 - DNA, 19 bp, synthetic construct
  misc_feature 1..19: note = Description of Artificial Sequence: Syntheticoligonucleotide
  source 1..19: mol_type = other DNA
gaggactcgcgagtcctcc

SEQ ID NO: 14710 - DNA, 19 bp, synthetic construct
  misc_feature 1..19: note = Description of Artificial Sequence: Syntheticoligonucleotide
  source 1..19: mol_type = other DNA
gaggactcgcgagtcctcg

SEQ ID NO: 14711 - DNA, 19 bp, synthetic construct
  misc_feature 1..19: note = Description of Artificial Sequence: Syntheticoligonucleotide
  source 1..19: mol_type = other DNA
caggactcgcgagtcctga

SEQ ID NO: 14712 - DNA, 19 bp, synthetic construct
  misc_feature 1..19: note = Description of Artificial Sequence: Syntheticoligonucleotide
  source 1..19: mol_type = other DNA
caggactcgcgagtcctgt

SEQ ID NO: 14713 - DNA, 19 bp, synthetic construct
  misc_feature 1..19: note = Description of Artificial Sequence: Syntheticoligonucleotide
  source 1..19: mol_type = other DNA
caggactcgcgagtcctgc

SEQ ID NO: 14714 - DNA, 19 bp, synthetic construct
  misc_feature 1..19: note = Description of Artificial Sequence: Syntheticoligonucleotide
  source 1..19: mol_type = other DNA
caggactcgcgagtcctgg

SEQ ID NO: 14715 - DNA, 19 bp, synthetic construct
  misc_feature 1..19: note = Description of Artificial Sequence: Syntheticoligonucleotide
  source 1..19: mol_type = other DNA
ttggactcgcgagtccaaa

SEQ ID NO: 14716 - DNA, 19 bp, synthetic construct
  misc_feature 1..19: note = Description of Artificial Sequence: Syntheticoligonucleotide
  source 1..19: mol_type = other DNA
ttggactcgcgagtccaat

SEQ ID NO: 14717 - DNA, 19 bp, synthetic construct
  misc_feature 1..19: note = Description of Artificial Sequence: Syntheticoligonucleotide
  source 1..19: mol_type = other DNA
ttggactcgcgagtccaac

SEQ ID NO: 14718 - DNA, 19 bp, synthetic construct
  misc_feature 1..19: note = Description of Artificial Sequence: Syntheticoligonucleotide
  source 1..19: mol_type = other DNA
ttggactcgcgagtccaag

SEQ ID NO: 14719 - DNA, 19 bp, synthetic construct
  misc_feature 1..19: note = Description of Artificial Sequence: Syntheticoligonucleotide
  source 1..19: mol_type = other DNA
atggactcgcgagtccata

SEQ ID NO: 14720 - DNA, 19 bp, synthetic construct
  misc_feature 1..19: note = Description of Artificial Sequence: Syntheticoligonucleotide
  source 1..19: mol_type = other DNA
atggactcgcgagtccatt

SEQ ID NO: 14721 - DNA, 19 bp, synthetic construct
  misc_feature 1..19: note = Description of Artificial Sequence: Syntheticoligonucleotide
  source 1..19: mol_type = other DNA
atggactcgcgagtccatc

SEQ ID NO: 14722 - DNA, 19 bp, synthetic construct
  misc_feature 1..19: note = Description of Artificial Sequence: Syntheticoligonucleotide
  source 1..19: mol_type = other DNA
gtggactcgcgagtccaca

SEQ ID NO: 14723 - DNA, 19 bp, synthetic construct
  misc_feature 1..19: note = Description of Artificial Sequence: Syntheticoligonucleotide
  source 1..19: mol_type = other DNA
gtggactcgcgagtccact

SEQ ID NO: 14724 - DNA, 19 bp, synthetic construct
  misc_feature 1..19: note = Description of Artificial Sequence: Syntheticoligonucleotide
  source 1..19: mol_type = other DNA
gtggactcgcgagtccacc

SEQ ID NO: 14725 - DNA, 19 bp, synthetic construct
  misc_feature 1..19: note = Description of Artificial Sequence: Syntheticoligonucleotide
  source 1..19: mol_type = other DNA
gtggactcgcgagtccacg

SEQ ID NO: 14726 - DNA, 19 bp, synthetic construct
  misc_feature 1..19: note = Description of Artificial Sequence: Syntheticoligonucleotide
  source 1..19: mol_type = other DNA
ctggactcgcgagtccaga

SEQ ID NO: 14727 - DNA, 19 bp, synthetic construct
  misc_feature 1..19: note = Description of Artificial Sequence: Syntheticoligonucleotide
  source 1..19: mol_type = other DNA
ctggactcgcgagtccagt

SEQ ID NO: 14728 - DNA, 19 bp, synthetic construct
  misc_feature 1..19: note = Description of Artificial Sequence: Syntheticoligonucleotide
  source 1..19: mol_type = other DNA
ctggactcgcgagtccagc

SEQ ID NO: 14729 - DNA, 19 bp, synthetic construct
  misc_feature 1..19: note = Description of Artificial Sequence: Syntheticoligonucleotide
  source 1..19: mol_type = other DNA
ctggactcgcgagtccagg

SEQ ID NO: 14730 - DNA, 19 bp, synthetic construct
  misc_feature 1..19: note = Description of Artificial Sequence: Syntheticoligonucleotide
  source 1..19: mol_type = other DNA
tgggactcgcgagtcccaa

SEQ ID NO: 14731 - DNA, 19 bp, synthetic construct
  misc_feature 1..19: note = Description of Artificial Sequence: Syntheticoligonucleotide
  source 1..19: mol_type = other DNA
tgggactcgcgagtcccat

SEQ ID NO: 14732 - DNA, 19 bp, synthetic construct
  misc_feature 1..19: note = Description of Artificial Sequence: Syntheticoligonucleotide
  source 1..19: mol_type = other DNA
tgggactcgcgagtcccac

SEQ ID NO: 14733 - DNA, 19 bp, synthetic construct
  misc_feature 1..19: note = Description of Artificial Sequence: Syntheticoligonucleotide
  source 1..19: mol_type = other DNA
tgggactcgcgagtcccag

SEQ ID NO: 14734 - DNA, 19 bp, synthetic construct
  misc_feature 1..19: note = Description of Artificial Sequence: Syntheticoligonucleotide
  source 1..19: mol_type = other DNA
agggactcgcgagtcccta

SEQ ID NO: 14735 - DNA, 19 bp, synthetic construct
  misc_feature 1..19: note = Description of Artificial Sequence: Syntheticoligonucleotide
  source 1..19: mol_type = other DNA
agggactcgcgagtccctt

SEQ ID NO: 14736 - DNA, 19 bp, synthetic construct
  misc_feature 1..19: note = Description of Artificial Sequence: Syntheticoligonucleotide
  source 1..19: mol_type = other DNA
agggactcgcgagtccctc

SEQ ID NO: 14737 - DNA, 19 bp, synthetic construct
  misc_feature 1..19: note = Description of Artificial Sequence: Syntheticoligonucleotide
  source 1..19: mol_type = other DNA
agggactcgcgagtccctg

SEQ ID NO: 14738 - DNA, 19 bp, synthetic construct
  misc_feature 1..19: note = Description of Artificial Sequence: Syntheticoligonucleotide
  source 1..19: mol_type = other DNA
ggggactcgcgagtcccca

SEQ ID NO: 14739 - DNA, 19 bp, synthetic construct
  misc_feature 1..19: note = Description of Artificial Sequence: Syntheticoligonucleotide
  source 1..19: mol_type = other DNA
ggggactcgcgagtcccct

SEQ ID NO: 14740 - DNA, 19 bp, synthetic construct
  misc_feature 1..19: note = Description of Artificial Sequence: Syntheticoligonucleotide
  source 1..19: mol_type = other DNA
ggggactcgcgagtccccg

SEQ ID NO: 14741 - DNA, 19 bp, synthetic construct
  misc_feature 1..19: note = Description of Artificial Sequence: Syntheticoligonucleotide
  source 1..19: mol_type = other DNA
cgggactcgcgagtcccga

SEQ ID NO: 14742 - DNA, 19 bp, synthetic construct
  misc_feature 1..19: note = Description of Artificial Sequence: Syntheticoligonucleotide
  source 1..19: mol_type = other DNA
cgggactcgcgagtcccgt

SEQ ID NO: 14743 - DNA, 19 bp, synthetic construct
  misc_feature 1..19: note = Description of Artificial Sequence: Syntheticoligonucleotide
  source 1..19: mol_type = other DNA
cgggactcgcgagtcccgc

SEQ ID NO: 14744 - DNA, 19 bp, synthetic construct
  misc_feature 1..19: note = Description of Artificial Sequence: Syntheticoligonucleotide
  source 1..19: mol_type = other DNA
aaagactcgcgagtcttta

SEQ ID NO: 14745 - DNA, 19 bp, synthetic construct
  misc_feature 1..19: note = Description of Artificial Sequence: Syntheticoligonucleotide
  source 1..19: mol_type = other DNA
aaagactcgcgagtctttt

SEQ ID NO: 14746 - DNA, 19 bp, synthetic construct
  misc_feature 1..19: note = Description of Artificial Sequence: Syntheticoligonucleotide
  source 1..19: mol_type = other DNA
aaagactcgcgagtctttc

SEQ ID NO: 14747 - DNA, 19 bp, synthetic construct
  misc_feature 1..19: note = Description of Artificial Sequence: Syntheticoligonucleotide
  source 1..19: mol_type = other DNA
aaagactcgcgagtctttg

SEQ ID NO: 14748 - DNA, 19 bp, synthetic construct
  misc_feature 1..19: note = Description of Artificial Sequence: Syntheticoligonucleotide
  source 1..19: mol_type = other DNA
gaagactcgcgagtcttca

SEQ ID NO: 14749 - DNA, 19 bp, synthetic construct
  misc_feature 1..19: note = Description of Artificial Sequence: Syntheticoligonucleotide
  source 1..19: mol_type = other DNA
gaagactcgcgagtcttct

SEQ ID NO: 14750 - DNA, 19 bp, synthetic construct
  misc_feature 1..19: note = Description of Artificial Sequence: Syntheticoligonucleotide
  source 1..19: mol_type = other DNA
gaagactcgcgagtcttcc

SEQ ID NO: 14751 - DNA, 19 bp, synthetic construct
  misc_feature 1..19: note = Description of Artificial Sequence: Syntheticoligonucleotide
  source 1..19: mol_type = other DNA
gaagactcgcgagtcttcg

SEQ ID NO: 14752 - DNA, 19 bp, synthetic construct
  misc_feature 1..19: note = Description of Artificial Sequence: Syntheticoligonucleotide
  source 1..19: mol_type = other DNA
caagactcgcgagtcttga

SEQ ID NO: 14753 - DNA, 19 bp, synthetic construct
  misc_feature 1..19: note = Description of Artificial Sequence: Syntheticoligonucleotide
  source 1..19: mol_type = other DNA
caagactcgcgagtcttgt

SEQ ID NO: 14754 - DNA, 19 bp, synthetic construct
  misc_feature 1..19: note = Description of Artificial Sequence: Syntheticoligonucleotide
  source 1..19: mol_type = other DNA
caagactcgcgagtcttgc

SEQ ID NO: 14755 - DNA, 19 bp, synthetic construct
  misc_feature 1..19: note = Description of Artificial Sequence: Syntheticoligonucleotide
  source 1..19: mol_type = other DNA
caagactcgcgagtcttgg

SEQ ID NO: 14756 - DNA, 19 bp, synthetic construct
  misc_feature 1..19: note = Description of Artificial Sequence: Syntheticoligonucleotide
  source 1..19: mol_type = other DNA
tttgactcgcgagtcaaaa

SEQ ID NO: 14757 - DNA, 19 bp, synthetic construct
  misc_feature 1..19: note = Description of Artificial Sequence: Syntheticoligonucleotide
  source 1..19: mol_type = other DNA
tttgactcgcgagtcaaat

SEQ ID NO: 14758 - DNA, 19 bp, synthetic construct
  misc_feature 1..19: note = Description of Artificial Sequence: Syntheticoligonucleotide
  source 1..19: mol_type = other DNA
tttgactcgcgagtcaaac

SEQ ID NO: 14759 - DNA, 19 bp, synthetic construct
  misc_feature 1..19: note = Description of Artificial Sequence: Syntheticoligonucleotide
  source 1..19: mol_type = other DNA
tttgactcgcgagtcaaag

SEQ ID NO: 14760 - DNA, 19 bp, synthetic construct
  misc_feature 1..19: note = Description of Artificial Sequence: Syntheticoligonucleotide
  source 1..19: mol_type = other DNA
attgactcgcgagtcaata

SEQ ID NO: 14761 - DNA, 19 bp, synthetic construct
  misc_feature 1..19: note = Description of Artificial Sequence: Syntheticoligonucleotide
  source 1..19: mol_type = other DNA
attgactcgcgagtcaatc

SEQ ID NO: 14762 - DNA, 19 bp, synthetic construct
  misc_feature 1..19: note = Description of Artificial Sequence: Syntheticoligonucleotide
  source 1..19: mol_type = other DNA
attgactcgcgagtcaatg

SEQ ID NO: 14763 - DNA, 19 bp, synthetic construct
  misc_feature 1..19: note = Description of Artificial Sequence: Syntheticoligonucleotide
  source 1..19: mol_type = other DNA
gttgactcgcgagtcaaca

SEQ ID NO: 14764 - DNA, 19 bp, synthetic construct
  misc_feature 1..19: note = Description of Artificial Sequence: Syntheticoligonucleotide
  source 1..19: mol_type = other DNA
gttgactcgcgagtcaact

SEQ ID NO: 14765 - DNA, 19 bp, synthetic construct
  misc_feature 1..19: note = Description of Artificial Sequence: Syntheticoligonucleotide
  source 1..19: mol_type = other DNA
gttgactcgcgagtcaacc

SEQ ID NO: 14766 - DNA, 19 bp, synthetic construct
  misc_feature 1..19: note = Description of Artificial Sequence: Syntheticoligonucleotide
  source 1..19: mol_type = other DNA
gttgactcgcgagtcaacg

SEQ ID NO: 14767 - DNA, 19 bp, synthetic construct
  misc_feature 1..19: note = Description of Artificial Sequence: Syntheticoligonucleotide
  source 1..19: mol_type = other DNA
cttgactcgcgagtcaaga

SEQ ID NO: 14768 - DNA, 19 bp, synthetic construct
  misc_feature 1..19: note = Description of Artificial Sequence: Syntheticoligonucleotide
  source 1..19: mol_type = other DNA
cttgactcgcgagtcaagt

SEQ ID NO: 14769 - DNA, 19 bp, synthetic construct
  misc_feature 1..19: note = Description of Artificial Sequence: Syntheticoligonucleotide
  source 1..19: mol_type = other DNA
cttgactcgcgagtcaagc

SEQ ID NO: 14770 - DNA, 19 bp, synthetic construct
  misc_feature 1..19: note = Description of Artificial Sequence: Syntheticoligonucleotide
  source 1..19: mol_type = other DNA
cttgactcgcgagtcaagg

SEQ ID NO: 14771 - DNA, 19 bp, synthetic construct
  misc_feature 1..19: note = Description of Artificial Sequence: Syntheticoligonucleotide
  source 1..19: mol_type = other DNA
aatgactcgcgagtcatta

SEQ ID NO: 14772 - DNA, 19 bp, synthetic construct
  misc_feature 1..19: note = Description of Artificial Sequence: Syntheticoligonucleotide
  source 1..19: mol_type = other DNA
aatgactcgcgagtcattt

SEQ ID NO: 14773 - DNA, 19 bp, synthetic construct
  misc_feature 1..19: note = Description of Artificial Sequence: Syntheticoligonucleotide
  source 1..19: mol_type = other DNA
aatgactcgcgagtcattc

SEQ ID NO: 14774 - DNA, 19 bp, synthetic construct
  misc_feature 1..19: note = Description of Artificial Sequence: Syntheticoligonucleotide
  source 1..19: mol_type = other DNA
aatgactcgcgagtcattg

SEQ ID NO: 14775 - DNA, 19 bp, synthetic construct
  misc_feature 1..19: note = Description of Artificial Sequence: Syntheticoligonucleotide
  source 1..19: mol_type = other DNA
gatgactcgcgagtcatca

SEQ ID NO: 14776 - DNA, 19 bp, synthetic construct
  misc_feature 1..19: note = Description of Artificial Sequence: Syntheticoligonucleotide
  source 1..19: mol_type = other DNA
gatgactcgcgagtcatct

SEQ ID NO: 14777 - DNA, 19 bp, synthetic construct
  misc_feature 1..19: note = Description of Artificial Sequence: Syntheticoligonucleotide
  source 1..19: mol_type = other DNA
gatgactcgcgagtcatcc

SEQ ID NO: 14778 - DNA, 19 bp, synthetic construct
  misc_feature 1..19: note = Description of Artificial Sequence: Syntheticoligonucleotide
  source 1..19: mol_type = other DNA
gatgactcgcgagtcatcg

SEQ ID NO: 14779 - DNA, 19 bp, synthetic construct
  misc_feature 1..19: note = Description of Artificial Sequence: Syntheticoligonucleotide
  source 1..19: mol_type = other DNA
catgactcgcgagtcatga

SEQ ID NO: 14780 - DNA, 19 bp, synthetic construct
  misc_feature 1..19: note = Description of Artificial Sequence: Syntheticoligonucleotide
  source 1..19: mol_type = other DNA
catgactcgcgagtcatgt

SEQ ID NO: 14781 - DNA, 19 bp, synthetic construct
  misc_feature 1..19: note = Description of Artificial Sequence: Syntheticoligonucleotide
  source 1..19: mol_type = other DNA
catgactcgcgagtcatgc

SEQ ID NO: 14782 - DNA, 19 bp, synthetic construct
  misc_feature 1..19: note = Description of Artificial Sequence: Syntheticoligonucleotide
  source 1..19: mol_type = other DNA
catgactcgcgagtcatgg

SEQ ID NO: 14783 - DNA, 19 bp, synthetic construct
  misc_feature 1..19: note = Description of Artificial Sequence: Syntheticoligonucleotide
  source 1..19: mol_type = other DNA
gtagactcgcgagtctaca

SEQ ID NO: 14784 - DNA, 19 bp, synthetic construct
  misc_feature 1..19: note = Description of Artificial Sequence: Syntheticoligonucleotide
  source 1..19: mol_type = other DNA
gtagactcgcgagtctact

SEQ ID NO: 14785 - DNA, 19 bp, synthetic construct
  misc_feature 1..19: note = Description of Artificial Sequence: Syntheticoligonucleotide
  source 1..19: mol_type = other DNA
gtagactcgcgagtctacc

SEQ ID NO: 14786 - DNA, 19 bp, synthetic construct
  misc_feature 1..19: note = Description of Artificial Sequence: Syntheticoligonucleotide
  source 1..19: mol_type = other DNA
gtagactcgcgagtctacg

SEQ ID NO: 14787 - DNA, 19 bp, synthetic construct
  misc_feature 1..19: note = Description of Artificial Sequence: Syntheticoligonucleotide
  source 1..19: mol_type = other DNA
ctagactcgcgagtctaga

SEQ ID NO: 14788 - DNA, 19 bp, synthetic construct
  misc_feature 1..19: note = Description of Artificial Sequence: Syntheticoligonucleotide
  source 1..19: mol_type = other DNA
ctagactcgcgagtctagt

SEQ ID NO: 14789 - DNA, 19 bp, synthetic construct
  misc_feature 1..19: note = Description of Artificial Sequence: Syntheticoligonucleotide
  source 1..19: mol_type = other DNA
ctagactcgcgagtctagc

SEQ ID NO: 14790 - DNA, 19 bp, synthetic construct
  misc_feature 1..19: note = Description of Artificial Sequence: Syntheticoligonucleotide
  source 1..19: mol_type = other DNA
ctagactcgcgagtctagg

SEQ ID NO: 14791 - DNA, 19 bp, synthetic construct
  misc_feature 1..19: note = Description of Artificial Sequence: Syntheticoligonucleotide
  source 1..19: mol_type = other DNA
tcagactccggagtctgaa

SEQ ID NO: 14792 - DNA, 19 bp, synthetic construct
  misc_feature 1..19: note = Description of Artificial Sequence: Syntheticoligonucleotide
  source 1..19: mol_type = other DNA
tcagactccggagtctgat

SEQ ID NO: 14793 - DNA, 19 bp, synthetic construct
  misc_feature 1..19: note = Description of Artificial Sequence: Syntheticoligonucleotide
  source 1..19: mol_type = other DNA
tcagactccggagtctgac

SEQ ID NO: 14794 - DNA, 19 bp, synthetic construct
  misc_feature 1..19: note = Description of Artificial Sequence: Syntheticoligonucleotide
  source 1..19: mol_type = other DNA
tcagactccggagtctgag

SEQ ID NO: 14795 - DNA, 19 bp, synthetic construct
  misc_feature 1..19: note = Description of Artificial Sequence: Syntheticoligonucleotide
  source 1..19: mol_type = other DNA
acagactccggagtctgta

SEQ ID NO: 14796 - DNA, 19 bp, synthetic construct
  misc_feature 1..19: note = Description of Artificial Sequence: Syntheticoligonucleotide
  source 1..19: mol_type = other DNA
acagactccggagtctgtt

SEQ ID NO: 14797 - DNA, 19 bp, synthetic construct
  misc_feature 1..19: note = Description of Artificial Sequence: Syntheticoligonucleotide
  source 1..19: mol_type = other DNA
acagactccggagtctgtc

SEQ ID NO: 14798 - DNA, 19 bp, synthetic construct
  misc_feature 1..19: note = Description of Artificial Sequence: Syntheticoligonucleotide
  source 1..19: mol_type = other DNA
acagactccggagtctgtg

SEQ ID NO: 14799 - DNA, 19 bp, synthetic construct
  misc_feature 1..19: note = Description of Artificial Sequence: Syntheticoligonucleotide
  source 1..19: mol_type = other DNA
gcagactccggagtctgct

SEQ ID NO: 14800 - DNA, 19 bp, synthetic construct
  misc_feature 1..19: note = Description of Artificial Sequence: Syntheticoligonucleotide
  source 1..19: mol_type = other DNA
gcagactccggagtctgcc

SEQ ID NO: 14801 - DNA, 19 bp, synthetic construct
  misc_feature 1..19: note = Description of Artificial Sequence: Syntheticoligonucleotide
  source 1..19: mol_type = other DNA
gcagactccggagtctgcg

SEQ ID NO: 14802 - DNA, 19 bp, synthetic construct
  misc_feature 1..19: note = Description of Artificial Sequence: Syntheticoligonucleotide
  source 1..19: mol_type = other DNA
ccagactccggagtctgga

SEQ ID NO: 14803 - DNA, 19 bp, synthetic construct
  misc_feature 1..19: note = Description of Artificial Sequence: Syntheticoligonucleotide
  source 1..19: mol_type = other DNA
ccagactccggagtctggt

SEQ ID NO: 14804 - DNA, 19 bp, synthetic construct
  misc_feature 1..19: note = Description of Artificial Sequence: Syntheticoligonucleotide
  source 1..19: mol_type = other DNA
ccagactccggagtctggc

SEQ ID NO: 14805 - DNA, 19 bp, synthetic construct
  misc_feature 1..19: note = Description of Artificial Sequence: Syntheticoligonucleotide
  source 1..19: mol_type = other DNA
ccagactccggagtctggg

SEQ ID NO: 14806 - DNA, 19 bp, synthetic construct
  misc_feature 1..19: note = Description of Artificial Sequence: Syntheticoligonucleotide
  source 1..19: mol_type = other DNA
tctgactccggagtcagaa

SEQ ID NO: 14807 - DNA, 19 bp, synthetic construct
  misc_feature 1..19: note = Description of Artificial Sequence: Syntheticoligonucleotide
  source 1..19: mol_type = other DNA
tctgactccggagtcagat

SEQ ID NO: 14808 - DNA, 19 bp, synthetic construct
  misc_feature 1..19: note = Description of Artificial Sequence: Syntheticoligonucleotide
  source 1..19: mol_type = other DNA
tctgactccggagtcagac

SEQ ID NO: 14809 - DNA, 19 bp, synthetic construct
  misc_feature 1..19: note = Description of Artificial Sequence: Syntheticoligonucleotide
  source 1..19: mol_type = other DNA
tctgactccggagtcagag

SEQ ID NO: 14810 - DNA, 19 bp, synthetic construct
  misc_feature 1..19: note = Description of Artificial Sequence: Syntheticoligonucleotide
  source 1..19: mol_type = other DNA
actgactccggagtcagta

SEQ ID NO: 14811 - DNA, 19 bp, synthetic construct
  misc_feature 1..19: note = Description of Artificial Sequence: Syntheticoligonucleotide
  source 1..19: mol_type = other DNA
actgactccggagtcagtt

SEQ ID NO: 14812 - DNA, 19 bp, synthetic construct
  misc_feature 1..19: note = Description of Artificial Sequence: Syntheticoligonucleotide
  source 1..19: mol_type = other DNA
actgactccggagtcagtc

SEQ ID NO: 14813 - DNA, 19 bp, synthetic construct
  misc_feature 1..19: note = Description of Artificial Sequence: Syntheticoligonucleotide
  source 1..19: mol_type = other DNA
actgactccggagtcagtg

SEQ ID NO: 14814 - DNA, 19 bp, synthetic construct
  misc_feature 1..19: note = Description of Artificial Sequence: Syntheticoligonucleotide
  source 1..19: mol_type = other DNA
gctgactccggagtcagca

SEQ ID NO: 14815 - DNA, 19 bp, synthetic construct
  misc_feature 1..19: note = Description of Artificial Sequence: Syntheticoligonucleotide
  source 1..19: mol_type = other DNA
gctgactccggagtcagcc

SEQ ID NO: 14816 - DNA, 19 bp, synthetic construct
  misc_feature 1..19: note = Description of Artificial Sequence: Syntheticoligonucleotide
  source 1..19: mol_type = other DNA
gctgactccggagtcagcg

SEQ ID NO: 14817 - DNA, 19 bp, synthetic construct
  misc_feature 1..19: note = Description of Artificial Sequence: Syntheticoligonucleotide
  source 1..19: mol_type = other DNA
cctgactccggagtcagga

SEQ ID NO: 14818 - DNA, 19 bp, synthetic construct
  misc_feature 1..19: note = Description of Artificial Sequence: Syntheticoligonucleotide
  source 1..19: mol_type = other DNA
cctgactccggagtcaggt

SEQ ID NO: 14819 - DNA, 19 bp, synthetic construct
  misc_feature 1..19: note = Description of Artificial Sequence: Syntheticoligonucleotide
  source 1..19: mol_type = other DNA
cctgactccggagtcaggc

SEQ ID NO: 14820 - DNA, 19 bp, synthetic construct
  misc_feature 1..19: note = Description of Artificial Sequence: Syntheticoligonucleotide
  source 1..19: mol_type = other DNA
cctgactccggagtcaggg

SEQ ID NO: 14821 - DNA, 19 bp, synthetic construct
  misc_feature 1..19: note = Description of Artificial Sequence: Syntheticoligonucleotide
  source 1..19: mol_type = other DNA
tacgactccggagtcgtaa

SEQ ID NO: 14822 - DNA, 19 bp, synthetic construct
  misc_feature 1..19: note = Description of Artificial Sequence: Syntheticoligonucleotide
  source 1..19: mol_type = other DNA
tacgactccggagtcgtat

SEQ ID NO: 14823 - DNA, 19 bp, synthetic construct
  misc_feature 1..19: note = Description of Artificial Sequence: Syntheticoligonucleotide
  source 1..19: mol_type = other DNA
tacgactccggagtcgtag

SEQ ID NO: 14824 - DNA, 19 bp, synthetic construct
  misc_feature 1..19: note = Description of Artificial Sequence: Syntheticoligonucleotide
  source 1..19: mol_type = other DNA
aacgactccggagtcgtta

SEQ ID NO: 14825 - DNA, 19 bp, synthetic construct
  misc_feature 1..19: note = Description of Artificial Sequence: Syntheticoligonucleotide
  source 1..19: mol_type = other DNA
aacgactccggagtcgttt

SEQ ID NO: 14826 - DNA, 19 bp, synthetic construct
  misc_feature 1..19: note = Description of Artificial Sequence: Syntheticoligonucleotide
  source 1..19: mol_type = other DNA
aacgactccggagtcgttc

SEQ ID NO: 14827 - DNA, 19 bp, synthetic construct
  misc_feature 1..19: note = Description of Artificial Sequence: Syntheticoligonucleotide
  source 1..19: mol_type = other DNA
aacgactccggagtcgttg

SEQ ID NO: 14828 - DNA, 19 bp, synthetic construct
  misc_feature 1..19: note = Description of Artificial Sequence: Syntheticoligonucleotide
  source 1..19: mol_type = other DNA
gacgactccggagtcgtca

SEQ ID NO: 14829 - DNA, 19 bp, synthetic construct
  misc_feature 1..19: note = Description of Artificial Sequence: Syntheticoligonucleotide
  source 1..19: mol_type = other DNA
gacgactccggagtcgtct

SEQ ID NO: 14830 - DNA, 19 bp, synthetic construct
  misc_feature 1..19: note = Description of Artificial Sequence: Syntheticoligonucleotide
  source 1..19: mol_type = other DNA
gacgactccggagtcgtcc

SEQ ID NO: 14831 - DNA, 19 bp, synthetic construct
  misc_feature 1..19: note = Description of Artificial Sequence: Syntheticoligonucleotide
  source 1..19: mol_type = other DNA
gacgactccggagtcgtcg

SEQ ID NO: 14832 - DNA, 19 bp, synthetic construct
  misc_feature 1..19: note = Description of Artificial Sequence: Syntheticoligonucleotide
  source 1..19: mol_type = other DNA
cacgactccggagtcgtga

SEQ ID NO: 14833 - DNA, 19 bp, synthetic construct
  misc_feature 1..19: note = Description of Artificial Sequence: Syntheticoligonucleotide
  source 1..19: mol_type = other DNA
cacgactccggagtcgtgt

SEQ ID NO: 14834 - DNA, 19 bp, synthetic construct
  misc_feature 1..19: note = Description of Artificial Sequence: Syntheticoligonucleotide
  source 1..19: mol_type = other DNA
cacgactccggagtcgtgc

SEQ ID NO: 14835 - DNA, 19 bp, synthetic construct
  misc_feature 1..19: note = Description of Artificial Sequence: Syntheticoligonucleotide
  source 1..19: mol_type = other DNA
cacgactccggagtcgtgg

SEQ ID NO: 14836 - DNA, 19 bp, synthetic construct
  misc_feature 1..19: note = Description of Artificial Sequence: Syntheticoligonucleotide
  source 1..19: mol_type = other DNA
tccgactccggagtcggaa

SEQ ID NO: 14837 - DNA, 19 bp, synthetic construct
  misc_feature 1..19: note = Description of Artificial Sequence: Syntheticoligonucleotide
  source 1..19: mol_type = other DNA
tccgactccggagtcggat

SEQ ID NO: 14838 - DNA, 19 bp, synthetic construct
  misc_feature 1..19: note = Description of Artificial Sequence: Syntheticoligonucleotide
  source 1..19: mol_type = other DNA
tccgactccggagtcggac

SEQ ID NO: 14839 - DNA, 19 bp, synthetic construct
  misc_feature 1..19: note = Description of Artificial Sequence: Syntheticoligonucleotide
  source 1..19: mol_type = other DNA
tccgactccggagtcggag

SEQ ID NO: 14840 - DNA, 19 bp, synthetic construct
  misc_feature 1..19: note = Description of Artificial Sequence: Syntheticoligonucleotide
  source 1..19: mol_type = other DNA
accgactccggagtcggta

SEQ ID NO: 14841 - DNA, 19 bp, synthetic construct
  misc_feature 1..19: note = Description of Artificial Sequence: Syntheticoligonucleotide
  source 1..19: mol_type = other DNA
accgactccggagtcggtt

SEQ ID NO: 14842 - DNA, 19 bp, synthetic construct
  misc_feature 1..19: note = Description of Artificial Sequence: Syntheticoligonucleotide
  source 1..19: mol_type = other DNA
accgactccggagtcggtc

SEQ ID NO: 14843 - DNA, 19 bp, synthetic construct
  misc_feature 1..19: note = Description of Artificial Sequence: Syntheticoligonucleotide
  source 1..19: mol_type = other DNA
accgactccggagtcggtg

SEQ ID NO: 14844 - DNA, 19 bp, synthetic construct
  misc_feature 1..19: note = Description of Artificial Sequence: Syntheticoligonucleotide
  source 1..19: mol_type = other DNA
gccgactccggagtcggca

SEQ ID NO: 14845 - DNA, 19 bp, synthetic construct
  misc_feature 1..19: note = Description of Artificial Sequence: Syntheticoligonucleotide
  source 1..19: mol_type = other DNA
gccgactccggagtcggct

SEQ ID NO: 14846 - DNA, 19 bp, synthetic construct
  misc_feature 1..19: note = Description of Artificial Sequence: Syntheticoligonucleotide
  source 1..19: mol_type = other DNA
gccgactccggagtcggcg

SEQ ID NO: 14847 - DNA, 19 bp, synthetic construct
  misc_feature 1..19: note = Description of Artificial Sequence: Syntheticoligonucleotide
  source 1..19: mol_type = other DNA
cccgactccggagtcggga

SEQ ID NO: 14848 - DNA, 19 bp, synthetic construct
  misc_feature 1..19: note = Description of Artificial Sequence: Syntheticoligonucleotide
  source 1..19: mol_type = other DNA
cccgactccggagtcgggt

SEQ ID NO: 14849 - DNA, 19 bp, synthetic construct
  misc_feature 1..19: note = Description of Artificial Sequence: Syntheticoligonucleotide
  source 1..19: mol_type = other DNA
cccgactccggagtcgggc

SEQ ID NO: 14850 - DNA, 19 bp, synthetic construct
  misc_feature 1..19: note = Description of Artificial Sequence: Syntheticoligonucleotide
  source 1..19: mol_type = other DNA
tgagactccggagtctcaa

SEQ ID NO: 14851 - DNA, 19 bp, synthetic construct
  misc_feature 1..19: note = Description of Artificial Sequence: Syntheticoligonucleotide
  source 1..19: mol_type = other DNA
tgagactccggagtctcat

SEQ ID NO: 14852 - DNA, 19 bp, synthetic construct
  misc_feature 1..19: note = Description of Artificial Sequence: Syntheticoligonucleotide
  source 1..19: mol_type = other DNA
tgagactccggagtctcac

SEQ ID NO: 14853 - DNA, 19 bp, synthetic construct
  misc_feature 1..19: note = Description of Artificial Sequence: Syntheticoligonucleotide
  source 1..19: mol_type = other DNA
tgagactccggagtctcag

SEQ ID NO: 14854 - DNA, 19 bp, synthetic construct
  misc_feature 1..19: note = Description of Artificial Sequence: Syntheticoligonucleotide
  source 1..19: mol_type = other DNA
agagactccggagtctcta

SEQ ID NO: 14855 - DNA, 19 bp, synthetic construct
  misc_feature 1..19: note = Description of Artificial Sequence: Syntheticoligonucleotide
  source 1..19: mol_type = other DNA
agagactccggagtctctt

SEQ ID NO: 14856 - DNA, 19 bp, synthetic construct
  misc_feature 1..19: note = Description of Artificial Sequence: Syntheticoligonucleotide
  source 1..19: mol_type = other DNA
agagactccggagtctctc

SEQ ID NO: 14857 - DNA, 19 bp, synthetic construct
  misc_feature 1..19: note = Description of Artificial Sequence: Syntheticoligonucleotide
  source 1..19: mol_type = other DNA
agagactccggagtctctg

SEQ ID NO: 14858 - DNA, 19 bp, synthetic construct
  misc_feature 1..19: note = Description of Artificial Sequence: Syntheticoligonucleotide
  source 1..19: mol_type = other DNA
ggagactccggagtctcca

SEQ ID NO: 14859 - DNA, 19 bp, synthetic construct
  misc_feature 1..19: note = Description of Artificial Sequence: Syntheticoligonucleotide
  source 1..19: mol_type = other DNA
ggagactccggagtctcct

SEQ ID NO: 14860 - DNA, 19 bp, synthetic construct
  misc_feature 1..19: note = Description of Artificial Sequence: Syntheticoligonucleotide
  source 1..19: mol_type = other DNA
ggagactccggagtctccc

SEQ ID NO: 14861 - DNA, 19 bp, synthetic construct
  misc_feature 1..19: note = Description of Artificial Sequence: Syntheticoligonucleotide
  source 1..19: mol_type = other DNA
ggagactccggagtctccg

SEQ ID NO: 14862 - DNA, 19 bp, synthetic construct
  misc_feature 1..19: note = Description of Artificial Sequence: Syntheticoligonucleotide
  source 1..19: mol_type = other DNA
cgagactccggagtctcgt

SEQ ID NO: 14863 - DNA, 19 bp, synthetic construct
  misc_feature 1..19: note = Description of Artificial Sequence: Syntheticoligonucleotide
  source 1..19: mol_type = other DNA
cgagactccggagtctcgc

SEQ ID NO: 14864 - DNA, 19 bp, synthetic construct
  misc_feature 1..19: note = Description of Artificial Sequence: Syntheticoligonucleotide
  source 1..19: mol_type = other DNA
cgagactccggagtctcgg

SEQ ID NO: 14865 - DNA, 19 bp, synthetic construct
  misc_feature 1..19: note = Description of Artificial Sequence: Syntheticoligonucleotide
  source 1..19: mol_type = other DNA
tgtgactccggagtcacaa

SEQ ID NO: 14866 - DNA, 19 bp, synthetic construct
  misc_feature 1..19: note = Description of Artificial Sequence: Syntheticoligonucleotide
  source 1..19: mol_type = other DNA
tgtgactccggagtcacat

SEQ ID NO: 14867 - DNA, 19 bp, synthetic construct
  misc_feature 1..19: note = Description of Artificial Sequence: Syntheticoligonucleotide
  source 1..19: mol_type = other DNA
tgtgactccggagtcacac

SEQ ID NO: 14868 - DNA, 19 bp, synthetic construct
  misc_feature 1..19: note = Description of Artificial Sequence: Syntheticoligonucleotide
  source 1..19: mol_type = other DNA
tgtgactccggagtcacag

SEQ ID NO: 14869 - DNA, 19 bp, synthetic construct
  misc_feature 1..19: note = Description of Artificial Sequence: Syntheticoligonucleotide
  source 1..19: mol_type = other DNA
agtgactccggagtcacta

SEQ ID NO: 14870 - DNA, 19 bp, synthetic construct
  misc_feature 1..19: note = Description of Artificial Sequence: Syntheticoligonucleotide
  source 1..19: mol_type = other DNA
agtgactccggagtcactt

SEQ ID NO: 14871 - DNA, 19 bp, synthetic construct
  misc_feature 1..19: note = Description of Artificial Sequence: Syntheticoligonucleotide
  source 1..19: mol_type = other DNA
agtgactccggagtcactc

SEQ ID NO: 14872 - DNA, 19 bp, synthetic construct
  misc_feature 1..19: note = Description of Artificial Sequence: Syntheticoligonucleotide
  source 1..19: mol_type = other DNA
agtgactccggagtcactg

SEQ ID NO: 14873 - DNA, 19 bp, synthetic construct
  misc_feature 1..19: note = Description of Artificial Sequence: Syntheticoligonucleotide
  source 1..19: mol_type = other DNA
ggtgactccggagtcacca

SEQ ID NO: 14874 - DNA, 19 bp, synthetic construct
  misc_feature 1..19: note = Description of Artificial Sequence: Syntheticoligonucleotide
  source 1..19: mol_type = other DNA
ggtgactccggagtcacct

SEQ ID NO: 14875 - DNA, 19 bp, synthetic construct
  misc_feature 1..19: note = Description of Artificial Sequence: Syntheticoligonucleotide
  source 1..19: mol_type = other DNA
ggtgactccggagtcaccc

SEQ ID NO: 14876 - DNA, 19 bp, synthetic construct
  misc_feature 1..19: note = Description of Artificial Sequence: Syntheticoligonucleotide
  source 1..19: mol_type = other DNA
ggtgactccggagtcaccg

SEQ ID NO: 14877 - DNA, 19 bp, synthetic construct
  misc_feature 1..19: note = Description of Artificial Sequence: Syntheticoligonucleotide
  source 1..19: mol_type = other DNA
cgtgactccggagtcacga

SEQ ID NO: 14878 - DNA, 19 bp, synthetic construct
  misc_feature 1..19: note = Description of Artificial Sequence: Syntheticoligonucleotide
  source 1..19: mol_type = other DNA
cgtgactccggagtcacgc

SEQ ID NO: 14879 - DNA, 19 bp, synthetic construct
  misc_feature 1..19: note = Description of Artificial Sequence: Syntheticoligonucleotide
  source 1..19: mol_type = other DNA
cgtgactccggagtcacgg

SEQ ID NO: 14880 - DNA, 19 bp, synthetic construct
  misc_feature 1..19: note = Description of Artificial Sequence: Syntheticoligonucleotide
  source 1..19: mol_type = other DNA
taggactccggagtcctaa

SEQ ID NO: 14881 - DNA, 19 bp, synthetic construct
  misc_feature 1..19: note = Description of Artificial Sequence: Syntheticoligonucleotide
  source 1..19: mol_type = other DNA
taggactccggagtcctat

SEQ ID NO: 14882 - DNA, 19 bp, synthetic construct
  misc_feature 1..19: note = Description of Artificial Sequence: Syntheticoligonucleotide
  source 1..19: mol_type = other DNA
taggactccggagtcctac

SEQ ID NO: 14883 - DNA, 19 bp, synthetic construct
  misc_feature 1..19: note = Description of Artificial Sequence: Syntheticoligonucleotide
  source 1..19: mol_type = other DNA
aaggactccggagtcctta

SEQ ID NO: 14884 - DNA, 19 bp, synthetic construct
  misc_feature 1..19: note = Description of Artificial Sequence: Syntheticoligonucleotide
  source 1..19: mol_type = other DNA
aaggactccggagtccttt

SEQ ID NO: 14885 - DNA, 19 bp, synthetic construct
  misc_feature 1..19: note = Description of Artificial Sequence: Syntheticoligonucleotide
  source 1..19: mol_type = other DNA
aaggactccggagtccttc

SEQ ID NO: 14886 - DNA, 19 bp, synthetic construct
  misc_feature 1..19: note = Description of Artificial Sequence: Syntheticoligonucleotide
  source 1..19: mol_type = other DNA
aaggactccggagtccttg

SEQ ID NO: 14887 - DNA, 19 bp, synthetic construct
  misc_feature 1..19: note = Description of Artificial Sequence: Syntheticoligonucleotide
  source 1..19: mol_type = other DNA
gaggactccggagtcctca

SEQ ID NO: 14888 - DNA, 19 bp, synthetic construct
  misc_feature 1..19: note = Description of Artificial Sequence: Syntheticoligonucleotide
  source 1..19: mol_type = other DNA
gaggactccggagtcctct

SEQ ID NO: 14889 - DNA, 19 bp, synthetic construct
  misc_feature 1..19: note = Description of Artificial Sequence: Syntheticoligonucleotide
  source 1..19: mol_type = other DNA
gaggactccggagtcctcc

SEQ ID NO: 14890 - DNA, 19 bp, synthetic construct
  misc_feature 1..19: note = Description of Artificial Sequence: Syntheticoligonucleotide
  source 1..19: mol_type = other DNA
gaggactccggagtcctcg

SEQ ID NO: 14891 - DNA, 19 bp, synthetic construct
  misc_feature 1..19: note = Description of Artificial Sequence: Syntheticoligonucleotide
  source 1..19: mol_type = other DNA
caggactccggagtcctga

SEQ ID NO: 14892 - DNA, 19 bp, synthetic construct
  misc_feature 1..19: note = Description of Artificial Sequence: Syntheticoligonucleotide
  source 1..19: mol_type = other DNA
caggactccggagtcctgt

SEQ ID NO: 14893 - DNA, 19 bp, synthetic construct
  misc_feature 1..19: note = Description of Artificial Sequence: Syntheticoligonucleotide
  source 1..19: mol_type = other DNA
caggactccggagtcctgc

SEQ ID NO: 14894 - DNA, 19 bp, synthetic construct
  misc_feature 1..19: note = Description of Artificial Sequence: Syntheticoligonucleotide
  source 1..19: mol_type = other DNA
caggactccggagtcctgg

SEQ ID NO: 14895 - DNA, 19 bp, synthetic construct
  misc_feature 1..19: note = Description of Artificial Sequence: Syntheticoligonucleotide
  source 1..19: mol_type = other DNA
ttggactccggagtccaaa

SEQ ID NO: 14896 - DNA, 19 bp, synthetic construct
  misc_feature 1..19: note = Description of Artificial Sequence: Syntheticoligonucleotide
  source 1..19: mol_type = other DNA
ttggactccggagtccaat

SEQ ID NO: 14897 - DNA, 19 bp, synthetic construct
  misc_feature 1..19: note = Description of Artificial Sequence: Syntheticoligonucleotide
  source 1..19: mol_type = other DNA
ttggactccggagtccaac

SEQ ID NO: 14898 - DNA, 19 bp, synthetic construct
  misc_feature 1..19: note = Description of Artificial Sequence: Syntheticoligonucleotide
  source 1..19: mol_type = other DNA
ttggactccggagtccaag

SEQ ID NO: 14899 - DNA, 19 bp, synthetic construct
  misc_feature 1..19: note = Description of Artificial Sequence: Syntheticoligonucleotide
  source 1..19: mol_type = other DNA
atggactccggagtccata

SEQ ID NO: 14900 - DNA, 19 bp, synthetic construct
  misc_feature 1..19: note = Description of Artificial Sequence: Syntheticoligonucleotide
  source 1..19: mol_type = other DNA
atggactccggagtccatt

SEQ ID NO: 14901 - DNA, 19 bp, synthetic construct
  misc_feature 1..19: note = Description of Artificial Sequence: Syntheticoligonucleotide
  source 1..19: mol_type = other DNA
atggactccggagtccatc

SEQ ID NO: 14902 - DNA, 19 bp, synthetic construct
  misc_feature 1..19: note = Description of Artificial Sequence: Syntheticoligonucleotide
  source 1..19: mol_type = other DNA
gtggactccggagtccaca

SEQ ID NO: 14903 - DNA, 19 bp, synthetic construct
  misc_feature 1..19: note = Description of Artificial Sequence: Syntheticoligonucleotide
  source 1..19: mol_type = other DNA
gtggactccggagtccact

SEQ ID NO: 14904 - DNA, 19 bp, synthetic construct
  misc_feature 1..19: note = Description of Artificial Sequence: Syntheticoligonucleotide
  source 1..19: mol_type = other DNA
gtggactccggagtccacc

SEQ ID NO: 14905 - DNA, 19 bp, synthetic construct
  misc_feature 1..19: note = Description of Artificial Sequence: Syntheticoligonucleotide
  source 1..19: mol_type = other DNA
gtggactccggagtccacg

SEQ ID NO: 14906 - DNA, 19 bp, synthetic construct
  misc_feature 1..19: note = Description of Artificial Sequence: Syntheticoligonucleotide
  source 1..19: mol_type = other DNA
ctggactccggagtccaga

SEQ ID NO: 14907 - DNA, 19 bp, synthetic construct
  misc_feature 1..19: note = Description of Artificial Sequence: Syntheticoligonucleotide
  source 1..19: mol_type = other DNA
ctggactccggagtccagt

SEQ ID NO: 14908 - DNA, 19 bp, synthetic construct
  misc_feature 1..19: note = Description of Artificial Sequence: Syntheticoligonucleotide
  source 1..19: mol_type = other DNA
ctggactccggagtccagc

SEQ ID NO: 14909 - DNA, 19 bp, synthetic construct
  misc_feature 1..19: note = Description of Artificial Sequence: Syntheticoligonucleotide
  source 1..19: mol_type = other DNA
ctggactccggagtccagg

SEQ ID NO: 14910 - DNA, 19 bp, synthetic construct
  misc_feature 1..19: note = Description of Artificial Sequence: Syntheticoligonucleotide
  source 1..19: mol_type = other DNA
tgggactccggagtcccaa

SEQ ID NO: 14911 - DNA, 19 bp, synthetic construct
  misc_feature 1..19: note = Description of Artificial Sequence: Syntheticoligonucleotide
  source 1..19: mol_type = other DNA
tgggactccggagtcccat

SEQ ID NO: 14912 - DNA, 19 bp, synthetic construct
  misc_feature 1..19: note = Description of Artificial Sequence: Syntheticoligonucleotide
  source 1..19: mol_type = other DNA
tgggactccggagtcccac

SEQ ID NO: 14913 - DNA, 19 bp, synthetic construct
  misc_feature 1..19: note = Description of Artificial Sequence: Syntheticoligonucleotide
  source 1..19: mol_type = other DNA
tgggactccggagtcccag

SEQ ID NO: 14914 - DNA, 19 bp, synthetic construct
  misc_feature 1..19: note = Description of Artificial Sequence: Syntheticoligonucleotide
  source 1..19: mol_type = other DNA
agggactccggagtcccta

SEQ ID NO: 14915 - DNA, 19 bp, synthetic construct
  misc_feature 1..19: note = Description of Artificial Sequence: Syntheticoligonucleotide
  source 1..19: mol_type = other DNA
agggactccggagtccctt

SEQ ID NO: 14916 - DNA, 19 bp, synthetic construct
  misc_feature 1..19: note = Description of Artificial Sequence: Syntheticoligonucleotide
  source 1..19: mol_type = other DNA
agggactccggagtccctc

SEQ ID NO: 14917 - DNA, 19 bp, synthetic construct
  misc_feature 1..19: note = Description of Artificial Sequence: Syntheticoligonucleotide
  source 1..19: mol_type = other DNA
agggactccggagtccctg

SEQ ID NO: 14918 - DNA, 19 bp, synthetic construct
  misc_feature 1..19: note = Description of Artificial Sequence: Syntheticoligonucleotide
  source 1..19: mol_type = other DNA
ggggactccggagtcccca

SEQ ID NO: 14919 - DNA, 19 bp, synthetic construct
  misc_feature 1..19: note = Description of Artificial Sequence: Syntheticoligonucleotide
  source 1..19: mol_type = other DNA
ggggactccggagtcccct

SEQ ID NO: 14920 - DNA, 19 bp, synthetic construct
  misc_feature 1..19: note = Description of Artificial Sequence: Syntheticoligonucleotide
  source 1..19: mol_type = other DNA
ggggactccggagtccccg

SEQ ID NO: 14921 - DNA, 19 bp, synthetic construct
  misc_feature 1..19: note = Description of Artificial Sequence: Syntheticoligonucleotide
  source 1..19: mol_type = other DNA
cgggactccggagtcccga

SEQ ID NO: 14922 - DNA, 19 bp, synthetic construct
  misc_feature 1..19: note = Description of Artificial Sequence: Syntheticoligonucleotide
  source 1..19: mol_type = other DNA
cgggactccggagtcccgt

SEQ ID NO: 14923 - DNA, 19 bp, synthetic construct
  misc_feature 1..19: note = Description of Artificial Sequence: Syntheticoligonucleotide
  source 1..19: mol_type = other DNA
cgggactccggagtcccgc

SEQ ID NO: 14924 - DNA, 19 bp, synthetic construct
  misc_feature 1..19: note = Description of Artificial Sequence: Syntheticoligonucleotide
  source 1..19: mol_type = other DNA
gaagactccggagtcttca

SEQ ID NO: 14925 - DNA, 19 bp, synthetic construct
  misc_feature 1..19: note = Description of Artificial Sequence: Syntheticoligonucleotide
  source 1..19: mol_type = other DNA
gaagactccggagtcttct

SEQ ID NO: 14926 - DNA, 19 bp, synthetic construct
  misc_feature 1..19: note = Description of Artificial Sequence: Syntheticoligonucleotide
  source 1..19: mol_type = other DNA
gaagactccggagtcttcc

SEQ ID NO: 14927 - DNA, 19 bp, synthetic construct
  misc_feature 1..19: note = Description of Artificial Sequence: Syntheticoligonucleotide
  source 1..19: mol_type = other DNA
gaagactccggagtcttcg

SEQ ID NO: 14928 - DNA, 19 bp, synthetic construct
  misc_feature 1..19: note = Description of Artificial Sequence: Syntheticoligonucleotide
  source 1..19: mol_type = other DNA
caagactccggagtcttga

SEQ ID NO: 14929 - DNA, 19 bp, synthetic construct
  misc_feature 1..19: note = Description of Artificial Sequence: Syntheticoligonucleotide
  source 1..19: mol_type = other DNA
caagactccggagtcttgt

SEQ ID NO: 14930 - DNA, 19 bp, synthetic construct
  misc_feature 1..19: note = Description of Artificial Sequence: Syntheticoligonucleotide
  source 1..19: mol_type = other DNA
caagactccggagtcttgc

SEQ ID NO: 14931 - DNA, 19 bp, synthetic construct
  misc_feature 1..19: note = Description of Artificial Sequence: Syntheticoligonucleotide
  source 1..19: mol_type = other DNA
caagactccggagtcttgg

SEQ ID NO: 14932 - DNA, 19 bp, synthetic construct
  misc_feature 1..19: note = Description of Artificial Sequence: Syntheticoligonucleotide
  source 1..19: mol_type = other DNA
tttgactccggagtcaaaa

SEQ ID NO: 14933 - DNA, 19 bp, synthetic construct
  misc_feature 1..19: note = Description of Artificial Sequence: Syntheticoligonucleotide
  source 1..19: mol_type = other DNA
tttgactccggagtcaaat

SEQ ID NO: 14934 - DNA, 19 bp, synthetic construct
  misc_feature 1..19: note = Description of Artificial Sequence: Syntheticoligonucleotide
  source 1..19: mol_type = other DNA
tttgactccggagtcaaac

SEQ ID NO: 14935 - DNA, 19 bp, synthetic construct
  misc_feature 1..19: note = Description of Artificial Sequence: Syntheticoligonucleotide
  source 1..19: mol_type = other DNA
tttgactccggagtcaaag

SEQ ID NO: 14936 - DNA, 19 bp, synthetic construct
  misc_feature 1..19: note = Description of Artificial Sequence: Syntheticoligonucleotide
  source 1..19: mol_type = other DNA
attgactccggagtcaata

SEQ ID NO: 14937 - DNA, 19 bp, synthetic construct
  misc_feature 1..19: note = Description of Artificial Sequence: Syntheticoligonucleotide
  source 1..19: mol_type = other DNA
attgactccggagtcaatc

SEQ ID NO: 14938 - DNA, 19 bp, synthetic construct
  misc_feature 1..19: note = Description of Artificial Sequence: Syntheticoligonucleotide
  source 1..19: mol_type = other DNA
attgactccggagtcaatg

SEQ ID NO: 14939 - DNA, 19 bp, synthetic construct
  misc_feature 1..19: note = Description of Artificial Sequence: Syntheticoligonucleotide
  source 1..19: mol_type = other DNA
gttgactccggagtcaaca

SEQ ID NO: 14940 - DNA, 19 bp, synthetic construct
  misc_feature 1..19: note = Description of Artificial Sequence: Syntheticoligonucleotide
  source 1..19: mol_type = other DNA
gttgactccggagtcaact

SEQ ID NO: 14941 - DNA, 19 bp, synthetic construct
  misc_feature 1..19: note = Description of Artificial Sequence: Syntheticoligonucleotide
  source 1..19: mol_type = other DNA
gttgactccggagtcaacc

SEQ ID NO: 14942 - DNA, 19 bp, synthetic construct
  misc_feature 1..19: note = Description of Artificial Sequence: Syntheticoligonucleotide
  source 1..19: mol_type = other DNA
gttgactccggagtcaacg

SEQ ID NO: 14943 - DNA, 19 bp, synthetic construct
  misc_feature 1..19: note = Description of Artificial Sequence: Syntheticoligonucleotide
  source 1..19: mol_type = other DNA
cttgactccggagtcaaga

SEQ ID NO: 14944 - DNA, 19 bp, synthetic construct
  misc_feature 1..19: note = Description of Artificial Sequence: Syntheticoligonucleotide
  source 1..19: mol_type = other DNA
cttgactccggagtcaagt

SEQ ID NO: 14945 - DNA, 19 bp, synthetic construct
  misc_feature 1..19: note = Description of Artificial Sequence: Syntheticoligonucleotide
  source 1..19: mol_type = other DNA
cttgactccggagtcaagc

SEQ ID NO: 14946 - DNA, 19 bp, synthetic construct
  misc_feature 1..19: note = Description of Artificial Sequence: Syntheticoligonucleotide
  source 1..19: mol_type = other DNA
cttgactccggagtcaagg

SEQ ID NO: 14947 - DNA, 19 bp, synthetic construct
  misc_feature 1..19: note = Description of Artificial Sequence: Syntheticoligonucleotide
  source 1..19: mol_type = other DNA
aatgactccggagtcatta

SEQ ID NO: 14948 - DNA, 19 bp, synthetic construct
  misc_feature 1..19: note = Description of Artificial Sequence: Syntheticoligonucleotide
  source 1..19: mol_type = other DNA
aatgactccggagtcattt

SEQ ID NO: 14949 - DNA, 19 bp, synthetic construct
  misc_feature 1..19: note = Description of Artificial Sequence: Syntheticoligonucleotide
  source 1..19: mol_type = other DNA
aatgactccggagtcattc

SEQ ID NO: 14950 - DNA, 19 bp, synthetic construct
  misc_feature 1..19: note = Description of Artificial Sequence: Syntheticoligonucleotide
  source 1..19: mol_type = other DNA
aatgactccggagtcattg

SEQ ID NO: 14951 - DNA, 19 bp, synthetic construct
  misc_feature 1..19: note = Description of Artificial Sequence: Syntheticoligonucleotide
  source 1..19: mol_type = other DNA
gatgactccggagtcatca

SEQ ID NO: 14952 - DNA, 19 bp, synthetic construct
  misc_feature 1..19: note = Description of Artificial Sequence: Syntheticoligonucleotide
  source 1..19: mol_type = other DNA
gatgactccggagtcatct

SEQ ID NO: 14953 - DNA, 19 bp, synthetic construct
  misc_feature 1..19: note = Description of Artificial Sequence: Syntheticoligonucleotide
  source 1..19: mol_type = other DNA
gatgactccggagtcatcc

SEQ ID NO: 14954 - DNA, 19 bp, synthetic construct
  misc_feature 1..19: note = Description of Artificial Sequence: Syntheticoligonucleotide
  source 1..19: mol_type = other DNA
gatgactccggagtcatcg

SEQ ID NO: 14955 - DNA, 19 bp, synthetic construct
  misc_feature 1..19: note = Description of Artificial Sequence: Syntheticoligonucleotide
  source 1..19: mol_type = other DNA
catgactccggagtcatga

SEQ ID NO: 14956 - DNA, 19 bp, synthetic construct
  misc_feature 1..19: note = Description of Artificial Sequence: Syntheticoligonucleotide
  source 1..19: mol_type = other DNA
catgactccggagtcatgt

SEQ ID NO: 14957 - DNA, 19 bp, synthetic construct
  misc_feature 1..19: note = Description of Artificial Sequence: Syntheticoligonucleotide
  source 1..19: mol_type = other DNA
catgactccggagtcatgc

SEQ ID NO: 14958 - DNA, 19 bp, synthetic construct
  misc_feature 1..19: note = Description of Artificial Sequence: Syntheticoligonucleotide
  source 1..19: mol_type = other DNA
catgactccggagtcatgg

SEQ ID NO: 14959 - DNA, 19 bp, synthetic construct
  misc_feature 1..19: note = Description of Artificial Sequence: Syntheticoligonucleotide
  source 1..19: mol_type = other DNA
gtagactccggagtctaca

SEQ ID NO: 14960 - DNA, 19 bp, synthetic construct
  misc_feature 1..19: note = Description of Artificial Sequence: Syntheticoligonucleotide
  source 1..19: mol_type = other DNA
gtagactccggagtctact

SEQ ID NO: 14961 - DNA, 19 bp, synthetic construct
  misc_feature 1..19: note = Description of Artificial Sequence: Syntheticoligonucleotide
  source 1..19: mol_type = other DNA
gtagactccggagtctacc

SEQ ID NO: 14962 - DNA, 19 bp, synthetic construct
  misc_feature 1..19: note = Description of Artificial Sequence: Syntheticoligonucleotide
  source 1..19: mol_type = other DNA
gtagactccggagtctacg

SEQ ID NO: 14963 - DNA, 19 bp, synthetic construct
  misc_feature 1..19: note = Description of Artificial Sequence: Syntheticoligonucleotide
  source 1..19: mol_type = other DNA
ctagactccggagtctaga

SEQ ID NO: 14964 - DNA, 19 bp, synthetic construct
  misc_feature 1..19: note = Description of Artificial Sequence: Syntheticoligonucleotide
  source 1..19: mol_type = other DNA
ctagactccggagtctagt

SEQ ID NO: 14965 - DNA, 19 bp, synthetic construct
  misc_feature 1..19: note = Description of Artificial Sequence: Syntheticoligonucleotide
  source 1..19: mol_type = other DNA
ctagactccggagtctagc

SEQ ID NO: 14966 - DNA, 19 bp, synthetic construct
  misc_feature 1..19: note = Description of Artificial Sequence: Syntheticoligonucleotide
  source 1..19: mol_type = other DNA
ctagactccggagtctagg

SEQ ID NO: 14967 - DNA, 19 bp, synthetic construct
  misc_feature 1..19: note = Description of Artificial Sequence: Syntheticoligonucleotide
  source 1..19: mol_type = other DNA
gcagactcatgagtctgct

SEQ ID NO: 14968 - DNA, 19 bp, synthetic construct
  misc_feature 1..19: note = Description of Artificial Sequence: Syntheticoligonucleotide
  source 1..19: mol_type = other DNA
gcagactcatgagtctgcc

SEQ ID NO: 14969 - DNA, 19 bp, synthetic construct
  misc_feature 1..19: note = Description of Artificial Sequence: Syntheticoligonucleotide
  source 1..19: mol_type = other DNA
gcagactcatgagtctgcg

SEQ ID NO: 14970 - DNA, 19 bp, synthetic construct
  misc_feature 1..19: note = Description of Artificial Sequence: Syntheticoligonucleotide
  source 1..19: mol_type = other DNA
ccagactcatgagtctgga

SEQ ID NO: 14971 - DNA, 19 bp, synthetic construct
  misc_feature 1..19: note = Description of Artificial Sequence: Syntheticoligonucleotide
  source 1..19: mol_type = other DNA
ccagactcatgagtctggt

SEQ ID NO: 14972 - DNA, 19 bp, synthetic construct
  misc_feature 1..19: note = Description of Artificial Sequence: Syntheticoligonucleotide
  source 1..19: mol_type = other DNA
ccagactcatgagtctggc

SEQ ID NO: 14973 - DNA, 19 bp, synthetic construct
  misc_feature 1..19: note = Description of Artificial Sequence: Syntheticoligonucleotide
  source 1..19: mol_type = other DNA
ccagactcatgagtctggg

SEQ ID NO: 14974 - DNA, 19 bp, synthetic construct
  misc_feature 1..19: note = Description of Artificial Sequence: Syntheticoligonucleotide
  source 1..19: mol_type = other DNA
gctgactcatgagtcagca

SEQ ID NO: 14975 - DNA, 19 bp, synthetic construct
  misc_feature 1..19: note = Description of Artificial Sequence: Syntheticoligonucleotide
  source 1..19: mol_type = other DNA
gctgactcatgagtcagcc

SEQ ID NO: 14976 - DNA, 19 bp, synthetic construct
  misc_feature 1..19: note = Description of Artificial Sequence: Syntheticoligonucleotide
  source 1..19: mol_type = other DNA
gctgactcatgagtcagcg

SEQ ID NO: 14977 - DNA, 19 bp, synthetic construct
  misc_feature 1..19: note = Description of Artificial Sequence: Syntheticoligonucleotide
  source 1..19: mol_type = other DNA
cctgactcatgagtcagga

SEQ ID NO: 14978 - DNA, 19 bp, synthetic construct
  misc_feature 1..19: note = Description of Artificial Sequence: Syntheticoligonucleotide
  source 1..19: mol_type = other DNA
cctgactcatgagtcaggt

SEQ ID NO: 14979 - DNA, 19 bp, synthetic construct
  misc_feature 1..19: note = Description of Artificial Sequence: Syntheticoligonucleotide
  source 1..19: mol_type = other DNA
cctgactcatgagtcaggc

SEQ ID NO: 14980 - DNA, 19 bp, synthetic construct
  misc_feature 1..19: note = Description of Artificial Sequence: Syntheticoligonucleotide
  source 1..19: mol_type = other DNA
cctgactcatgagtcaggg

SEQ ID NO: 14981 - DNA, 19 bp, synthetic construct
  misc_feature 1..19: note = Description of Artificial Sequence: Syntheticoligonucleotide
  source 1..19: mol_type = other DNA
aacgactcatgagtcgtta

SEQ ID NO: 14982 - DNA, 19 bp, synthetic construct
  misc_feature 1..19: note = Description of Artificial Sequence: Syntheticoligonucleotide
  source 1..19: mol_type = other DNA
aacgactcatgagtcgttt

SEQ ID NO: 14983 - DNA, 19 bp, synthetic construct
  misc_feature 1..19: note = Description of Artificial Sequence: Syntheticoligonucleotide
  source 1..19: mol_type = other DNA
aacgactcatgagtcgttc

SEQ ID NO: 14984 - DNA, 19 bp, synthetic construct
  misc_feature 1..19: note = Description of Artificial Sequence: Syntheticoligonucleotide
  source 1..19: mol_type = other DNA
aacgactcatgagtcgttg

SEQ ID NO: 14985 - DNA, 19 bp, synthetic construct
  misc_feature 1..19: note = Description of Artificial Sequence: Syntheticoligonucleotide
  source 1..19: mol_type = other DNA
gacgactcatgagtcgtca

SEQ ID NO: 14986 - DNA, 19 bp, synthetic construct
  misc_feature 1..19: note = Description of Artificial Sequence: Syntheticoligonucleotide
  source 1..19: mol_type = other DNA
gacgactcatgagtcgtct

SEQ ID NO: 14987 - DNA, 19 bp, synthetic construct
  misc_feature 1..19: note = Description of Artificial Sequence: Syntheticoligonucleotide
  source 1..19: mol_type = other DNA
gacgactcatgagtcgtcc

SEQ ID NO: 14988 - DNA, 19 bp, synthetic construct
  misc_feature 1..19: note = Description of Artificial Sequence: Syntheticoligonucleotide
  source 1..19: mol_type = other DNA
gacgactcatgagtcgtcg

SEQ ID NO: 14989 - DNA, 19 bp, synthetic construct
  misc_feature 1..19: note = Description of Artificial Sequence: Syntheticoligonucleotide
  source 1..19: mol_type = other DNA
cacgactcatgagtcgtga

SEQ ID NO: 14990 - DNA, 19 bp, synthetic construct
  misc_feature 1..19: note = Description of Artificial Sequence: Syntheticoligonucleotide
  source 1..19: mol_type = other DNA
cacgactcatgagtcgtgt

SEQ ID NO: 14991 - DNA, 19 bp, synthetic construct
  misc_feature 1..19: note = Description of Artificial Sequence: Syntheticoligonucleotide
  source 1..19: mol_type = other DNA
cacgactcatgagtcgtgc

SEQ ID NO: 14992 - DNA, 19 bp, synthetic construct
  misc_feature 1..19: note = Description of Artificial Sequence: Syntheticoligonucleotide
  source 1..19: mol_type = other DNA
cacgactcatgagtcgtgg

SEQ ID NO: 14993 - DNA, 19 bp, synthetic construct
  misc_feature 1..19: note = Description of Artificial Sequence: Syntheticoligonucleotide
  source 1..19: mol_type = other DNA
tccgactcatgagtcggaa

SEQ ID NO: 14994 - DNA, 19 bp, synthetic construct
  misc_feature 1..19: note = Description of Artificial Sequence: Syntheticoligonucleotide
  source 1..19: mol_type = other DNA
tccgactcatgagtcggat

SEQ ID NO: 14995 - DNA, 19 bp, synthetic construct
  misc_feature 1..19: note = Description of Artificial Sequence: Syntheticoligonucleotide
  source 1..19: mol_type = other DNA
tccgactcatgagtcggac

SEQ ID NO: 14996 - DNA, 19 bp, synthetic construct
  misc_feature 1..19: note = Description of Artificial Sequence: Syntheticoligonucleotide
  source 1..19: mol_type = other DNA
tccgactcatgagtcggag

SEQ ID NO: 14997 - DNA, 19 bp, synthetic construct
  misc_feature 1..19: note = Description of Artificial Sequence: Syntheticoligonucleotide
  source 1..19: mol_type = other DNA
accgactcatgagtcggta

SEQ ID NO: 14998 - DNA, 19 bp, synthetic construct
  misc_feature 1..19: note = Description of Artificial Sequence: Syntheticoligonucleotide
  source 1..19: mol_type = other DNA
accgactcatgagtcggtt

SEQ ID NO: 14999 - DNA, 19 bp, synthetic construct
  misc_feature 1..19: note = Description of Artificial Sequence: Syntheticoligonucleotide
  source 1..19: mol_type = other DNA
accgactcatgagtcggtc

SEQ ID NO: 15000 - DNA, 19 bp, synthetic construct
  misc_feature 1..19: note = Description of Artificial Sequence: Syntheticoligonucleotide
  source 1..19: mol_type = other DNA
accgactcatgagtcggtg

SEQ ID NO: 15001 - DNA, 19 bp, synthetic construct
  misc_feature 1..19: note = Description of Artificial Sequence: Syntheticoligonucleotide
  source 1..19: mol_type = other DNA
gccgactcatgagtcggca

SEQ ID NO: 15002 - DNA, 19 bp, synthetic construct
  misc_feature 1..19: note = Description of Artificial Sequence: Syntheticoligonucleotide
  source 1..19: mol_type = other DNA
gccgactcatgagtcggct

SEQ ID NO: 15003 - DNA, 19 bp, synthetic construct
  misc_feature 1..19: note = Description of Artificial Sequence: Syntheticoligonucleotide
  source 1..19: mol_type = other DNA
gccgactcatgagtcggcg

SEQ ID NO: 15004 - DNA, 19 bp, synthetic construct
  misc_feature 1..19: note = Description of Artificial Sequence: Syntheticoligonucleotide
  source 1..19: mol_type = other DNA
cccgactcatgagtcggga

SEQ ID NO: 15005 - DNA, 19 bp, synthetic construct
  misc_feature 1..19: note = Description of Artificial Sequence: Syntheticoligonucleotide
  source 1..19: mol_type = other DNA
cccgactcatgagtcgggt

SEQ ID NO: 15006 - DNA, 19 bp, synthetic construct
  misc_feature 1..19: note = Description of Artificial Sequence: Syntheticoligonucleotide
  source 1..19: mol_type = other DNA
cccgactcatgagtcgggc

SEQ ID NO: 15007 - DNA, 19 bp, synthetic construct
  misc_feature 1..19: note = Description of Artificial Sequence: Syntheticoligonucleotide
  source 1..19: mol_type = other DNA
ggagactcatgagtctcca

SEQ ID NO: 15008 - DNA, 19 bp, synthetic construct
  misc_feature 1..19: note = Description of Artificial Sequence: Syntheticoligonucleotide
  source 1..19: mol_type = other DNA
ggagactcatgagtctcct

SEQ ID NO: 15009 - DNA, 19 bp, synthetic construct
  misc_feature 1..19: note = Description of Artificial Sequence: Syntheticoligonucleotide
  source 1..19: mol_type = other DNA
ggagactcatgagtctccc

SEQ ID NO: 15010 - DNA, 19 bp, synthetic construct
  misc_feature 1..19: note = Description of Artificial Sequence: Syntheticoligonucleotide
  source 1..19: mol_type = other DNA
ggagactcatgagtctccg

SEQ ID NO: 15011 - DNA, 19 bp, synthetic construct
  misc_feature 1..19: note = Description of Artificial Sequence: Syntheticoligonucleotide
  source 1..19: mol_type = other DNA
cgagactcatgagtctcgt

SEQ ID NO: 15012 - DNA, 19 bp, synthetic construct
  misc_feature 1..19: note = Description of Artificial Sequence: Syntheticoligonucleotide
  source 1..19: mol_type = other DNA
cgagactcatgagtctcgc

SEQ ID NO: 15013 - DNA, 19 bp, synthetic construct
  misc_feature 1..19: note = Description of Artificial Sequence: Syntheticoligonucleotide
  source 1..19: mol_type = other DNA
cgagactcatgagtctcgg

SEQ ID NO: 15014 - DNA, 19 bp, synthetic construct
  misc_feature 1..19: note = Description of Artificial Sequence: Syntheticoligonucleotide
  source 1..19: mol_type = other DNA
ggtgactcatgagtcacca

SEQ ID NO: 15015 - DNA, 19 bp, synthetic construct
  misc_feature 1..19: note = Description of Artificial Sequence: Syntheticoligonucleotide
  source 1..19: mol_type = other DNA
ggtgactcatgagtcacct

SEQ ID NO: 15016 - DNA, 19 bp, synthetic construct
  misc_feature 1..19: note = Description of Artificial Sequence: Syntheticoligonucleotide
  source 1..19: mol_type = other DNA
ggtgactcatgagtcaccc

SEQ ID NO: 15017 - DNA, 19 bp, synthetic construct
  misc_feature 1..19: note = Description of Artificial Sequence: Syntheticoligonucleotide
  source 1..19: mol_type = other DNA
ggtgactcatgagtcaccg

SEQ ID NO: 15018 - DNA, 19 bp, synthetic construct
  misc_feature 1..19: note = Description of Artificial Sequence: Syntheticoligonucleotide
  source 1..19: mol_type = other DNA
cgtgactcatgagtcacga

SEQ ID NO: 15019 - DNA, 19 bp, synthetic construct
  misc_feature 1..19: note = Description of Artificial Sequence: Syntheticoligonucleotide
  source 1..19: mol_type = other DNA
cgtgactcatgagtcacgc

SEQ ID NO: 15020 - DNA, 19 bp, synthetic construct
  misc_feature 1..19: note = Description of Artificial Sequence: Syntheticoligonucleotide
  source 1..19: mol_type = other DNA
cgtgactcatgagtcacgg

SEQ ID NO: 15021 - DNA, 19 bp, synthetic construct
  misc_feature 1..19: note = Description of Artificial Sequence: Syntheticoligonucleotide
  source 1..19: mol_type = other DNA
gaggactcatgagtcctca

SEQ ID NO: 15022 - DNA, 19 bp, synthetic construct
  misc_feature 1..19: note = Description of Artificial Sequence: Syntheticoligonucleotide
  source 1..19: mol_type = other DNA
gaggactcatgagtcctct

SEQ ID NO: 15023 - DNA, 19 bp, synthetic construct
  misc_feature 1..19: note = Description of Artificial Sequence: Syntheticoligonucleotide
  source 1..19: mol_type = other DNA
gaggactcatgagtcctcc

SEQ ID NO: 15024 - DNA, 19 bp, synthetic construct
  misc_feature 1..19: note = Description of Artificial Sequence: Syntheticoligonucleotide
  source 1..19: mol_type = other DNA
gaggactcatgagtcctcg

SEQ ID NO: 15025 - DNA, 19 bp, synthetic construct
  misc_feature 1..19: note = Description of Artificial Sequence: Syntheticoligonucleotide
  source 1..19: mol_type = other DNA
caggactcatgagtcctga

SEQ ID NO: 15026 - DNA, 19 bp, synthetic construct
  misc_feature 1..19: note = Description of Artificial Sequence: Syntheticoligonucleotide
  source 1..19: mol_type = other DNA
caggactcatgagtcctgt

SEQ ID NO: 15027 - DNA, 19 bp, synthetic construct
  misc_feature 1..19: note = Description of Artificial Sequence: Syntheticoligonucleotide
  source 1..19: mol_type = other DNA
caggactcatgagtcctgc

SEQ ID NO: 15028 - DNA, 19 bp, synthetic construct
  misc_feature 1..19: note = Description of Artificial Sequence: Syntheticoligonucleotide
  source 1..19: mol_type = other DNA
caggactcatgagtcctgg

SEQ ID NO: 15029 - DNA, 19 bp, synthetic construct
  misc_feature 1..19: note = Description of Artificial Sequence: Syntheticoligonucleotide
  source 1..19: mol_type = other DNA
gtggactcatgagtccaca

SEQ ID NO: 15030 - DNA, 19 bp, synthetic construct
  misc_feature 1..19: note = Description of Artificial Sequence: Syntheticoligonucleotide
  source 1..19: mol_type = other DNA
gtggactcatgagtccact

SEQ ID NO: 15031 - DNA, 19 bp, synthetic construct
  misc_feature 1..19: note = Description of Artificial Sequence: Syntheticoligonucleotide
  source 1..19: mol_type = other DNA
gtggactcatgagtccacc

SEQ ID NO: 15032 - DNA, 19 bp, synthetic construct
  misc_feature 1..19: note = Description of Artificial Sequence: Syntheticoligonucleotide
  source 1..19: mol_type = other DNA
gtggactcatgagtccacg

SEQ ID NO: 15033 - DNA, 19 bp, synthetic construct
  misc_feature 1..19: note = Description of Artificial Sequence: Syntheticoligonucleotide
  source 1..19: mol_type = other DNA
ctggactcatgagtccaga

SEQ ID NO: 15034 - DNA, 19 bp, synthetic construct
  misc_feature 1..19: note = Description of Artificial Sequence: Syntheticoligonucleotide
  source 1..19: mol_type = other DNA
ctggactcatgagtccagt

SEQ ID NO: 15035 - DNA, 19 bp, synthetic construct
  misc_feature 1..19: note = Description of Artificial Sequence: Syntheticoligonucleotide
  source 1..19: mol_type = other DNA
ctggactcatgagtccagc

SEQ ID NO: 15036 - DNA, 19 bp, synthetic construct
  misc_feature 1..19: note = Description of Artificial Sequence: Syntheticoligonucleotide
  source 1..19: mol_type = other DNA
ctggactcatgagtccagg

SEQ ID NO: 15037 - DNA, 19 bp, synthetic construct
  misc_feature 1..19: note = Description of Artificial Sequence: Syntheticoligonucleotide
  source 1..19: mol_type = other DNA
tgggactcatgagtcccaa

SEQ ID NO: 15038 - DNA, 19 bp, synthetic construct
  misc_feature 1..19: note = Description of Artificial Sequence: Syntheticoligonucleotide
  source 1..19: mol_type = other DNA
tgggactcatgagtcccat

SEQ ID NO: 15039 - DNA, 19 bp, synthetic construct
  misc_feature 1..19: note = Description of Artificial Sequence: Syntheticoligonucleotide
  source 1..19: mol_type = other DNA
tgggactcatgagtcccac

SEQ ID NO: 15040 - DNA, 19 bp, synthetic construct
  misc_feature 1..19: note = Description of Artificial Sequence: Syntheticoligonucleotide
  source 1..19: mol_type = other DNA
tgggactcatgagtcccag

SEQ ID NO: 15041 - DNA, 19 bp, synthetic construct
  misc_feature 1..19: note = Description of Artificial Sequence: Syntheticoligonucleotide
  source 1..19: mol_type = other DNA
agggactcatgagtcccta

SEQ ID NO: 15042 - DNA, 19 bp, synthetic construct
  misc_feature 1..19: note = Description of Artificial Sequence: Syntheticoligonucleotide
  source 1..19: mol_type = other DNA
agggactcatgagtccctt

SEQ ID NO: 15043 - DNA, 19 bp, synthetic construct
  misc_feature 1..19: note = Description of Artificial Sequence: Syntheticoligonucleotide
  source 1..19: mol_type = other DNA
agggactccggagtccctc

SEQ ID NO: 15044 - DNA, 19 bp, synthetic construct
  misc_feature 1..19: note = Description of Artificial Sequence: Syntheticoligonucleotide
  source 1..19: mol_type = other DNA
agggactcatgagtccctg

SEQ ID NO: 15045 - DNA, 19 bp, synthetic construct
  misc_feature 1..19: note = Description of Artificial Sequence: Syntheticoligonucleotide
  source 1..19: mol_type = other DNA
ggggactcatgagtcccca

SEQ ID NO: 15046 - DNA, 19 bp, synthetic construct
  misc_feature 1..19: note = Description of Artificial Sequence: Syntheticoligonucleotide
  source 1..19: mol_type = other DNA
ggggactcatgagtcccct

SEQ ID NO: 15047 - DNA, 19 bp, synthetic construct
  misc_feature 1..19: note = Description of Artificial Sequence: Syntheticoligonucleotide
  source 1..19: mol_type = other DNA
ggggactcatgagtccccg

SEQ ID NO: 15048 - DNA, 19 bp, synthetic construct
  misc_feature 1..19: note = Description of Artificial Sequence: Syntheticoligonucleotide
  source 1..19: mol_type = other DNA
cgggactcatgagtcccga

SEQ ID NO: 15049 - DNA, 19 bp, synthetic construct
  misc_feature 1..19: note = Description of Artificial Sequence: Syntheticoligonucleotide
  source 1..19: mol_type = other DNA
cgggactcatgagtcccgt

SEQ ID NO: 15050 - DNA, 19 bp, synthetic construct
  misc_feature 1..19: note = Description of Artificial Sequence: Syntheticoligonucleotide
  source 1..19: mol_type = other DNA
cgggactcatgagtcccgc

SEQ ID NO: 15051 - DNA, 19 bp, synthetic construct
  misc_feature 1..19: note = Description of Artificial Sequence: Syntheticoligonucleotide
  source 1..19: mol_type = other DNA
gcagactctagagtctgct

SEQ ID NO: 15052 - DNA, 19 bp, synthetic construct
  misc_feature 1..19: note = Description of Artificial Sequence: Syntheticoligonucleotide
  source 1..19: mol_type = other DNA
gcagactctagagtctgcc

SEQ ID NO: 15053 - DNA, 19 bp, synthetic construct
  misc_feature 1..19: note = Description of Artificial Sequence: Syntheticoligonucleotide
  source 1..19: mol_type = other DNA
gcagactctagagtctgcg

SEQ ID NO: 15054 - DNA, 19 bp, synthetic construct
  misc_feature 1..19: note = Description of Artificial Sequence: Syntheticoligonucleotide
  source 1..19: mol_type = other DNA
ccagactctagagtctgga

SEQ ID NO: 15055 - DNA, 19 bp, synthetic construct
  misc_feature 1..19: note = Description of Artificial Sequence: Syntheticoligonucleotide
  source 1..19: mol_type = other DNA
ccagactctagagtctggt

SEQ ID NO: 15056 - DNA, 19 bp, synthetic construct
  misc_feature 1..19: note = Description of Artificial Sequence: Syntheticoligonucleotide
  source 1..19: mol_type = other DNA
ccagactctagagtctggc

SEQ ID NO: 15057 - DNA, 19 bp, synthetic construct
  misc_feature 1..19: note = Description of Artificial Sequence: Syntheticoligonucleotide
  source 1..19: mol_type = other DNA
ccagactctagagtctggg

SEQ ID NO: 15058 - DNA, 19 bp, synthetic construct
  misc_feature 1..19: note = Description of Artificial Sequence: Syntheticoligonucleotide
  source 1..19: mol_type = other DNA
gctgactctagagtcagca

SEQ ID NO: 15059 - DNA, 19 bp, synthetic construct
  misc_feature 1..19: note = Description of Artificial Sequence: Syntheticoligonucleotide
  source 1..19: mol_type = other DNA
gctgactctagagtcagcc

SEQ ID NO: 15060 - DNA, 19 bp, synthetic construct
  misc_feature 1..19: note = Description of Artificial Sequence: Syntheticoligonucleotide
  source 1..19: mol_type = other DNA
gctgactctagagtcagcg

SEQ ID NO: 15061 - DNA, 19 bp, synthetic construct
  misc_feature 1..19: note = Description of Artificial Sequence: Syntheticoligonucleotide
  source 1..19: mol_type = other DNA
cctgactctagagtcagga

SEQ ID NO: 15062 - DNA, 19 bp, synthetic construct
  misc_feature 1..19: note = Description of Artificial Sequence: Syntheticoligonucleotide
  source 1..19: mol_type = other DNA
cctgactctagagtcaggt

SEQ ID NO: 15063 - DNA, 19 bp, synthetic construct
  misc_feature 1..19: note = Description of Artificial Sequence: Syntheticoligonucleotide
  source 1..19: mol_type = other DNA
cctgactctagagtcaggc

SEQ ID NO: 15064 - DNA, 19 bp, synthetic construct
  misc_feature 1..19: note = Description of Artificial Sequence: Syntheticoligonucleotide
  source 1..19: mol_type = other DNA
cctgactctagagtcaggg

SEQ ID NO: 15065 - DNA, 19 bp, synthetic construct
  misc_feature 1..19: note = Description of Artificial Sequence: Syntheticoligonucleotide
  source 1..19: mol_type = other DNA
gacgactctagagtcgtca

SEQ ID NO: 15066 - DNA, 19 bp, synthetic construct
  misc_feature 1..19: note = Description of Artificial Sequence: Syntheticoligonucleotide
  source 1..19: mol_type = other DNA
gacgactctagagtcgtct

SEQ ID NO: 15067 - DNA, 19 bp, synthetic construct
  misc_feature 1..19: note = Description of Artificial Sequence: Syntheticoligonucleotide
  source 1..19: mol_type = other DNA
gacgactctagagtcgtcc

SEQ ID NO: 15068 - DNA, 19 bp, synthetic construct
  misc_feature 1..19: note = Description of Artificial Sequence: Syntheticoligonucleotide
  source 1..19: mol_type = other DNA
gacgactctagagtcgtcg

SEQ ID NO: 15069 - DNA, 19 bp, synthetic construct
  misc_feature 1..19: note = Description of Artificial Sequence: Syntheticoligonucleotide
  source 1..19: mol_type = other DNA
cacgactctagagtcgtga

SEQ ID NO: 15070 - DNA, 19 bp, synthetic construct
  misc_feature 1..19: note = Description of Artificial Sequence: Syntheticoligonucleotide
  source 1..19: mol_type = other DNA
cacgactctagagtcgtgt

SEQ ID NO: 15071 - DNA, 19 bp, synthetic construct
  misc_feature 1..19: note = Description of Artificial Sequence: Syntheticoligonucleotide
  source 1..19: mol_type = other DNA
cacgactctagagtcgtgc

SEQ ID NO: 15072 - DNA, 19 bp, synthetic construct
  misc_feature 1..19: note = Description of Artificial Sequence: Syntheticoligonucleotide
  source 1..19: mol_type = other DNA
cacgactctagagtcgtgg

SEQ ID NO: 15073 - DNA, 19 bp, synthetic construct
  misc_feature 1..19: note = Description of Artificial Sequence: Syntheticoligonucleotide
  source 1..19: mol_type = other DNA
tccgactctagagtcggaa

SEQ ID NO: 15074 - DNA, 19 bp, synthetic construct
  misc_feature 1..19: note = Description of Artificial Sequence: Syntheticoligonucleotide
  source 1..19: mol_type = other DNA
tccgactctagagtcggat

SEQ ID NO: 15075 - DNA, 19 bp, synthetic construct
  misc_feature 1..19: note = Description of Artificial Sequence: Syntheticoligonucleotide
  source 1..19: mol_type = other DNA
tccgactctagagtcggac

SEQ ID NO: 15076 - DNA, 19 bp, synthetic construct
  misc_feature 1..19: note = Description of Artificial Sequence: Syntheticoligonucleotide
  source 1..19: mol_type = other DNA
tccgactctagagtcggag

SEQ ID NO: 15077 - DNA, 19 bp, synthetic construct
  misc_feature 1..19: note = Description of Artificial Sequence: Syntheticoligonucleotide
  source 1..19: mol_type = other DNA
accgactctagagtcggta

SEQ ID NO: 15078 - DNA, 19 bp, synthetic construct
  misc_feature 1..19: note = Description of Artificial Sequence: Syntheticoligonucleotide
  source 1..19: mol_type = other DNA
accgactctagagtcggtt

SEQ ID NO: 15079 - DNA, 19 bp, synthetic construct
  misc_feature 1..19: note = Description of Artificial Sequence: Syntheticoligonucleotide
  source 1..19: mol_type = other DNA
accgactctagagtcggtc

SEQ ID NO: 15080 - DNA, 19 bp, synthetic construct
  misc_feature 1..19: note = Description of Artificial Sequence: Syntheticoligonucleotide
  source 1..19: mol_type = other DNA
accgactctagagtcggtg

SEQ ID NO: 15081 - DNA, 19 bp, synthetic construct
  misc_feature 1..19: note = Description of Artificial Sequence: Syntheticoligonucleotide
  source 1..19: mol_type = other DNA
gccgactctagagtcggca

SEQ ID NO: 15082 - DNA, 19 bp, synthetic construct
  misc_feature 1..19: note = Description of Artificial Sequence: Syntheticoligonucleotide
  source 1..19: mol_type = other DNA
gccgactctagagtcggct

SEQ ID NO: 15083 - DNA, 19 bp, synthetic construct
  misc_feature 1..19: note = Description of Artificial Sequence: Syntheticoligonucleotide
  source 1..19: mol_type = other DNA
gccgactctagagtcggcg

SEQ ID NO: 15084 - DNA, 19 bp, synthetic construct
  misc_feature 1..19: note = Description of Artificial Sequence: Syntheticoligonucleotide
  source 1..19: mol_type = other DNA
cccgactctagagtcggga

SEQ ID NO: 15085 - DNA, 19 bp, synthetic construct
  misc_feature 1..19: note = Description of Artificial Sequence: Syntheticoligonucleotide
  source 1..19: mol_type = other DNA
cccgactctagagtcgggt

SEQ ID NO: 15086 - DNA, 19 bp, synthetic construct
  misc_feature 1..19: note = Description of Artificial Sequence: Syntheticoligonucleotide
  source 1..19: mol_type = other DNA
cccgactctagagtcgggc

SEQ ID NO: 15087 - DNA, 19 bp, synthetic construct
  misc_feature 1..19: note = Description of Artificial Sequence: Syntheticoligonucleotide
  source 1..19: mol_type = other DNA
ggagactctagagtctcca

SEQ ID NO: 15088 - DNA, 19 bp, synthetic construct
  misc_feature 1..19: note = Description of Artificial Sequence: Syntheticoligonucleotide
  source 1..19: mol_type = other DNA
ggagactctagagtctcct

SEQ ID NO: 15089 - DNA, 19 bp, synthetic construct
  misc_feature 1..19: note = Description of Artificial Sequence: Syntheticoligonucleotide
  source 1..19: mol_type = other DNA
ggagactctagagtctccc

SEQ ID NO: 15090 - DNA, 19 bp, synthetic construct
  misc_feature 1..19: note = Description of Artificial Sequence: Syntheticoligonucleotide
  source 1..19: mol_type = other DNA
ggagactctagagtctccg

SEQ ID NO: 15091 - DNA, 19 bp, synthetic construct
  misc_feature 1..19: note = Description of Artificial Sequence: Syntheticoligonucleotide
  source 1..19: mol_type = other DNA
cgagactctagagtctcgt

SEQ ID NO: 15092 - DNA, 19 bp, synthetic construct
  misc_feature 1..19: note = Description of Artificial Sequence: Syntheticoligonucleotide
  source 1..19: mol_type = other DNA
cgagactctagagtctcgc

SEQ ID NO: 15093 - DNA, 19 bp, synthetic construct
  misc_feature 1..19: note = Description of Artificial Sequence: Syntheticoligonucleotide
  source 1..19: mol_type = other DNA
cgagactctagagtctcgg

SEQ ID NO: 15094 - DNA, 19 bp, synthetic construct
  misc_feature 1..19: note = Description of Artificial Sequence: Syntheticoligonucleotide
  source 1..19: mol_type = other DNA
ggtgactctagagtcacca

SEQ ID NO: 15095 - DNA, 19 bp, synthetic construct
  misc_feature 1..19: note = Description of Artificial Sequence: Syntheticoligonucleotide
  source 1..19: mol_type = other DNA
ggtgactctagagtcacct

SEQ ID NO: 15096 - DNA, 19 bp, synthetic construct
  misc_feature 1..19: note = Description of Artificial Sequence: Syntheticoligonucleotide
  source 1..19: mol_type = other DNA
ggtgactctagagtcaccc

SEQ ID NO: 15097 - DNA, 19 bp, synthetic construct
  misc_feature 1..19: note = Description of Artificial Sequence: Syntheticoligonucleotide
  source 1..19: mol_type = other DNA
ggtgactctagagtcaccg

SEQ ID NO: 15098 - DNA, 19 bp, synthetic construct
  misc_feature 1..19: note = Description of Artificial Sequence: Syntheticoligonucleotide
  source 1..19: mol_type = other DNA
cgtgactctagagtcacga

SEQ ID NO: 15099 - DNA, 19 bp, synthetic construct
  misc_feature 1..19: note = Description of Artificial Sequence: Syntheticoligonucleotide
  source 1..19: mol_type = other DNA
cgtgactctagagtcacgc

SEQ ID NO: 15100 - DNA, 19 bp, synthetic construct
  misc_feature 1..19: note = Description of Artificial Sequence: Syntheticoligonucleotide
  source 1..19: mol_type = other DNA
cgtgactctagagtcacgg

SEQ ID NO: 15101 - DNA, 19 bp, synthetic construct
  misc_feature 1..19: note = Description of Artificial Sequence: Syntheticoligonucleotide
  source 1..19: mol_type = other DNA
gaggactctagagtcctca

SEQ ID NO: 15102 - DNA, 19 bp, synthetic construct
  misc_feature 1..19: note = Description of Artificial Sequence: Syntheticoligonucleotide
  source 1..19: mol_type = other DNA
gaggactctagagtcctct

SEQ ID NO: 15103 - DNA, 19 bp, synthetic construct
  misc_feature 1..19: note = Description of Artificial Sequence: Syntheticoligonucleotide
  source 1..19: mol_type = other DNA
gaggactctagagtcctcc

SEQ ID NO: 15104 - DNA, 19 bp, synthetic construct
  misc_feature 1..19: note = Description of Artificial Sequence: Syntheticoligonucleotide
  source 1..19: mol_type = other DNA
gaggactctagagtcctcg

SEQ ID NO: 15105 - DNA, 19 bp, synthetic construct
  misc_feature 1..19: note = Description of Artificial Sequence: Syntheticoligonucleotide
  source 1..19: mol_type = other DNA
caggactctagagtcctga

SEQ ID NO: 15106 - DNA, 19 bp, synthetic construct
  misc_feature 1..19: note = Description of Artificial Sequence: Syntheticoligonucleotide
  source 1..19: mol_type = other DNA
caggactctagagtcctgt

SEQ ID NO: 15107 - DNA, 19 bp, synthetic construct
  misc_feature 1..19: note = Description of Artificial Sequence: Syntheticoligonucleotide
  source 1..19: mol_type = other DNA
caggactctagagtcctgc

SEQ ID NO: 15108 - DNA, 19 bp, synthetic construct
  misc_feature 1..19: note = Description of Artificial Sequence: Syntheticoligonucleotide
  source 1..19: mol_type = other DNA
caggactctagagtcctgg

SEQ ID NO: 15109 - DNA, 19 bp, synthetic construct
  misc_feature 1..19: note = Description of Artificial Sequence: Syntheticoligonucleotide
  source 1..19: mol_type = other DNA
gtggactctagagtccaca

SEQ ID NO: 15110 - DNA, 19 bp, synthetic construct
  misc_feature 1..19: note = Description of Artificial Sequence: Syntheticoligonucleotide
  source 1..19: mol_type = other DNA
gtggactctagagtccact

SEQ ID NO: 15111 - DNA, 19 bp, synthetic construct
  misc_feature 1..19: note = Description of Artificial Sequence: Syntheticoligonucleotide
  source 1..19: mol_type = other DNA
gtggactctagagtccacc

SEQ ID NO: 15112 - DNA, 19 bp, synthetic construct
  misc_feature 1..19: note = Description of Artificial Sequence: Syntheticoligonucleotide
  source 1..19: mol_type = other DNA
gtggactctagagtccacg

SEQ ID NO: 15113 - DNA, 19 bp, synthetic construct
  misc_feature 1..19: note = Description of Artificial Sequence: Syntheticoligonucleotide
  source 1..19: mol_type = other DNA
ctggactctagagtccaga

SEQ ID NO: 15114 - DNA, 19 bp, synthetic construct
  misc_feature 1..19: note = Description of Artificial Sequence: Syntheticoligonucleotide
  source 1..19: mol_type = other DNA
ctggactctagagtccagt

SEQ ID NO: 15115 - DNA, 19 bp, synthetic construct
  misc_feature 1..19: note = Description of Artificial Sequence: Syntheticoligonucleotide
  source 1..19: mol_type = other DNA
ctggactctagagtccagc

SEQ ID NO: 15116 - DNA, 19 bp, synthetic construct
  misc_feature 1..19: note = Description of Artificial Sequence: Syntheticoligonucleotide
  source 1..19: mol_type = other DNA
ctggactctagagtccagg

SEQ ID NO: 15117 - DNA, 19 bp, synthetic construct
  misc_feature 1..19: note = Description of Artificial Sequence: Syntheticoligonucleotide
  source 1..19: mol_type = other DNA
tgggactctagagtcccaa

SEQ ID NO: 15118 - DNA, 19 bp, synthetic construct
  misc_feature 1..19: note = Description of Artificial Sequence: Syntheticoligonucleotide
  source 1..19: mol_type = other DNA
tgggactctagagtcccat

SEQ ID NO: 15119 - DNA, 19 bp, synthetic construct
  misc_feature 1..19: note = Description of Artificial Sequence: Syntheticoligonucleotide
  source 1..19: mol_type = other DNA
tgggactctagagtcccac

SEQ ID NO: 15120 - DNA, 19 bp, synthetic construct
  misc_feature 1..19: note = Description of Artificial Sequence: Syntheticoligonucleotide
  source 1..19: mol_type = other DNA
tgggactctagagtcccag

SEQ ID NO: 15121 - DNA, 19 bp, synthetic construct
  misc_feature 1..19: note = Description of Artificial Sequence: Syntheticoligonucleotide
  source 1..19: mol_type = other DNA
agggactctagagtcccta

SEQ ID NO: 15122 - DNA, 19 bp, synthetic construct
  misc_feature 1..19: note = Description of Artificial Sequence: Syntheticoligonucleotide
  source 1..19: mol_type = other DNA
agggactctagagtccctt

SEQ ID NO: 15123 - DNA, 19 bp, synthetic construct
  misc_feature 1..19: note = Description of Artificial Sequence: Syntheticoligonucleotide
  source 1..19: mol_type = other DNA
agggactctagagtccctc

SEQ ID NO: 15124 - DNA, 19 bp, synthetic construct
  misc_feature 1..19: note = Description of Artificial Sequence: Syntheticoligonucleotide
  source 1..19: mol_type = other DNA
agggactctagagtccctg

SEQ ID NO: 15125 - DNA, 19 bp, synthetic construct
  misc_feature 1..19: note = Description of Artificial Sequence: Syntheticoligonucleotide
  source 1..19: mol_type = other DNA
ggggactctagagtcccca

SEQ ID NO: 15126 - DNA, 19 bp, synthetic construct
  misc_feature 1..19: note = Description of Artificial Sequence: Syntheticoligonucleotide
  source 1..19: mol_type = other DNA
ggggactctagagtcccct

SEQ ID NO: 15127 - DNA, 19 bp, synthetic construct
  misc_feature 1..19: note = Description of Artificial Sequence: Syntheticoligonucleotide
  source 1..19: mol_type = other DNA
ggggactctagagtccccg

SEQ ID NO: 15128 - DNA, 19 bp, synthetic construct
  misc_feature 1..19: note = Description of Artificial Sequence: Syntheticoligonucleotide
  source 1..19: mol_type = other DNA
cgggactctagagtcccga

SEQ ID NO: 15129 - DNA, 19 bp, synthetic construct
  misc_feature 1..19: note = Description of Artificial Sequence: Syntheticoligonucleotide
  source 1..19: mol_type = other DNA
cgggactctagagtcccgt

SEQ ID NO: 15130 - DNA, 19 bp, synthetic construct
  misc_feature 1..19: note = Description of Artificial Sequence: Syntheticoligonucleotide
  source 1..19: mol_type = other DNA
cgggactctagagtcccgc

SEQ ID NO: 15131 - DNA, 17 bp, synthetic construct
  misc_feature 1..17: note = Description of Artificial Sequence: Syntheticoligonucleotide
  source 1..17: mol_type = other DNA
cagactcgcgagtctga

SEQ ID NO: 15132 - DNA, 17 bp, synthetic construct
  misc_feature 1..17: note = Description of Artificial Sequence: Syntheticoligonucleotide
  source 1..17: mol_type = other DNA
cagactcgcgagtctgt

SEQ ID NO: 15133 - DNA, 17 bp, synthetic construct
  misc_feature 1..17: note = Description of Artificial Sequence: Syntheticoligonucleotide
  source 1..17: mol_type = other DNA
cagactcgcgagtctgc

SEQ ID NO: 15134 - DNA, 17 bp, synthetic construct
  misc_feature 1..17: note = Description of Artificial Sequence: Syntheticoligonucleotide
  source 1..17: mol_type = other DNA
cagactcgcgagtctgg

SEQ ID NO: 15135 - DNA, 17 bp, synthetic construct
  misc_feature 1..17: note = Description of Artificial Sequence: Syntheticoligonucleotide
  source 1..17: mol_type = other DNA
ctgactcgcgagtcaga

SEQ ID NO: 15136 - DNA, 17 bp, synthetic construct
  misc_feature 1..17: note = Description of Artificial Sequence: Syntheticoligonucleotide
  source 1..17: mol_type = other DNA
ctgactcgcgagtcagt

SEQ ID NO: 15137 - DNA, 17 bp, synthetic construct
  misc_feature 1..17: note = Description of Artificial Sequence: Syntheticoligonucleotide
  source 1..17: mol_type = other DNA
ctgactcgcgagtcagc

SEQ ID NO: 15138 - DNA, 17 bp, synthetic construct
  misc_feature 1..17: note = Description of Artificial Sequence: Syntheticoligonucleotide
  source 1..17: mol_type = other DNA
ctgactcgcgagtcagg

SEQ ID NO: 15139 - DNA, 17 bp, synthetic construct
  misc_feature 1..17: note = Description of Artificial Sequence: Syntheticoligonucleotide
  source 1..17: mol_type = other DNA
acgactcgcgagtcgta

SEQ ID NO: 15140 - DNA, 17 bp, synthetic construct
  misc_feature 1..17: note = Description of Artificial Sequence: Syntheticoligonucleotide
  source 1..17: mol_type = other DNA
acgactcgcgagtcgtt

SEQ ID NO: 15141 - DNA, 17 bp, synthetic construct
  misc_feature 1..17: note = Description of Artificial Sequence: Syntheticoligonucleotide
  source 1..17: mol_type = other DNA
acgactcgcgagtcgtc

SEQ ID NO: 15142 - DNA, 17 bp, synthetic construct
  misc_feature 1..17: note = Description of Artificial Sequence: Syntheticoligonucleotide
  source 1..17: mol_type = other DNA
acgactcgcgagtcgtg

SEQ ID NO: 15143 - DNA, 17 bp, synthetic construct
  misc_feature 1..17: note = Description of Artificial Sequence: Syntheticoligonucleotide
  source 1..17: mol_type = other DNA
ccgactcgcgagtcgga

SEQ ID NO: 15144 - DNA, 17 bp, synthetic construct
  misc_feature 1..17: note = Description of Artificial Sequence: Syntheticoligonucleotide
  source 1..17: mol_type = other DNA
ccgactcgcgagtcggt

SEQ ID NO: 15145 - DNA, 17 bp, synthetic construct
  misc_feature 1..17: note = Description of Artificial Sequence: Syntheticoligonucleotide
  source 1..17: mol_type = other DNA
ccgactcgcgagtcggc

SEQ ID NO: 15146 - DNA, 17 bp, synthetic construct
  misc_feature 1..17: note = Description of Artificial Sequence: Syntheticoligonucleotide
  source 1..17: mol_type = other DNA
ccgactcgcgagtcggg

SEQ ID NO: 15147 - DNA, 17 bp, synthetic construct
  misc_feature 1..17: note = Description of Artificial Sequence: Syntheticoligonucleotide
  source 1..17: mol_type = other DNA
gagactcgcgagtctca

SEQ ID NO: 15148 - DNA, 17 bp, synthetic construct
  misc_feature 1..17: note = Description of Artificial Sequence: Syntheticoligonucleotide
  source 1..17: mol_type = other DNA
gagactcgcgagtctct

SEQ ID NO: 15149 - DNA, 17 bp, synthetic construct
  misc_feature 1..17: note = Description of Artificial Sequence: Syntheticoligonucleotide
  source 1..17: mol_type = other DNA
gagactcgcgagtctcc

SEQ ID NO: 15150 - DNA, 17 bp, synthetic construct
  misc_feature 1..17: note = Description of Artificial Sequence: Syntheticoligonucleotide
  source 1..17: mol_type = other DNA
gagactcgcgagtctcg

SEQ ID NO: 15151 - DNA, 17 bp, synthetic construct
  misc_feature 1..17: note = Description of Artificial Sequence: Syntheticoligonucleotide
  source 1..17: mol_type = other DNA
gtgactcgcgagtcaca

SEQ ID NO: 15152 - DNA, 17 bp, synthetic construct
  misc_feature 1..17: note = Description of Artificial Sequence: Syntheticoligonucleotide
  source 1..17: mol_type = other DNA
gtgactcgcgagtcact

SEQ ID NO: 15153 - DNA, 17 bp, synthetic construct
  misc_feature 1..17: note = Description of Artificial Sequence: Syntheticoligonucleotide
  source 1..17: mol_type = other DNA
gtgactcgcgagtcacc

SEQ ID NO: 15154 - DNA, 17 bp, synthetic construct
  misc_feature 1..17: note = Description of Artificial Sequence: Syntheticoligonucleotide
  source 1..17: mol_type = other DNA
gtgactcgcgagtcacg

SEQ ID NO: 15155 - DNA, 17 bp, synthetic construct
  misc_feature 1..17: note = Description of Artificial Sequence: Syntheticoligonucleotide
  source 1..17: mol_type = other DNA
aggactcgcgagtccta

SEQ ID NO: 15156 - DNA, 17 bp, synthetic construct
  misc_feature 1..17: note = Description of Artificial Sequence: Syntheticoligonucleotide
  source 1..17: mol_type = other DNA
aggactcgcgagtcctt

SEQ ID NO: 15157 - DNA, 17 bp, synthetic construct
  misc_feature 1..17: note = Description of Artificial Sequence: Syntheticoligonucleotide
  source 1..17: mol_type = other DNA
aggactcgcgagtcctc

SEQ ID NO: 15158 - DNA, 17 bp, synthetic construct
  misc_feature 1..17: note = Description of Artificial Sequence: Syntheticoligonucleotide
  source 1..17: mol_type = other DNA
aggactcgcgagtcctg

SEQ ID NO: 15159 - DNA, 17 bp, synthetic construct
  misc_feature 1..17: note = Description of Artificial Sequence: Syntheticoligonucleotide
  source 1..17: mol_type = other DNA
tggactcgcgagtccaa

SEQ ID NO: 15160 - DNA, 17 bp, synthetic construct
  misc_feature 1..17: note = Description of Artificial Sequence: Syntheticoligonucleotide
  source 1..17: mol_type = other DNA
tggactcgcgagtccat

SEQ ID NO: 15161 - DNA, 17 bp, synthetic construct
  misc_feature 1..17: note = Description of Artificial Sequence: Syntheticoligonucleotide
  source 1..17: mol_type = other DNA
tggactcgcgagtccac

SEQ ID NO: 15162 - DNA, 17 bp, synthetic construct
  misc_feature 1..17: note = Description of Artificial Sequence: Syntheticoligonucleotide
  source 1..17: mol_type = other DNA
tggactcgcgagtccag

SEQ ID NO: 15163 - DNA, 17 bp, synthetic construct
  misc_feature 1..17: note = Description of Artificial Sequence: Syntheticoligonucleotide
  source 1..17: mol_type = other DNA
gggactcgcgagtccca

SEQ ID NO: 15164 - DNA, 17 bp, synthetic construct
  misc_feature 1..17: note = Description of Artificial Sequence: Syntheticoligonucleotide
  source 1..17: mol_type = other DNA
gggactcgcgagtccct

SEQ ID NO: 15165 - DNA, 17 bp, synthetic construct
  misc_feature 1..17: note = Description of Artificial Sequence: Syntheticoligonucleotide
  source 1..17: mol_type = other DNA
gggactcgcgagtcccc

SEQ ID NO: 15166 - DNA, 17 bp, synthetic construct
  misc_feature 1..17: note = Description of Artificial Sequence: Syntheticoligonucleotide
  source 1..17: mol_type = other DNA
gggactcgcgagtcccg

SEQ ID NO: 15167 - DNA, 17 bp, synthetic construct
  misc_feature 1..17: note = Description of Artificial Sequence: Syntheticoligonucleotide
  source 1..17: mol_type = other DNA
gcgactcgcgagtcgca

SEQ ID NO: 15168 - DNA, 17 bp, synthetic construct
  misc_feature 1..17: note = Description of Artificial Sequence: Syntheticoligonucleotide
  source 1..17: mol_type = other DNA
gcgactcgcgagtcgct

SEQ ID NO: 15169 - DNA, 17 bp, synthetic construct
  misc_feature 1..17: note = Description of Artificial Sequence: Syntheticoligonucleotide
  source 1..17: mol_type = other DNA
gcgactcgcgagtcgcc

SEQ ID NO: 15170 - DNA, 17 bp, synthetic construct
  misc_feature 1..17: note = Description of Artificial Sequence: Syntheticoligonucleotide
  source 1..17: mol_type = other DNA
cggactcgcgagtccga

SEQ ID NO: 15171 - DNA, 17 bp, synthetic construct
  misc_feature 1..17: note = Description of Artificial Sequence: Syntheticoligonucleotide
  source 1..17: mol_type = other DNA
cggactcgcgagtccgt

SEQ ID NO: 15172 - DNA, 17 bp, synthetic construct
  misc_feature 1..17: note = Description of Artificial Sequence: Syntheticoligonucleotide
  source 1..17: mol_type = other DNA
cggactcgcgagtccgc

SEQ ID NO: 15173 - DNA, 17 bp, synthetic construct
  misc_feature 1..17: note = Description of Artificial Sequence: Syntheticoligonucleotide
  source 1..17: mol_type = other DNA
acgactccggagtcgta

SEQ ID NO: 15174 - DNA, 17 bp, synthetic construct
  misc_feature 1..17: note = Description of Artificial Sequence: Syntheticoligonucleotide
  source 1..17: mol_type = other DNA
acgactccggagtcgtt

SEQ ID NO: 15175 - DNA, 17 bp, synthetic construct
  misc_feature 1..17: note = Description of Artificial Sequence: Syntheticoligonucleotide
  source 1..17: mol_type = other DNA
acgactccggagtcgtc

SEQ ID NO: 15176 - DNA, 17 bp, synthetic construct
  misc_feature 1..17: note = Description of Artificial Sequence: Syntheticoligonucleotide
  source 1..17: mol_type = other DNA
acgactccggagtcgtg

SEQ ID NO: 15177 - DNA, 17 bp, synthetic construct
  misc_feature 1..17: note = Description of Artificial Sequence: Syntheticoligonucleotide
  source 1..17: mol_type = other DNA
ccgactccggagtcgga

SEQ ID NO: 15178 - DNA, 17 bp, synthetic construct
  misc_feature 1..17: note = Description of Artificial Sequence: Syntheticoligonucleotide
  source 1..17: mol_type = other DNA
ccgactccggagtcggt

SEQ ID NO: 15179 - DNA, 17 bp, synthetic construct
  misc_feature 1..17: note = Description of Artificial Sequence: Syntheticoligonucleotide
  source 1..17: mol_type = other DNA
ccgactccggagtcggc

SEQ ID NO: 15180 - DNA, 17 bp, synthetic construct
  misc_feature 1..17: note = Description of Artificial Sequence: Syntheticoligonucleotide
  source 1..17: mol_type = other DNA
ccgactccggagtcggg

SEQ ID NO: 15181 - DNA, 17 bp, synthetic construct
  misc_feature 1..17: note = Description of Artificial Sequence: Syntheticoligonucleotide
  source 1..17: mol_type = other DNA
gtgactccggagtcaca

SEQ ID NO: 15182 - DNA, 17 bp, synthetic construct
  misc_feature 1..17: note = Description of Artificial Sequence: Syntheticoligonucleotide
  source 1..17: mol_type = other DNA
gtgactccggagtcact

SEQ ID NO: 15183 - DNA, 17 bp, synthetic construct
  misc_feature 1..17: note = Description of Artificial Sequence: Syntheticoligonucleotide
  source 1..17: mol_type = other DNA
gtgactccggagtcacc

SEQ ID NO: 15184 - DNA, 17 bp, synthetic construct
  misc_feature 1..17: note = Description of Artificial Sequence: Syntheticoligonucleotide
  source 1..17: mol_type = other DNA
gtgactccggagtcacg

SEQ ID NO: 15185 - DNA, 17 bp, synthetic construct
  misc_feature 1..17: note = Description of Artificial Sequence: Syntheticoligonucleotide
  source 1..17: mol_type = other DNA
aggactccggagtccta

SEQ ID NO: 15186 - DNA, 17 bp, synthetic construct
  misc_feature 1..17: note = Description of Artificial Sequence: Syntheticoligonucleotide
  source 1..17: mol_type = other DNA
aggactccggagtcctt

SEQ ID NO: 15187 - DNA, 17 bp, synthetic construct
  misc_feature 1..17: note = Description of Artificial Sequence: Syntheticoligonucleotide
  source 1..17: mol_type = other DNA
aggactccggagtcctc

SEQ ID NO: 15188 - DNA, 17 bp, synthetic construct
  misc_feature 1..17: note = Description of Artificial Sequence: Syntheticoligonucleotide
  source 1..17: mol_type = other DNA
aggactccggagtcctg

SEQ ID NO: 15189 - DNA, 17 bp, synthetic construct
  misc_feature 1..17: note = Description of Artificial Sequence: Syntheticoligonucleotide
  source 1..17: mol_type = other DNA
tggactccggagtccaa

SEQ ID NO: 15190 - DNA, 17 bp, synthetic construct
  misc_feature 1..17: note = Description of Artificial Sequence: Syntheticoligonucleotide
  source 1..17: mol_type = other DNA
tggactccggagtccat

SEQ ID NO: 15191 - DNA, 17 bp, synthetic construct
  misc_feature 1..17: note = Description of Artificial Sequence: Syntheticoligonucleotide
  source 1..17: mol_type = other DNA
tggactccggagtccac

SEQ ID NO: 15192 - DNA, 17 bp, synthetic construct
  misc_feature 1..17: note = Description of Artificial Sequence: Syntheticoligonucleotide
  source 1..17: mol_type = other DNA
tggactccggagtccag

SEQ ID NO: 15193 - DNA, 17 bp, synthetic construct
  misc_feature 1..17: note = Description of Artificial Sequence: Syntheticoligonucleotide
  source 1..17: mol_type = other DNA
gggactccggagtccca

SEQ ID NO: 15194 - DNA, 17 bp, synthetic construct
  misc_feature 1..17: note = Description of Artificial Sequence: Syntheticoligonucleotide
  source 1..17: mol_type = other DNA
gggactccggagtccct

SEQ ID NO: 15195 - DNA, 17 bp, synthetic construct
  misc_feature 1..17: note = Description of Artificial Sequence: Syntheticoligonucleotide
  source 1..17: mol_type = other DNA
gggactccggagtcccc

SEQ ID NO: 15196 - DNA, 17 bp, synthetic construct
  misc_feature 1..17: note = Description of Artificial Sequence: Syntheticoligonucleotide
  source 1..17: mol_type = other DNA
gggactccggagtcccg

SEQ ID NO: 15197 - DNA, 17 bp, synthetic construct
  misc_feature 1..17: note = Description of Artificial Sequence: Syntheticoligonucleotide
  source 1..17: mol_type = other DNA
gcgactccggagtcgca

SEQ ID NO: 15198 - DNA, 17 bp, synthetic construct
  misc_feature 1..17: note = Description of Artificial Sequence: Syntheticoligonucleotide
  source 1..17: mol_type = other DNA
gcgactccggagtcgct

SEQ ID NO: 15199 - DNA, 17 bp, synthetic construct
  misc_feature 1..17: note = Description of Artificial Sequence: Syntheticoligonucleotide
  source 1..17: mol_type = other DNA
gcgactccggagtcgcc

SEQ ID NO: 15200 - DNA, 17 bp, synthetic construct
  misc_feature 1..17: note = Description of Artificial Sequence: Syntheticoligonucleotide
  source 1..17: mol_type = other DNA
cggactccggagtccga

SEQ ID NO: 15201 - DNA, 17 bp, synthetic construct
  misc_feature 1..17: note = Description of Artificial Sequence: Syntheticoligonucleotide
  source 1..17: mol_type = other DNA
cggactccggagtccgt

SEQ ID NO: 15202 - DNA, 17 bp, synthetic construct
  misc_feature 1..17: note = Description of Artificial Sequence: Syntheticoligonucleotide
  source 1..17: mol_type = other DNA
cggactccggagtccgc

SEQ ID NO: 15203 - DNA, 17 bp, synthetic construct
  misc_feature 1..17: note = Description of Artificial Sequence: Syntheticoligonucleotide
  source 1..17: mol_type = other DNA
ccgactcatgagtcgga

SEQ ID NO: 15204 - DNA, 17 bp, synthetic construct
  misc_feature 1..17: note = Description of Artificial Sequence: Syntheticoligonucleotide
  source 1..17: mol_type = other DNA
ccgactcatgagtcggt

SEQ ID NO: 15205 - DNA, 17 bp, synthetic construct
  misc_feature 1..17: note = Description of Artificial Sequence: Syntheticoligonucleotide
  source 1..17: mol_type = other DNA
ccgactcatgagtcggc

SEQ ID NO: 15206 - DNA, 17 bp, synthetic construct
  misc_feature 1..17: note = Description of Artificial Sequence: Syntheticoligonucleotide
  source 1..17: mol_type = other DNA
ccgactcatgagtcggg

SEQ ID NO: 15207 - DNA, 17 bp, synthetic construct
  misc_feature 1..17: note = Description of Artificial Sequence: Syntheticoligonucleotide
  source 1..17: mol_type = other DNA
gcgactcatgagtcgca

SEQ ID NO: 15208 - DNA, 17 bp, synthetic construct
  misc_feature 1..17: note = Description of Artificial Sequence: Syntheticoligonucleotide
  source 1..17: mol_type = other DNA
gcgactcatgagtcgct

SEQ ID NO: 15209 - DNA, 17 bp, synthetic construct
  misc_feature 1..17: note = Description of Artificial Sequence: Syntheticoligonucleotide
  source 1..17: mol_type = other DNA
gcgactcatgagtcgcc

SEQ ID NO: 15210 - DNA, 17 bp, synthetic construct
  misc_feature 1..17: note = Description of Artificial Sequence: Syntheticoligonucleotide
  source 1..17: mol_type = other DNA
cggactcatgagtccga

SEQ ID NO: 15211 - DNA, 17 bp, synthetic construct
  misc_feature 1..17: note = Description of Artificial Sequence: Syntheticoligonucleotide
  source 1..17: mol_type = other DNA
cggactcatgagtccgt

SEQ ID NO: 15212 - DNA, 17 bp, synthetic construct
  misc_feature 1..17: note = Description of Artificial Sequence: Syntheticoligonucleotide
  source 1..17: mol_type = other DNA
cggactcatgagtccgc

SEQ ID NO: 15213 - DNA, 17 bp, synthetic construct
  misc_feature 1..17: note = Description of Artificial Sequence: Syntheticoligonucleotide
  source 1..17: mol_type = other DNA
gcgactctagagtcgca

SEQ ID NO: 15214 - DNA, 17 bp, synthetic construct
  misc_feature 1..17: note = Description of Artificial Sequence: Syntheticoligonucleotide
  source 1..17: mol_type = other DNA
gcgactctagagtcgct

SEQ ID NO: 15215 - DNA, 17 bp, synthetic construct
  misc_feature 1..17: note = Description of Artificial Sequence: Syntheticoligonucleotide
  source 1..17: mol_type = other DNA
gcgactctagagtcgcc

SEQ ID NO: 15216 - DNA, 16 bp, synthetic construct
  misc_feature 1..16: note = Description of Artificial Sequence: Syntheticoligonucleotide
  source 1..16: mol_type = other DNA
gcgactcgcgagtcgc

SEQ ID NO: 15217 - DNA, 16 bp, synthetic construct
  misc_feature 1..16: note = Description of Artificial Sequence: Syntheticoligonucleotide
  source 1..16: mol_type = other DNA
acgactcgcgagtcgt

SEQ ID NO: 15218 - DNA, 16 bp, synthetic construct
  misc_feature 1..16: note = Description of Artificial Sequence: Syntheticoligonucleotide
  source 1..16: mol_type = other DNA
ccgactcgcgagtcgg

SEQ ID NO: 15219 - DNA, 16 bp, synthetic construct
  misc_feature 1..16: note = Description of Artificial Sequence: Syntheticoligonucleotide
  source 1..16: mol_type = other DNA
cggactcgcgagtccg

SEQ ID NO: 15220 - DNA, 16 bp, synthetic construct
  misc_feature 1..16: note = Description of Artificial Sequence: Syntheticoligonucleotide
  source 1..16: mol_type = other DNA
aggactcgcgagtcct

SEQ ID NO: 15221 - DNA, 16 bp, synthetic construct
  misc_feature 1..16: note = Description of Artificial Sequence: Syntheticoligonucleotide
  source 1..16: mol_type = other DNA
tggactcgcgagtcca

SEQ ID NO: 15222 - DNA, 16 bp, synthetic construct
  misc_feature 1..16: note = Description of Artificial Sequence: Syntheticoligonucleotide
  source 1..16: mol_type = other DNA
gggactcgcgagtccc

SEQ ID NO: 15223 - DNA, 16 bp, synthetic construct
  misc_feature 1..16: note = Description of Artificial Sequence: Syntheticoligonucleotide
  source 1..16: mol_type = other DNA
cagactcgcgagtctg

SEQ ID NO: 15224 - DNA, 16 bp, synthetic construct
  misc_feature 1..16: note = Description of Artificial Sequence: Syntheticoligonucleotide
  source 1..16: mol_type = other DNA
gagactcgcgagtctc

SEQ ID NO: 15225 - DNA, 16 bp, synthetic construct
  misc_feature 1..16: note = Description of Artificial Sequence: Syntheticoligonucleotide
  source 1..16: mol_type = other DNA
ctgactcgcgagtcag

SEQ ID NO: 15226 - DNA, 16 bp, synthetic construct
  misc_feature 1..16: note = Description of Artificial Sequence: Syntheticoligonucleotide
  source 1..16: mol_type = other DNA
gtgactcgcgagtcac

SEQ ID NO: 15227 - DNA, 16 bp, synthetic construct
  misc_feature 1..16: note = Description of Artificial Sequence: Syntheticoligonucleotide
  source 1..16: mol_type = other DNA
gcgactccggagtcgc

SEQ ID NO: 15228 - DNA, 16 bp, synthetic construct
  misc_feature 1..16: note = Description of Artificial Sequence: Syntheticoligonucleotide
  source 1..16: mol_type = other DNA
acgactccggagtcgt

SEQ ID NO: 15229 - DNA, 16 bp, synthetic construct
  misc_feature 1..16: note = Description of Artificial Sequence: Syntheticoligonucleotide
  source 1..16: mol_type = other DNA
ccgactccggagtcgg

SEQ ID NO: 15230 - DNA, 16 bp, synthetic construct
  misc_feature 1..16: note = Description of Artificial Sequence: Syntheticoligonucleotide
  source 1..16: mol_type = other DNA
cggactccggagtccg

SEQ ID NO: 15231 - DNA, 16 bp, synthetic construct
  misc_feature 1..16: note = Description of Artificial Sequence: Syntheticoligonucleotide
  source 1..16: mol_type = other DNA
aggactccggagtcct

SEQ ID NO: 15232 - DNA, 16 bp, synthetic construct
  misc_feature 1..16: note = Description of Artificial Sequence: Syntheticoligonucleotide
  source 1..16: mol_type = other DNA
tggactccggagtcca

SEQ ID NO: 15233 - DNA, 16 bp, synthetic construct
  misc_feature 1..16: note = Description of Artificial Sequence: Syntheticoligonucleotide
  source 1..16: mol_type = other DNA
gggactccggagtccc

SEQ ID NO: 15234 - DNA, 16 bp, synthetic construct
  misc_feature 1..16: note = Description of Artificial Sequence: Syntheticoligonucleotide
  source 1..16: mol_type = other DNA
gtgactccggagtcac

SEQ ID NO: 15235 - DNA, 16 bp, synthetic construct
  misc_feature 1..16: note = Description of Artificial Sequence: Syntheticoligonucleotide
  source 1..16: mol_type = other DNA
gcgactcatgagtcgc

SEQ ID NO: 15236 - DNA, 16 bp, synthetic construct
  misc_feature 1..16: note = Description of Artificial Sequence: Syntheticoligonucleotide
  source 1..16: mol_type = other DNA
ccgactcatgagtcgg

SEQ ID NO: 15237 - DNA, 16 bp, synthetic construct
  misc_feature 1..16: note = Description of Artificial Sequence: Syntheticoligonucleotide
  source 1..16: mol_type = other DNA
cggactcatgagtccg

SEQ ID NO: 15238 - DNA, 16 bp, synthetic construct
  misc_feature 1..16: note = Description of Artificial Sequence: Syntheticoligonucleotide
  source 1..16: mol_type = other DNA
gcgactctagagtcgc

SEQ ID NO: 15239 - DNA, 33 bp, synthetic construct
  misc_feature 1..33: note = Description of Artificial Sequence: Syntheticoligonucleotide
  source 1..33: mol_type = other DNA
  modified_base 30: mod_base = OTHER; note = 2'-methoxy uracil
  misc_difference 1..33: note = Each position can be independently DNA or RNA
gactcgtgcacgagtcatactcatctgtttacc

SEQ ID NO: 15240 - DNA, 30 bp, synthetic construct
  misc_feature 1..30: note = Description of Artificial Sequence: Syntheticoligonucleotide
  source 1..30: mol_type = other DNA
  modified_base 28: mod_base = OTHER; note = 2'-methoxy uracil
  misc_difference 1..30: note = Each position can be independently DNA or RNA
gactcgtgcacgagtcttttctctggatgg

SEQ ID NO: 15241 - DNA, 12 bp, synthetic construct
  misc_feature 1..12: note = Description of Artificial Sequence: Syntheticoligonucleotide
  misc_difference 6..7: note = a, c, t, or g
  source 1..12: mol_type = other DNA
gactcnngagtc

SEQ ID NO: 15242 - DNA, 13 bp, synthetic construct
  misc_feature 1..13: note = Description of Artificial Sequence: Syntheticoligonucleotide
  misc_difference 6..7: note = a, c, t, or g
  misc_difference 13: note = a, c, t, or g
  source 1..13: mol_type = other DNA
gactcnngagtcn

SEQ ID NO: 15243 - DNA, 14 bp, synthetic construct
  misc_feature 1..14: note = Description of Artificial Sequence: Syntheticoligonucleotide
  misc_difference 1: note = a, c, t, or g
  misc_difference 7..8: note = a, c, t, or g
  misc_difference 14: note = a, c, t, or g
  source 1..14: mol_type = other DNA
ngactcnngagtcn

SEQ ID NO: 15244 - DNA, 15 bp, synthetic construct
  misc_feature 1..15: note = Description of Artificial Sequence: Syntheticoligonucleotide
  misc_difference 1: note = a, c, t, or g
  misc_difference 7..8: note = a, c, t, or g
  misc_difference 14..15: note = a, c, t, or g
  source 1..15: mol_type = other DNA
ngactcnngagtcnn

SEQ ID NO: 15245 - DNA, 16 bp, synthetic construct
  misc_feature 1..16: note = Description of Artificial Sequence: Syntheticoligonucleotide
  misc_difference 1..2: note = a, c, t, or g
  misc_difference 8..9: note = a, c, t, or g
  misc_difference 15..16: note = a, c, t, or g
  source 1..16: mol_type = other DNA
nngactcnngagtcnn

SEQ ID NO: 15246 - DNA, 17 bp, synthetic construct
  misc_feature 1..17: note = Description of Artificial Sequence: Syntheticoligonucleotide
  misc_difference 1..2: note = a, c, t, or g
  misc_difference 8..9: note = a, c, t, or g
  misc_difference 15..17: note = a, c, t, or g
  source 1..17: mol_type = other DNA
nngactcnngagtcnnn

SEQ ID NO: 15247 - DNA, 18 bp, synthetic construct
  misc_feature 1..18: note = Description of Artificial Sequence: Syntheticoligonucleotide
  misc_difference 1..3: note = a, c, t, or g
  misc_difference 9..10: note = a, c, t, or g
  misc_difference 16..18: note = a, c, t, or g
  source 1..18: mol_type = other DNA
nnngactcnngagtcnnn

SEQ ID NO: 15248 - DNA, 19 bp, synthetic construct
  misc_feature 1..19: note = Description of Artificial Sequence: Syntheticoligonucleotide
  misc_difference 1..3: note = a, c, t, or g
  misc_difference 9..10: note = a, c, t, or g
  misc_difference 16..19: note = a, c, t, or g
  source 1..19: mol_type = other DNA
nnngactcnngagtcnnnn

SEQ ID NO: 15249 - DNA, 20 bp, synthetic construct
  misc_feature 1..20: note = Description of Artificial Sequence: Syntheticoligonucleotide
  misc_difference 1..4: note = a, c, t, or g
  misc_difference 10..11: note = a, c, t, or g
  misc_difference 17..20: note = a, c, t, or g
  source 1..20: mol_type = other DNA
nnnngactcnngagtcnnnn

SEQ ID NO: 15250 - DNA, 14 bp, synthetic construct
  misc_feature 1..14: note = Description of Artificial Sequence: Syntheticoligonucleotide
  misc_difference 6..9: note = a, c, t, or g
  source 1..14: mol_type = other DNA
gactcnnnngagtc

SEQ ID NO: 15251 - DNA, 15 bp, synthetic construct
  misc_feature 1..15: note = Description of Artificial Sequence: Syntheticoligonucleotide
  misc_difference 6..9: note = a, c, t, or g
  misc_difference 15: note = a, c, t, or g
  source 1..15: mol_type = other DNA
gactcnnnngagtcn

SEQ ID NO: 15252 - DNA, 16 bp, synthetic construct
  misc_feature 1..16: note = Description of Artificial Sequence: Syntheticoligonucleotide
  misc_difference 1: note = a, c, t, or g
  misc_difference 7..10: note = a, c, t, or g
  misc_difference 16: note = a, c, t, or g
  source 1..16: mol_type = other DNA
ngactcnnnngagtcn

SEQ ID NO: 15253 - DNA, 17 bp, synthetic construct
  misc_feature 1..17: note = Description of Artificial Sequence: Syntheticoligonucleotide
  misc_difference 1: note = a, c, t, or g
  misc_difference 7..10: note = a, c, t, or g
  misc_difference 16..17: note = a, c, t, or g
  source 1..17: mol_type = other DNA
ngactcnnnngagtcnn

SEQ ID NO: 15254 - DNA, 18 bp, synthetic construct
  misc_feature 1..18: note = Description of Artificial Sequence: Syntheticoligonucleotide
  misc_difference 1..2: note = a, c, t, or g
  misc_difference 8..11: note = a, c, t, or g
  misc_difference 17..18: note = a, c, t, or g
  source 1..18: mol_type = other DNA
nngactcnnnngagtcnn

SEQ ID NO: 15255 - DNA, 19 bp, synthetic construct
  misc_feature 1..19: note = Description of Artificial Sequence: Syntheticoligonucleotide
  misc_difference 1..2: note = a, c, t, or g
  misc_difference 8..11: note = a, c, t, or g
  misc_difference 17..19: note = a, c, t, or g
  source 1..19: mol_type = other DNA
nngactcnnnngagtcnnn

SEQ ID NO: 15256 - DNA, 20 bp, synthetic construct
  misc_feature 1..20: note = Description of Artificial Sequence: Syntheticoligonucleotide
  misc_difference 1..3: note = a, c, t, or g
  misc_difference 9..12: note = a, c, t, or g
  misc_difference 18..20: note = a, c, t, or g
  source 1..20: mol_type = other DNA
nnngactcnnnngagtcnnn

SEQ ID NO: 15257 - DNA, 21 bp, synthetic construct
  misc_feature 1..21: note = Description of Artificial Sequence: Syntheticoligonucleotide
  misc_difference 1..3: note = a, c, t, or g
  misc_difference 9..12: note = a, c, t, or g
  misc_difference 18..21: note = a, c, t, or g
  source 1..21: mol_type = other DNA
nnngactcnnnngagtcnnnn

SEQ ID NO: 15258 - DNA, 22 bp, synthetic construct
  misc_feature 1..22: note = Description of Artificial Sequence: Syntheticoligonucleotide
  misc_difference 1..4: note = a, c, t, or g
  misc_difference 10..13: note = a, c, t, or g
  misc_difference 19..22: note = a, c, t, or g
  source 1..22: mol_type = other DNA
nnnngactcnnnngagtcnnnn

SEQ ID NO: 15259 - DNA, 16 bp, synthetic construct
  misc_feature 1..16: note = Description of Artificial Sequence: Syntheticoligonucleotide
  misc_difference 6..11: note = a, c, t, or g
  source 1..16: mol_type = other DNA
gactcnnnnnngagtc

SEQ ID NO: 15260 - DNA, 17 bp, synthetic construct
  misc_feature 1..17: note = Description of Artificial Sequence: Syntheticoligonucleotide
  misc_difference 6..11: note = a, c, t, or g
  misc_difference 17: note = a, c, t, or g
  source 1..17: mol_type = other DNA
gactcnnnnnngagtcn

SEQ ID NO: 15261 - DNA, 18 bp, synthetic construct
  misc_feature 1..18: note = Description of Artificial Sequence: Syntheticoligonucleotide
  misc_difference 6..11: note = a, c, t, or g
  misc_difference 17..18: note = a, c, t, or g
  source 1..18: mol_type = other DNA
gactcnnnnnngagtcnn

SEQ ID NO: 15262 - DNA, 19 bp, synthetic construct
  misc_feature 1..19: note = Description of Artificial Sequence: Syntheticoligonucleotide
  misc_difference 6..11: note = a, c, t, or g
  misc_difference 17..19: note = a, c, t, or g
  source 1..19: mol_type = other DNA
gactcnnnnnngagtcnnn

SEQ ID NO: 15263 - DNA, 20 bp, synthetic construct
  misc_feature 1..20: note = Description of Artificial Sequence: Syntheticoligonucleotide
  misc_difference 6..11: note = a, c, t, or g
  misc_difference 17..20: note = a, c, t, or g
  source 1..20: mol_type = other DNA
gactcnnnnnngagtcnnnn

SEQ ID NO: 15264 - DNA, 18 bp, synthetic construct
  misc_feature 1..18: note = Description of Artificial Sequence: Syntheticoligonucleotide
  misc_difference 1: note = a, c, t, or g
  misc_difference 7..12: note = a, c, t, or g
  misc_difference 18: note = a, c, t, or g
  source 1..18: mol_type = other DNA
ngactcnnnnnngagtcn

SEQ ID NO: 15265 - DNA, 19 bp, synthetic construct
  misc_feature 1..19: note = Description of Artificial Sequence: Syntheticoligonucleotide
  misc_difference 1: note = a, c, t, or g
  misc_difference 7..12: note = a, c, t, or g
  misc_difference 18..19: note = a, c, t, or g
  source 1..19: mol_type = other DNA
ngactcnnnnnngagtcnn

SEQ ID NO: 15266 - DNA, 20 bp, synthetic construct
  misc_feature 1..20: note = Description of Artificial Sequence: Syntheticoligonucleotide
  misc_difference 1: note = a, c, t, or g
  misc_difference 7..12: note = a, c, t, or g
  misc_difference 18..20: note = a, c, t, or g
  source 1..20: mol_type = other DNA
ngactcnnnnnngagtcnnn

SEQ ID NO: 15267 - DNA, 21 bp, synthetic construct
  misc_feature 1..21: note = Description of Artificial Sequence: Syntheticoligonucleotide
  misc_difference 1: note = a, c, t, or g
  misc_difference 7..12: note = a, c, t, or g
  misc_difference 18..21: note = a, c, t, or g
  source 1..21: mol_type = other DNA
ngactcnnnnnngagtcnnnn

SEQ ID NO: 15268 - DNA, 20 bp, synthetic construct
  misc_feature 1..20: note = Description of Artificial Sequence: Syntheticoligonucleotide
  misc_difference 1..2: note = a, c, t, or g
  misc_difference 8..13: note = a, c, t, or g
  misc_difference 19..20: note = a, c, t, or g
  source 1..20: mol_type = other DNA
nngactcnnnnnngagtcnn

SEQ ID NO: 15269 - DNA, 21 bp, synthetic construct
  misc_feature 1..21: note = Description of Artificial Sequence: Syntheticoligonucleotide
  misc_difference 1..2: note = a, c, t, or g
  misc_difference 8..13: note = a, c, t, or g
  misc_difference 19..21: note = a, c, t, or g
  source 1..21: mol_type = other DNA
nngactcnnnnnngagtcnnn

SEQ ID NO: 15270 - DNA, 22 bp, synthetic construct
  misc_feature 1..22: note = Description of Artificial Sequence: Syntheticoligonucleotide
  misc_difference 1..3: note = a, c, t, or g
  misc_difference 9..14: note = a, c, t, or g
  misc_difference 20..22: note = a, c, t, or g
  source 1..22: mol_type = other DNA
nnngactcnnnnnngagtcnnn

SEQ ID NO: 15271 - DNA, 23 bp, synthetic construct
  misc_feature 1..23: note = Description of Artificial Sequence: Syntheticoligonucleotide
  misc_difference 1..3: note = a, c, t, or g
  misc_difference 9..14: note = a, c, t, or g
  misc_difference 20..23: note = a, c, t, or g
  source 1..23: mol_type = other DNA
nnngactcnnnnnngagtcnnnn

SEQ ID NO: 15272 - DNA, 24 bp, synthetic construct
  misc_feature 1..24: note = Description of Artificial Sequence: Syntheticoligonucleotide
  misc_difference 1..4: note = a, c, t, or g
  misc_difference 10..15: note = a, c, t, or g
  misc_difference 21..24: note = a, c, t, or g
  source 1..24: mol_type = other DNA
nnnngactcnnnnnngagtcnnnn

SEQ ID NO: 15273 - DNA, 16 bp, synthetic construct
  misc_feature 1..16: note = Description of Artificial Sequence: Syntheticoligonucleotide
  misc_difference 8..9: note = a, c, t, or g
  source 1..16: mol_type = other DNA
tcgactcnngagtcga

SEQ ID NO: 15274 - DNA, 17 bp, synthetic construct
  misc_feature 1..17: note = Description of Artificial Sequence: Syntheticoligonucleotide
  misc_difference 8..9: note = a, c, t, or g
  misc_difference 17: note = a, c, t, or g
  source 1..17: mol_type = other DNA
tcgactcnngagtcgan

SEQ ID NO: 15275 - DNA, 18 bp, synthetic construct
  misc_feature 1..18: note = Description of Artificial Sequence: Syntheticoligonucleotide
  misc_difference 1: note = a, c, t, or g
  misc_difference 9..10: note = a, c, t, or g
  misc_difference 18: note = a, c, t, or g
  source 1..18: mol_type = other DNA
ntcgactcnngagtcgan

SEQ ID NO: 15276 - DNA, 19 bp, synthetic construct
  misc_feature 1..19: note = Description of Artificial Sequence: Syntheticoligonucleotide
  misc_difference 1: note = a, c, t, or g
  misc_difference 9..10: note = a, c, t, or g
  misc_difference 18..19: note = a, c, t, or g
  source 1..19: mol_type = other DNA
ntcgactcnngagtcgann

SEQ ID NO: 15277 - DNA, 18 bp, synthetic construct
  misc_feature 1..18: note = Description of Artificial Sequence: Syntheticoligonucleotide
  misc_difference 9..10: note = a, c, t, or g
  source 1..18: mol_type = other DNA
gtcgactcnngagtcgac

SEQ ID NO: 15278 - DNA, 19 bp, synthetic construct
  misc_feature 1..19: note = Description of Artificial Sequence: Syntheticoligonucleotide
  misc_difference 9..10: note = a, c, t, or g
  misc_difference 19: note = a, c, t, or g
  source 1..19: mol_type = other DNA
gtcgactcnngagtcgacn

SEQ ID NO: 15279 - DNA, 20 bp, synthetic construct
  misc_feature 1..20: note = Description of Artificial Sequence: Syntheticoligonucleotide
  misc_difference 1..2: note = a, c, t, or g
  misc_difference 10..11: note = a, c, t, or g
  misc_difference 19..20: note = a, c, t, or g
  source 1..20: mol_type = other DNA
nntcgactcnngagtcgann

SEQ ID NO: 15280 - DNA, 20 bp, synthetic construct
  misc_feature 1..20: note = Description of Artificial Sequence: Syntheticoligonucleotide
  misc_difference 1: note = a, c, t, or g
  misc_difference 10..11: note = a, c, t, or g
  misc_difference 20: note = a, c, t, or g
  source 1..20: mol_type = other DNA
ngtcgactcnngagtcgacn

SEQ ID NO: 15281 - DNA, 20 bp, synthetic construct
  misc_feature 1..20: note = Description of Artificial Sequence: Syntheticoligonucleotide
  misc_difference 10..11: note = a, c, t, or g
  source 1..20: mol_type = other DNA
agtcgactcnngagtcgact

SEQ ID NO: 15282 - DNA, 14 bp, synthetic construct
  misc_feature 1..14: note = Description of Artificial Sequence: Syntheticoligonucleotide
  source 1..14: mol_type = other DNA
gactcgatcgagtc

SEQ ID NO: 15283 - DNA, 15 bp, synthetic construct
  misc_feature 1..15: note = Description of Artificial Sequence: Syntheticoligonucleotide
  misc_difference 15: note = a, c, t, or g
  source 1..15: mol_type = other DNA
gactcgatcgagtcn

SEQ ID NO: 15284 - DNA, 16 bp, synthetic construct
  misc_feature 1..16: note = Description of Artificial Sequence: Syntheticoligonucleotide
  misc_difference 1: note = a, c, t, or g
  misc_difference 16: note = a, c, t, or g
  source 1..16: mol_type = other DNA
ngactcgatcgagtcn

SEQ ID NO: 15285 - DNA, 17 bp, synthetic construct
  misc_feature 1..17: note = Description of Artificial Sequence: Syntheticoligonucleotide
  misc_difference 1: note = a, c, t, or g
  misc_difference 16..17: note = a, c, t, or g
  source 1..17: mol_type = other DNA
ngactcgatcgagtcnn

SEQ ID NO: 15286 - DNA, 18 bp, synthetic construct
  misc_feature 1..18: note = Description of Artificial Sequence: Syntheticoligonucleotide
  misc_difference 1..2: note = a, c, t, or g
  misc_difference 17..18: note = a, c, t, or g
  source 1..18: mol_type = other DNA
nngactcgatcgagtcnn

SEQ ID NO: 15287 - DNA, 19 bp, synthetic construct
  misc_feature 1..19: note = Description of Artificial Sequence: Syntheticoligonucleotide
  misc_difference 1..2: note = a, c, t, or g
  misc_difference 17..19: note = a, c, t, or g
  source 1..19: mol_type = other DNA
nngactcgatcgagtcnnn

SEQ ID NO: 15288 - DNA, 18 bp, synthetic construct
  misc_feature 1..18: note = Description of Artificial Sequence: Syntheticoligonucleotide
  misc_difference 8..11: note = a, c, t, or g
  source 1..18: mol_type = other DNA
tcgactcnnnngagtcga

SEQ ID NO: 15289 - DNA, 19 bp, synthetic construct
  misc_feature 1..19: note = Description of Artificial Sequence: Syntheticoligonucleotide
  misc_difference 8..11: note = a, c, t, or g
  misc_difference 19: note = a, c, t, or g
  source 1..19: mol_type = other DNA
tcgactcnnnngagtcgan

SEQ ID NO: 15290 - DNA, 20 bp, synthetic construct
  misc_feature 1..20: note = Description of Artificial Sequence: Syntheticoligonucleotide
  misc_difference 1..3: note = a, c, t, or g
  misc_difference 18..20: note = a, c, t, or g
  source 1..20: mol_type = other DNA
nnngactcgatcgagtcnnn

SEQ ID NO: 15291 - DNA, 21 bp, synthetic construct
  misc_feature 1..21: note = Description of Artificial Sequence: Syntheticoligonucleotide
  misc_difference 1..3: note = a, c, t, or g
  misc_difference 18..21: note = a, c, t, or g
  source 1..21: mol_type = other DNA
nnngactcgatcgagtcnnnn

SEQ ID NO: 15292 - DNA, 20 bp, synthetic construct
  misc_feature 1..20: note = Description of Artificial Sequence: Syntheticoligonucleotide
  misc_difference 1: note = a, c, t, or g
  misc_difference 9..12: note = a, c, t, or g
  misc_difference 20: note = a, c, t, or g
  source 1..20: mol_type = other DNA
ntcgactcnnnngagtcgan

SEQ ID NO: 15293 - DNA, 21 bp, synthetic construct
  misc_feature 1..21: note = Description of Artificial Sequence: Syntheticoligonucleotide
  misc_difference 1: note = a, c, t, or g
  misc_difference 9..12: note = a, c, t, or g
  misc_difference 20..21: note = a, c, t, or g
  source 1..21: mol_type = other DNA
ntcgactcnnnngagtcgann

SEQ ID NO: 15294 - DNA, 20 bp, synthetic construct
  misc_feature 1..20: note = Description of Artificial Sequence: Syntheticoligonucleotide
  misc_difference 9..12: note = a, c, t, or g
  source 1..20: mol_type = other DNA
gtcgactcnnnngagtcgac

SEQ ID NO: 15295 - DNA, 21 bp, synthetic construct
  misc_feature 1..21: note = Description of Artificial Sequence: Syntheticoligonucleotide
  misc_difference 9..12: note = a, c, t, or g
  misc_difference 21: note = a, c, t, or g
  source 1..21: mol_type = other DNA
gtcgactcnnnngagtcgacn

SEQ ID NO: 15296 - DNA, 22 bp, synthetic construct
  misc_feature 1..22: note = Description of Artificial Sequence: Syntheticoligonucleotide
  misc_difference 1..4: note = a, c, t, or g
  misc_difference 19..22: note = a, c, t, or g
  source 1..22: mol_type = other DNA
nnnngactcgatcgagtcnnnn

SEQ ID NO: 15297 - DNA, 22 bp, synthetic construct
  misc_feature 1..22: note = Description of Artificial Sequence: Syntheticoligonucleotide
  misc_difference 1..2: note = a, c, t, or g
  misc_difference 10..13: note = a, c, t, or g
  misc_difference 21..22: note = a, c, t, or g
  source 1..22: mol_type = other DNA
nntcgactcnnnngagtcgann

SEQ ID NO: 15298 - DNA, 22 bp, synthetic construct
  misc_feature 1..22: note = Description of Artificial Sequence: Syntheticoligonucleotide
  misc_difference 1: note = a, c, t, or g
  misc_difference 10..13: note = a, c, t, or g
  misc_difference 22: note = a, c, t, or g
  source 1..22: mol_type = other DNA
ngtcgactcnnnngagtcgacn

SEQ ID NO: 15299 - DNA, 22 bp, synthetic construct
  misc_feature 1..22: note = Description of Artificial Sequence: Syntheticoligonucleotide
  misc_difference 10..13: note = a, c, t, or g
  source 1..22: mol_type = other DNA
agtcgactcnnnngagtcgact

SEQ ID NO: 15300 - DNA, 16 bp, synthetic construct
  misc_feature 1..16: note = Description of Artificial Sequence: Syntheticoligonucleotide
  misc_difference 8..9: note = a, c, t, or g
  source 1..16: mol_type = other DNA
gactcganntcgagtc

SEQ ID NO: 15301 - DNA, 17 bp, synthetic construct
  misc_feature 1..17: note = Description of Artificial Sequence: Syntheticoligonucleotide
  misc_difference 8..9: note = a, c, t, or g
  misc_difference 17: note = a, c, t, or g
  source 1..17: mol_type = other DNA
gactcganntcgagtcn

SEQ ID NO: 15302 - DNA, 18 bp, synthetic construct
  misc_feature 1..18: note = Description of Artificial Sequence: Syntheticoligonucleotide
  misc_difference 1: note = a, c, t, or g
  misc_difference 9..10: note = a, c, t, or g
  misc_difference 18: note = a, c, t, or g
  source 1..18: mol_type = other DNA
ngactcganntcgagtcn

SEQ ID NO: 15303 - DNA, 19 bp, synthetic construct
  misc_feature 1..19: note = Description of Artificial Sequence: Syntheticoligonucleotide
  misc_difference 1: note = a, c, t, or g
  misc_difference 9..10: note = a, c, t, or g
  misc_difference 18..19: note = a, c, t, or g
  source 1..19: mol_type = other DNA
ngactcganntcgagtcnn

SEQ ID NO: 15304 - DNA, 20 bp, synthetic construct
  misc_feature 1..20: note = Description of Artificial Sequence: Syntheticoligonucleotide
  misc_difference 1..2: note = a, c, t, or g
  misc_difference 10..11: note = a, c, t, or g
  misc_difference 19..20: note = a, c, t, or g
  source 1..20: mol_type = other DNA
nngactcganntcgagtcnn

SEQ ID NO: 15305 - DNA, 21 bp, synthetic construct
  misc_feature 1..21: note = Description of Artificial Sequence: Syntheticoligonucleotide
  misc_difference 1..2: note = a, c, t, or g
  misc_difference 10..11: note = a, c, t, or g
  misc_difference 19..21: note = a, c, t, or g
  source 1..21: mol_type = other DNA
nngactcganntcgagtcnnn

SEQ ID NO: 15306 - DNA, 20 bp, synthetic construct
  misc_feature 1..20: note = Description of Artificial Sequence: Syntheticoligonucleotide
  misc_difference 8..13: note = a, c, t, or g
  source 1..20: mol_type = other DNA
tcgactcnnnnnngagtcga

SEQ ID NO: 15307 - DNA, 21 bp, synthetic construct
  misc_feature 1..21: note = Description of Artificial Sequence: Syntheticoligonucleotide
  misc_difference 8..13: note = a, c, t, or g
  misc_difference 21: note = a, c, t, or g
  source 1..21: mol_type = other DNA
tcgactcnnnnnngagtcgan

SEQ ID NO: 15308 - DNA, 22 bp, synthetic construct
  misc_feature 1..22: note = Description of Artificial Sequence: Syntheticoligonucleotide
  misc_difference 1..3: note = a, c, t, or g
  misc_difference 11..12: note = a, c, t, or g
  misc_difference 20..22: note = a, c, t, or g
  source 1..22: mol_type = other DNA
nnngactcganntcgagtcnnn

SEQ ID NO: 15309 - DNA, 23 bp, synthetic construct
  misc_feature 1..23: note = Description of Artificial Sequence: Syntheticoligonucleotide
  misc_difference 1..3: note = a, c, t, or g
  misc_difference 11..12: note = a, c, t, or g
  misc_difference 20..23: note = a, c, t, or g
  source 1..23: mol_type = other DNA
nnngactcganntcgagtcnnnn

SEQ ID NO: 15310 - DNA, 24 bp, synthetic construct
  misc_feature 1..24: note = Description of Artificial Sequence: Syntheticoligonucleotide
  misc_difference 1: note = a, c, t, or g
  misc_difference 10..15: note = a, c, t, or g
  misc_difference 24: note = a, c, t, or g
  source 1..24: mol_type = other DNA
ngtcgactcnnnnnngagtcgacn

SEQ ID NO: 15311 - DNA, 22 bp, synthetic construct
  misc_feature 1..22: note = Description of Artificial Sequence: Syntheticoligonucleotide
  misc_difference 9..14: note = a, c, t, or g
  source 1..22: mol_type = other DNA
gtcgactcnnnnnngagtcgac

SEQ ID NO: 15312 - DNA, 23 bp, synthetic construct
  misc_feature 1..23: note = Description of Artificial Sequence: Syntheticoligonucleotide
  misc_difference 9..14: note = a, c, t, or g
  misc_difference 23: note = a, c, t, or g
  source 1..23: mol_type = other DNA
gtcgactcnnnnnngagtcgacn

SEQ ID NO: 15313 - DNA, 24 bp, synthetic construct
  misc_feature 1..24: note = Description of Artificial Sequence: Syntheticoligonucleotide
  misc_difference 1..4: note = a, c, t, or g
  misc_difference 12..13: note = a, c, t, or g
  misc_difference 21..24: note = a, c, t, or g
  source 1..24: mol_type = other DNA
nnnngactcganntcgagtcnnnn

SEQ ID NO: 15314 - DNA, 24 bp, synthetic construct
  misc_feature 1..24: note = Description of Artificial Sequence: Syntheticoligonucleotide
  misc_difference 1..2: note = a, c, t, or g
  misc_difference 10..15: note = a, c, t, or g
  misc_difference 23..24: note = a, c, t, or g
  source 1..24: mol_type = other DNA
nntcgactcnnnnnngagtcgann

SEQ ID NO: 15315 - DNA, 24 bp, synthetic construct
  misc_feature 1..24: note = Description of Artificial Sequence: Syntheticoligonucleotide
  misc_difference 10..15: note = a, c, t, or g
  source 1..24: mol_type = other DNA
agtcgactcnnnnnngagtcgact

SEQ ID NO: 15316 - DNA, 72 bp, Glycine max
  source 1..72: mol_type = unassigned DNA
ccaaggttctcattacctatgatgcctccaccagcctcttggttgcttctttggtctacccttcacagagaa

SEQ ID NO: 15317 - DNA, 15 bp, synthetic construct
  misc_feature 1..15: note = Description of Artificial Sequence: Syntheticprimer
  source 1..15: mol_type = other DNA
attacctatgatgcc

SEQ ID NO: 15318 - DNA, 14 bp, synthetic construct
  misc_feature 1..14: note = Description of Artificial Sequence: Syntheticprimer
  source 1..14: mol_type = other DNA
accaaagaagcaac

SEQ ID NO: 15319 - DNA, 39 bp, synthetic construct
  misc_feature 1..39: note = Description of Artificial Sequence: Syntheticoligonucleotide
  source 1..39: mol_type = other DNA
  modified_base 36: mod_base = OTHER; note = 2'-methoxy uracil
  modified_base 37: mod_base = OTHER; note = 2'-methoxy guanine
  modified_base 38: mod_base = OTHER; note = 2'-methoxy cytosine
  modified_base 39: mod_base = OTHER; note = 2'-methoxy cytosine
  misc_difference 36..39: note = Each position can be independently DNA or RNA
acgcgactcgtcgacgagtcgcgtattacctatgatgcc

SEQ ID NO: 15320 - DNA, 38 bp, synthetic construct
  misc_feature 1..38: note = Description of Artificial Sequence: Syntheticoligonucleotide
  source 1..38: mol_type = other DNA
  modified_base 34: mod_base = OTHER; note = 2'-methoxy guanine
  modified_base 35: mod_base = OTHER; note = 2'-methoxy cytosine
  modified_base 36: mod_base = OTHER; note = 2'-methoxy adenine
  modified_base 37: mod_base = OTHER; note = 2'-methoxy adenine
  modified_base 38: mod_base = OTHER; note = 2'-methoxy cytosine
  misc_difference 34..38: note = Each position can be independently DNA or RNA
acgcgactcgtcgacgagtcgcgtaccaaagaagcaac

SEQ ID NO: 15321 - DNA, 24 bp, synthetic construct
  misc_feature 1..24: note = Description of Artificial Sequence: Syntheticprobe
  modified_base 13: mod_base = OTHER; note = Inosine
  source 1..24: mol_type = other DNA
cgcgctccaccancctcttgcgcg

SEQ ID NO: 15322 - DNA, 38 bp, Salmonella enterica
  source 1..38: mol_type = unassigned DNA
atactcatctgtttaccgggcataccatccagagaaaa

SEQ ID NO: 15323 - DNA, 17 bp, synthetic construct
  misc_feature 1..17: note = Description of Artificial Sequence: Syntheticprimer
  source 1..17: mol_type = other DNA
atactcatctgtttacc

SEQ ID NO: 15324 - DNA, 14 bp, synthetic construct
  misc_feature 1..14: note = Description of Artificial Sequence: Syntheticprimer
  source 1..14: mol_type = other DNA
ttttctctggatgg

SEQ ID NO: 15325 - DNA, 41 bp, synthetic construct
  misc_feature 1..41: note = Description of Artificial Sequence: Syntheticoligonucleotide
  source 1..41: mol_type = other DNA
  modified_base 36: mod_base = OTHER; note = 2'-methoxy uracil
  modified_base 37: mod_base = OTHER; note = 2'-methoxy uracil
  modified_base 38: mod_base = OTHER; note = 2'-methoxy uracil
  modified_base 39: mod_base = OTHER; note = 2'-methoxy adenine
  modified_base 40: mod_base = OTHER; note = 2'-methoxy cytosine
  modified_base 41: mod_base = OTHER; note = 2'-methoxy cytosine
  misc_difference 36..41: note = Each position can be independently DNA or RNA
ggctgactcctgcaggagtcagccatactcatctgtttacc

SEQ ID NO: 15326 - DNA, 41 bp, synthetic construct; identical to SEQ ID NO: 15325
  misc_feature 1..41: note = Description of Artificial Sequence: Syntheticoligonucleotide
  source 1..41: mol_type = other DNA
  modified_base 37: mod_base = OTHER; note = 2'-methoxy uracil
  modified_base 38: mod_base = OTHER; note = 2'-methoxy uracil
  modified_base 39: mod_base = OTHER; note = 2'-methoxy adenine
  modified_base 40: mod_base = OTHER; note = 2'-methoxy cytosine
  modified_base 41: mod_base = OTHER; note = 2'-methoxy cytosine
  misc_difference 37..41: note = Each position can be independently DNA or RNA

SEQ ID NO: 15327 - DNA, 38 bp, synthetic construct
  misc_feature 1..38: note = Description of Artificial Sequence: Syntheticoligonucleotide
  source 1..38: mol_type = other DNA
  modified_base 34: mod_base = OTHER; note = 2'-methoxy guanine
  modified_base 35: mod_base = OTHER; note = 2'-methoxy adenine
  modified_base 36: mod_base = OTHER; note = 2'-methoxy uracil
  modified_base 37: mod_base = OTHER; note = 2'-methoxy guanine
  modified_base 38: mod_base = OTHER; note = 2'-methoxy guanine
  misc_difference 34..38: note = Each position can be independently DNA or RNA
ggctgactcctgcaggagtcagccttttctctggatgg

SEQ ID NO: 15328 - DNA, 27 bp, synthetic construct
  misc_feature 1..27: note = Description of Artificial Sequence: Syntheticprobe
  source 1..27: mol_type = other DNA
acctgtttaccgggcatacaaacaggt

SEQ ID NO: 15329 - DNA, 24 bp, synthetic construct
  misc_feature 1..24: note = Description of Artificial Sequence: Syntheticoligonucleotide
  source 1..24: mol_type = other DNA
ccgggactccgcgcggagtcccgg

SEQ ID NO: 15330 - DNA, 24 bp, synthetic construct
  misc_feature 1..24: note = Description of Artificial Sequence: Syntheticoligonucleotide
  source 1..24: mol_type = other DNA
cccggactccgcgcggagtccggg

SEQ ID NO: 15331 - DNA, 24 bp, synthetic construct
  misc_feature 1..24: note = Description of Artificial Sequence: Syntheticoligonucleotide
  source 1..24: mol_type = other DNA
gccggactccgcgcggagtccggc

SEQ ID NO: 15332 - DNA, 24 bp, synthetic construct
  misc_feature 1..24: note = Description of Artificial Sequence: Syntheticoligonucleotide
  source 1..24: mol_type = other DNA
ggccgactccgcgcggagtcggcc

SEQ ID NO: 15333 - DNA, 24 bp, synthetic construct
  misc_feature 1..24: note = Description of Artificial Sequence: Syntheticoligonucleotide
  source 1..24: mol_type = other DNA
ggtcgactccgcgcggagtcgacc

SEQ ID NO: 15334 - DNA, 24 bp, synthetic construct
  misc_feature 1..24: note = Description of Artificial Sequence: Syntheticoligonucleotide
  source 1..24: mol_type = other DNA
gctcgactccgcgcggagtcgagc

SEQ ID NO: 15335 - DNA, 24 bp, synthetic construct
  misc_feature 1..24: note = Description of Artificial Sequence: Syntheticoligonucleotide
  source 1..24: mol_type = other DNA
accggactccgcgcggagtccggt

SEQ ID NO: 15336 - DNA, 24 bp, synthetic construct
  misc_feature 1..24: note = Description of Artificial Sequence: Syntheticoligonucleotide
  source 1..24: mol_type = other DNA
tccggactccgcgcggagtccgga

SEQ ID NO: 15337 - DNA, 24 bp, synthetic construct
  misc_feature 1..24: note = Description of Artificial Sequence: Syntheticoligonucleotide
  source 1..24: mol_type = other DNA
ggcggactcgggcccgagtccgcc

SEQ ID NO: 15338 - DNA, 24 bp, synthetic construct
  misc_feature 1..24: note = Description of Artificial Sequence: Syntheticoligonucleotide
  source 1..24: mol_type = other DNA
gcccgactcgggcccgagtcgggc

SEQ ID NO: 15339 - DNA, 24 bp, synthetic construct
  misc_feature 1..24: note = Description of Artificial Sequence: Syntheticoligonucleotide
  source 1..24: mol_type = other DNA
gggcgactcgggcccgagtcgccc

SEQ ID NO: 15340 - DNA, 24 bp, synthetic construct
  misc_feature 1..24: note = Description of Artificial Sequence: Syntheticoligonucleotide
  source 1..24: mol_type = other DNA
gggagactcgggcccgagtctccc

SEQ ID NO: 15341 - DNA, 24 bp, synthetic construct
  misc_feature 1..24: note = Description of Artificial Sequence: Syntheticoligonucleotide
  source 1..24: mol_type = other DNA
gggtgactcgggcccgagtcaccc

SEQ ID NO: 15342 - DNA, 24 bp, synthetic construct
  misc_feature 1..24: note = Description of Artificial Sequence: Syntheticoligonucleotide
  source 1..24: mol_type = other DNA
ggacgactcgggcccgagtcgtcc

SEQ ID NO: 15343 - DNA, 24 bp, synthetic construct
  misc_feature 1..24: note = Description of Artificial Sequence: Syntheticoligonucleotide
  source 1..24: mol_type = other DNA
gcacgactcgggcccgagtcgtgc

SEQ ID NO: 15344 - DNA, 24 bp, synthetic construct
  misc_feature 1..24: note = Description of Artificial Sequence: Syntheticoligonucleotide
  source 1..24: mol_type = other DNA
gaccgactcgggcccgagtcggtc

SEQ ID NO: 15345 - DNA, 24 bp, synthetic construct
  misc_feature 1..24: note = Description of Artificial Sequence: Syntheticoligonucleotide
  source 1..24: mol_type = other DNA
gtccgactcgggcccgagtcggac

SEQ ID NO: 15346 - DNA, 24 bp, synthetic construct
  misc_feature 1..24: note = Description of Artificial Sequence: Syntheticoligonucleotide
  source 1..24: mol_type = other DNA
acccgactcgggcccgagtcgggt

SEQ ID NO: 15347 - DNA, 24 bp, synthetic construct
  misc_feature 1..24: note = Description of Artificial Sequence: Syntheticoligonucleotide
  source 1..24: mol_type = other DNA
tcccgactcgggcccgagtcggga

SEQ ID NO: 15348 - DNA, 24 bp, synthetic construct
  misc_feature 1..24: note = Description of Artificial Sequence: Syntheticoligonucleotide
  source 1..24: mol_type = other DNA
gccagactcgggcccgagtctggc

SEQ ID NO: 15349 - DNA, 24 bp, synthetic construct
  misc_feature 1..24: note = Description of Artificial Sequence: Syntheticoligonucleotide
  source 1..24: mol_type = other DNA
gcctgactcgggcccgagtcaggc

SEQ ID NO: 15350 - DNA, 24 bp, synthetic construct
  misc_feature 1..24: note = Description of Artificial Sequence: Syntheticoligonucleotide
  source 1..24: mol_type = other DNA
gacggactcgggcccgagtccgtc

SEQ ID NO: 15351 - DNA, 24 bp, synthetic construct
  misc_feature 1..24: note = Description of Artificial Sequence: Syntheticoligonucleotide
  source 1..24: mol_type = other DNA
gtcggactcgggcccgagtccgac

SEQ ID NO: 15352 - DNA, 24 bp, synthetic construct
  misc_feature 1..24: note = Description of Artificial Sequence: Syntheticoligonucleotide
  source 1..24: mol_type = other DNA
agcggactcgggcccgagtccgct

SEQ ID NO: 15353 - DNA, 24 bp, synthetic construct
  misc_feature 1..24: note = Description of Artificial Sequence: Syntheticoligonucleotide
  source 1..24: mol_type = other DNA
tgcggactcgggcccgagtccgca

SEQ ID NO: 15354 - DNA, 24 bp, synthetic construct
  misc_feature 1..24: note = Description of Artificial Sequence: Syntheticoligonucleotide
  source 1..24: mol_type = other DNA
ggaggactcgggcccgagtcctcc

SEQ ID NO: 15355 - DNA, 24 bp, synthetic construct
  misc_feature 1..24: note = Description of Artificial Sequence: Syntheticoligonucleotide
  source 1..24: mol_type = other DNA
ggtggactcgggcccgagtccacc

SEQ ID NO: 15356 - DNA, 24 bp, synthetic construct
  misc_feature 1..24: note = Description of Artificial Sequence: Syntheticoligonucleotide
  source 1..24: mol_type = other DNA
ggcagactcgggcccgagtctgcc

SEQ ID NO: 15357 - DNA, 24 bp, synthetic construct
  misc_feature 1..24: note = Description of Artificial Sequence: Syntheticoligonucleotide
  source 1..24: mol_type = other DNA
ggctgactcgggcccgagtcagcc

SEQ ID NO: 15358 - DNA, 24 bp, synthetic construct
  misc_feature 1..24: note = Description of Artificial Sequence: Syntheticoligonucleotide
  source 1..24: mol_type = other DNA
cacggactcgggcccgagtccgtg

SEQ ID NO: 15359 - DNA, 24 bp, synthetic construct
  misc_feature 1..24: note = Description of Artificial Sequence: Syntheticoligonucleotide
  source 1..24: mol_type = other DNA
ctcggactcgggcccgagtccgag

SEQ ID NO: 15360 - DNA, 24 bp, synthetic construct
  misc_feature 1..24: note = Description of Artificial Sequence: Syntheticoligonucleotide
  source 1..24: mol_type = other DNA
ccaggactcgggcccgagtcctgg

SEQ ID NO: 15361 - DNA, 24 bp, synthetic construct
  misc_feature 1..24: note = Description of Artificial Sequence: Syntheticoligonucleotide
  source 1..24: mol_type = other DNA
cctggactcgggcccgagtccagg

SEQ ID NO: 15362 - DNA, 24 bp, synthetic construct
  misc_feature 1..24: note = Description of Artificial Sequence: Syntheticoligonucleotide
  source 1..24: mol_type = other DNA
cccagactcgggcccgagtctggg

SEQ ID NO: 15363 - DNA, 24 bp, synthetic construct
  misc_feature 1..24: note = Description of Artificial Sequence: Syntheticoligonucleotide
  source 1..24: mol_type = other DNA
ccctgactcgggcccgagtcaggg

SEQ ID NO: 15364 - DNA, 24 bp, synthetic construct
  misc_feature 1..24: note = Description of Artificial Sequence: Syntheticoligonucleotide
  source 1..24: mol_type = other DNA
acgggactcgggcccgagtcccgt

SEQ ID NO: 15365 - DNA, 24 bp, synthetic construct
  misc_feature 1..24: note = Description of Artificial Sequence: Syntheticoligonucleotide
  source 1..24: mol_type = other DNA
tcgggactcgggcccgagtcccga

SEQ ID NO: 15366 - DNA, 24 bp, synthetic construct
  misc_feature 1..24: note = Description of Artificial Sequence: Syntheticoligonucleotide
  source 1..24: mol_type = other DNA
cagggactcgggcccgagtccctg

SEQ ID NO: 15367 - DNA, 24 bp, synthetic construct
  misc_feature 1..24: note = Description of Artificial Sequence: Syntheticoligonucleotide
  source 1..24: mol_type = other DNA
ctgggactcgggcccgagtcccag

SEQ ID NO: 15368 - DNA, 24 bp, synthetic construct
  misc_feature 1..24: note = Description of Artificial Sequence: Syntheticoligonucleotide
  source 1..24: mol_type = other DNA
ggcggactcggcgccgagtccgcc

SEQ ID NO: 15369 - DNA, 24 bp, synthetic construct
  misc_feature 1..24: note = Description of Artificial Sequence: Syntheticoligonucleotide
  source 1..24: mol_type = other DNA
gcccgactcggcgccgagtcgggc

SEQ ID NO: 15370 - DNA, 24 bp, synthetic construct
  misc_feature 1..24: note = Description of Artificial Sequence: Syntheticoligonucleotide
  source 1..24: mol_type = other DNA
gggcgactcggcgccgagtcgccc

SEQ ID NO: 15371 - DNA, 24 bp, synthetic construct
  misc_feature 1..24: note = Description of Artificial Sequence: Syntheticoligonucleotide
  source 1..24: mol_type = other DNA
gggagactcggcgccgagtctccc

SEQ ID NO: 15372 - DNA, 24 bp, synthetic construct
  misc_feature 1..24: note = Description of Artificial Sequence: Syntheticoligonucleotide
  source 1..24: mol_type = other DNA
gggtgactcggcgccgagtcaccc

SEQ ID NO: 15373 - DNA, 24 bp, synthetic construct
  misc_feature 1..24: note = Description of Artificial Sequence: Syntheticoligonucleotide
  source 1..24: mol_type = other DNA
ggacgactcggcgccgagtcgtcc

SEQ ID NO: 15374 - DNA, 24 bp, synthetic construct
  misc_feature 1..24: note = Description of Artificial Sequence: Syntheticoligonucleotide
  source 1..24: mol_type = other DNA
gcacgactcggcgccgagtcgtgc

SEQ ID NO: 15375 - DNA, 24 bp, synthetic construct
  misc_feature 1..24: note = Description of Artificial Sequence: Syntheticoligonucleotide
  source 1..24: mol_type = other DNA
gaccgactcggcgccgagtcggtc

SEQ ID NO: 15376 - DNA, 24 bp, synthetic construct
  misc_feature 1..24: note = Description of Artificial Sequence: Syntheticoligonucleotide
  source 1..24: mol_type = other DNA
gtccgactcggcgccgagtcggac

SEQ ID NO: 15377 - DNA, 24 bp, synthetic construct
  misc_feature 1..24: note = Description of Artificial Sequence: Syntheticoligonucleotide
  source 1..24: mol_type = other DNA
acccgactcggcgccgagtcgggt

SEQ ID NO: 15378 - DNA, 24 bp, synthetic construct
  misc_feature 1..24: note = Description of Artificial Sequence: Syntheticoligonucleotide
  source 1..24: mol_type = other DNA
tcccgactcggcgccgagtcggga

SEQ ID NO: 15379 - DNA, 24 bp, synthetic construct
  misc_feature 1..24: note = Description of Artificial Sequence: Syntheticoligonucleotide
  source 1..24: mol_type = other DNA
gccagactcggcgccgagtctggc

SEQ ID NO: 15380 - DNA, 24 bp, synthetic construct
  misc_feature 1..24: note = Description of Artificial Sequence: Syntheticoligonucleotide
  source 1..24: mol_type = other DNA
gcctgactcggcgccgagtcaggc

SEQ ID NO: 15381 - DNA, 24 bp, synthetic construct
  misc_feature 1..24: note = Description of Artificial Sequence: Syntheticoligonucleotide
  source 1..24: mol_type = other DNA
gacggactcggcgccgagtccgtc

SEQ ID NO: 15382 - DNA, 24 bp, synthetic construct
  misc_feature 1..24: note = Description of Artificial Sequence: Syntheticoligonucleotide
  source 1..24: mol_type = other DNA
gtcggactcggcgccgagtccgac

SEQ ID NO: 15383 - DNA, 24 bp, synthetic construct
  misc_feature 1..24: note = Description of Artificial Sequence: Syntheticoligonucleotide
  source 1..24: mol_type = other DNA
agcggactcggcgccgagtccgct

SEQ ID NO: 15384 - DNA, 24 bp, synthetic construct
  misc_feature 1..24: note = Description of Artificial Sequence: Syntheticoligonucleotide
  source 1..24: mol_type = other DNA
tgcggactcggcgccgagtccgca

SEQ ID NO: 15385 - DNA, 24 bp, synthetic construct
  misc_feature 1..24: note = Description of Artificial Sequence: Syntheticoligonucleotide
  source 1..24: mol_type = other DNA
ggaggactcggcgccgagtcctcc

SEQ ID NO: 15386 - DNA, 24 bp, synthetic construct
  misc_feature 1..24: note = Description of Artificial Sequence: Syntheticoligonucleotide
  source 1..24: mol_type = other DNA
ggtggactcggcgccgagtccacc

SEQ ID NO: 15387 - DNA, 24 bp, synthetic construct
  misc_feature 1..24: note = Description of Artificial Sequence: Syntheticoligonucleotide
  source 1..24: mol_type = other DNA
ggcagactcggcgccgagtctgcc

SEQ ID NO: 15388 - DNA, 24 bp, synthetic construct
  misc_feature 1..24: note = Description of Artificial Sequence: Syntheticoligonucleotide
  source 1..24: mol_type = other DNA
ggctgactcggcgccgagtcagcc

SEQ ID NO: 15389 - DNA, 24 bp, synthetic construct
  misc_feature 1..24: note = Description of Artificial Sequence: Syntheticoligonucleotide
  source 1..24: mol_type = other DNA
cacggactcggcgccgagtccgtg

SEQ ID NO: 15390 - DNA, 24 bp, synthetic construct
  misc_feature 1..24: note = Description of Artificial Sequence: Syntheticoligonucleotide
  source 1..24: mol_type = other DNA
ctcggactcggcgccgagtccgag

SEQ ID NO: 15391 - DNA, 24 bp, synthetic construct
  misc_feature 1..24: note = Description of Artificial Sequence: Syntheticoligonucleotide
  source 1..24: mol_type = other DNA
ccaggactcggcgccgagtcctgg

SEQ ID NO: 15392 - DNA, 24 bp, synthetic construct
  misc_feature 1..24: note = Description of Artificial Sequence: Syntheticoligonucleotide
  source 1..24: mol_type = other DNA
cctggactcggcgccgagtccagg

SEQ ID NO: 15393 - DNA, 24 bp, synthetic construct
  misc_feature 1..24: note = Description of Artificial Sequence: Syntheticoligonucleotide
  source 1..24: mol_type = other DNA
cccagactcggcgccgagtctggg

SEQ ID NO: 15394 - DNA, 24 bp, synthetic construct
  misc_feature 1..24: note = Description of Artificial Sequence: Syntheticoligonucleotide
  source 1..24: mol_type = other DNA
ccctgactcggcgccgagtcaggg

SEQ ID NO: 15395 - DNA, 24 bp, synthetic construct
  misc_feature 1..24: note = Description of Artificial Sequence: Syntheticoligonucleotide
  source 1..24: mol_type = other DNA
acgggactcggcgccgagtcccgt

SEQ ID NO: 15396 - DNA, 24 bp, synthetic construct
  misc_feature 1..24: note = Description of Artificial Sequence: Syntheticoligonucleotide
  source 1..24: mol_type = other DNA
tcgggactcggcgccgagtcccga

SEQ ID NO: 15397 - DNA, 24 bp, synthetic construct
  misc_feature 1..24: note = Description of Artificial Sequence: Syntheticoligonucleotide
  source 1..24: mol_type = other DNA
cagggactcggcgccgagtccctg

SEQ ID NO: 15398 - DNA, 24 bp, synthetic construct
  misc_feature 1..24: note = Description of Artificial Sequence: Syntheticoligonucleotide
  source 1..24: mol_type = other DNA
ctgggactcggcgccgagtcccag

SEQ ID NO: 15399 - DNA, 24 bp, synthetic construct
  misc_feature 1..24: note = Description of Artificial Sequence: Syntheticoligonucleotide
  source 1..24: mol_type = other DNA
ccgggactctgcgcagagtcccgg

SEQ ID NO: 15400 - DNA, 24 bp, synthetic construct
  misc_feature 1..24: note = Description of Artificial Sequence: Syntheticoligonucleotide
  source 1..24: mol_type = other DNA
cccggactctgcgcagagtccggg

SEQ ID NO: 15401 - DNA, 24 bp, synthetic construct
  misc_feature 1..24: note = Description of Artificial Sequence: Syntheticoligonucleotide
  source 1..24: mol_type = other DNA
gccggactctgcgcagagtccggc

SEQ ID NO: 15402 - DNA, 24 bp, synthetic construct
  misc_feature 1..24: note = Description of Artificial Sequence: Syntheticoligonucleotide
  source 1..24: mol_type = other DNA
ggccgactctgcgcagagtcggcc

SEQ ID NO: 15403 - DNA, 24 bp, synthetic construct
  misc_feature 1..24: note = Description of Artificial Sequence: Syntheticoligonucleotide
  source 1..24: mol_type = other DNA
ggtcgactctgcgcagagtcgacc

SEQ ID NO: 15404 - DNA, 24 bp, synthetic construct
  misc_feature 1..24: note = Description of Artificial Sequence: Syntheticoligonucleotide
  source 1..24: mol_type = other DNA
gctcgactctgcgcagagtcgagc

SEQ ID NO: 15405 - DNA, 24 bp, synthetic construct
  misc_feature 1..24: note = Description of Artificial Sequence: Syntheticoligonucleotide
  source 1..24: mol_type = other DNA
accggactctgcgcagagtccggt

SEQ ID NO: 15406 - DNA, 24 bp, synthetic construct
  misc_feature 1..24: note = Description of Artificial Sequence: Syntheticoligonucleotide
  source 1..24: mol_type = other DNA
tccggactctgcgcagagtccgga

SEQ ID NO: 15407 - DNA, 24 bp, synthetic construct
  misc_feature 1..24: note = Description of Artificial Sequence: Syntheticoligonucleotide
  source 1..24: mol_type = other DNA
ccgggactcagcgctgagtcccgg

SEQ ID NO: 15408 - DNA, 24 bp, synthetic construct
  misc_feature 1..24: note = Description of Artificial Sequence: Syntheticoligonucleotide
  source 1..24: mol_type = other DNA
cccggactcagcgctgagtccggg

SEQ ID NO: 15409 - DNA, 24 bp, synthetic construct
  misc_feature 1..24: note = Description of Artificial Sequence: Syntheticoligonucleotide
  source 1..24: mol_type = other DNA
gccggactcagcgctgagtccggc

SEQ ID NO: 15410 - DNA, 24 bp, synthetic construct
  misc_feature 1..24: note = Description of Artificial Sequence: Syntheticoligonucleotide
  source 1..24: mol_type = other DNA
ggccgactcagcgctgagtcggcc

SEQ ID NO: 15411 - DNA, 24 bp, synthetic construct
  misc_feature 1..24: note = Description of Artificial Sequence: Syntheticoligonucleotide
  source 1..24: mol_type = other DNA
ggtcgactcagcgctgagtcgacc

SEQ ID NO: 15412 - DNA, 24 bp, synthetic construct
  misc_feature 1..24: note = Description of Artificial Sequence: Syntheticoligonucleotide
  source 1..24: mol_type = other DNA
gctcgactcagcgctgagtcgagc

SEQ ID NO: 15413 - DNA, 24 bp, synthetic construct
  misc_feature 1..24: note = Description of Artificial Sequence: Syntheticoligonucleotide
  source 1..24: mol_type = other DNA
accggactcagcgctgagtccggt

SEQ ID NO: 15414 - DNA, 24 bp, synthetic construct
  misc_feature 1..24: note = Description of Artificial Sequence: Syntheticoligonucleotide
  source 1..24: mol_type = other DNA
tccggactcagcgctgagtccgga

SEQ ID NO: 15415 - DNA, 23 bp, synthetic construct
  misc_feature 1..23: note = Description of Artificial Sequence: Syntheticoligonucleotide
  source 1..23: mol_type = other DNA
cctggactaccggtgagtccagg

SEQ ID NO: 15416 - DNA, 24 bp, synthetic construct
  misc_feature 1..24: note = Description of Artificial Sequence: Syntheticoligonucleotide
  source 1..24: mol_type = other DNA
ccgggactcctcgaggagtcccgg

SEQ ID NO: 15417 - DNA, 24 bp, synthetic construct
  misc_feature 1..24: note = Description of Artificial Sequence: Syntheticoligonucleotide
  source 1..24: mol_type = other DNA
cccggactcctcgaggagtccggg

SEQ ID NO: 15418 - DNA, 24 bp, synthetic construct
  misc_feature 1..24: note = Description of Artificial Sequence: Syntheticoligonucleotide
  source 1..24: mol_type = other DNA
gccggactcctcgaggagtccggc

SEQ ID NO: 15419 - DNA, 24 bp, synthetic construct
  misc_feature 1..24: note = Description of Artificial Sequence: Syntheticoligonucleotide
  source 1..24: mol_type = other DNA
ggccgactcctcgaggagtcggcc

SEQ ID NO: 15420 - DNA, 24 bp, synthetic construct
  misc_feature 1..24: note = Description of Artificial Sequence: Syntheticoligonucleotide
  source 1..24: mol_type = other DNA
ggtcgactcctcgaggagtcgacc

SEQ ID NO: 15421 - DNA, 24 bp, synthetic construct
  misc_feature 1..24: note = Description of Artificial Sequence: Syntheticoligonucleotide
  source 1..24: mol_type = other DNA
gctcgactcctcgaggagtcgagc

SEQ ID NO: 15422 - DNA, 24 bp, synthetic construct
  misc_feature 1..24: note = Description of Artificial Sequence: Syntheticoligonucleotide
  source 1..24: mol_type = other DNA
accggactcctcgaggagtccggt

SEQ ID NO: 15423 - DNA, 24 bp, synthetic construct
  misc_feature 1..24: note = Description of Artificial Sequence: Syntheticoligonucleotide
  source 1..24: mol_type = other DNA
tccggactcctcgaggagtccgga

SEQ ID NO: 15424 - DNA, 24 bp, synthetic construct
  misc_feature 1..24: note = Description of Artificial Sequence: Syntheticoligonucleotide
  source 1..24: mol_type = other DNA
gcccgactcggtaccgagtcgggc

SEQ ID NO: 15425 - DNA, 24 bp, synthetic construct
  misc_feature 1..24: note = Description of Artificial Sequence: Syntheticoligonucleotide
  source 1..24: mol_type = other DNA
gggcgactcggtaccgagtcgccc

SEQ ID NO: 15426 - DNA, 24 bp, synthetic construct
  misc_feature 1..24: note = Description of Artificial Sequence: Syntheticoligonucleotide
  source 1..24: mol_type = other DNA
gggagactcggtaccgagtctccc

SEQ ID NO: 15427 - DNA, 24 bp, synthetic construct
  misc_feature 1..24: note = Description of Artificial Sequence: Syntheticoligonucleotide
  source 1..24: mol_type = other DNA
gggtgactcggtaccgagtcaccc

SEQ ID NO: 15428 - DNA, 24 bp, synthetic construct
  misc_feature 1..24: note = Description of Artificial Sequence: Syntheticoligonucleotide
  source 1..24: mol_type = other DNA
ggacgactcggtaccgagtcgtcc

SEQ ID NO: 15429 - DNA, 24 bp, synthetic construct
  misc_feature 1..24: note = Description of Artificial Sequence: Syntheticoligonucleotide
  source 1..24: mol_type = other DNA
gcacgactcggtaccgagtcgtgc

SEQ ID NO: 15430 - DNA, 24 bp, synthetic construct
  misc_feature 1..24: note = Description of Artificial Sequence: Syntheticoligonucleotide
  source 1..24: mol_type = other DNA
gaccgactcggtaccgagtcggtc

SEQ ID NO: 15431 - DNA, 24 bp, synthetic construct
  misc_feature 1..24: note = Description of Artificial Sequence: Syntheticoligonucleotide
  source 1..24: mol_type = other DNA
gtccgactcggtaccgagtcggac

SEQ ID NO: 15432 - DNA, 24 bp, synthetic construct
  misc_feature 1..24: note = Description of Artificial Sequence: Syntheticoligonucleotide
  source 1..24: mol_type = other DNA
acccgactcggtaccgagtcgggt

SEQ ID NO: 15433 - DNA, 24 bp, synthetic construct
  misc_feature 1..24: note = Description of Artificial Sequence: Syntheticoligonucleotide
  source 1..24: mol_type = other DNA
tcccgactcggtaccgagtcggga

SEQ ID NO: 15434 - DNA, 24 bp, synthetic construct
  misc_feature 1..24: note = Description of Artificial Sequence: Syntheticoligonucleotide
  source 1..24: mol_type = other DNA
gccagactcggtaccgagtctggc

SEQ ID NO: 15435 - DNA, 24 bp, synthetic construct
  misc_feature 1..24: note = Description of Artificial Sequence: Syntheticoligonucleotide
  source 1..24: mol_type = other DNA
gcctgactcggtaccgagtcaggc

SEQ ID NO: 15436 - DNA, 24 bp, synthetic construct
  misc_feature 1..24: note = Description of Artificial Sequence: Syntheticoligonucleotide
  source 1..24: mol_type = other DNA
gacggactcggtaccgagtccgtc

SEQ ID NO: 15437 - DNA, 24 bp, synthetic construct
  misc_feature 1..24: note = Description of Artificial Sequence: Syntheticoligonucleotide
  source 1..24: mol_type = other DNA
gtcggactcggtaccgagtccgac

SEQ ID NO: 15438 - DNA, 24 bp, synthetic construct
  misc_feature 1..24: note = Description of Artificial Sequence: Syntheticoligonucleotide
  source 1..24: mol_type = other DNA
agcggactcggtaccgagtccgct

SEQ ID NO: 15439 - DNA, 24 bp, synthetic construct
  misc_feature 1..24: note = Description of Artificial Sequence: Syntheticoligonucleotide
  source 1..24: mol_type = other DNA
tgcggactcggtaccgagtccgca

SEQ ID NO: 15440 - DNA, 24 bp, synthetic construct
  misc_feature 1..24: note = Description of Artificial Sequence: Syntheticoligonucleotide
  source 1..24: mol_type = other DNA
ggaggactcggtaccgagtcctcc

SEQ ID NO: 15441 - DNA, 24 bp, synthetic construct
  misc_feature 1..24: note = Description of Artificial Sequence: Syntheticoligonucleotide
  source 1..24: mol_type = other DNA
ggtggactcggtaccgagtccacc

SEQ ID NO: 15442 - DNA, 24 bp, synthetic construct
  misc_feature 1..24: note = Description of Artificial Sequence: Syntheticoligonucleotide
  source 1..24: mol_type = other DNA
ggcagactcggtaccgagtctgcc

SEQ ID NO: 15443 - DNA, 24 bp, synthetic construct
  misc_feature 1..24: note = Description of Artificial Sequence: Syntheticoligonucleotide
  source 1..24: mol_type = other DNA
ggctgactcggtaccgagtcagcc

SEQ ID NO: 15444 - DNA, 24 bp, synthetic construct
  misc_feature 1..24: note = Description of Artificial Sequence: Syntheticoligonucleotide
  source 1..24: mol_type = other DNA
cacggactcggtaccgagtccgtg

SEQ ID NO: 15445 - DNA, 24 bp, synthetic construct
  misc_feature 1..24: note = Description of Artificial Sequence: Syntheticoligonucleotide
  source 1..24: mol_type = other DNA
ctcggactcggtaccgagtccgag

SEQ ID NO: 15446 - DNA, 24 bp, synthetic construct
  misc_feature 1..24: note = Description of Artificial Sequence: Syntheticoligonucleotide
  source 1..24: mol_type = other DNA
ccaggactcggtaccgagtcctgg

SEQ ID NO: 15447 - DNA, 24 bp, synthetic construct
  misc_feature 1..24: note = Description of Artificial Sequence: Syntheticoligonucleotide
  source 1..24: mol_type = other DNA
cctggactcggtaccgagtccagg

SEQ ID NO: 15448 - DNA, 24 bp, synthetic construct
  misc_feature 1..24: note = Description of Artificial Sequence: Syntheticoligonucleotide
  source 1..24: mol_type = other DNA
cccagactcggtaccgagtctggg

SEQ ID NO: 15449 - DNA, 24 bp, synthetic construct
  misc_feature 1..24: note = Description of Artificial Sequence: Syntheticoligonucleotide
  source 1..24: mol_type = other DNA
ccctgactcggtaccgagtcaggg

SEQ ID NO: 15450 - DNA, 24 bp, synthetic construct
  misc_feature 1..24: note = Description of Artificial Sequence: Syntheticoligonucleotide
  source 1..24: mol_type = other DNA
acgggactcggtaccgagtcccgt

SEQ ID NO: 15451 - DNA, 24 bp, synthetic construct
  misc_feature 1..24: note = Description of Artificial Sequence: Syntheticoligonucleotide
  source 1..24: mol_type = other DNA
tcgggactcggtaccgagtcccga

SEQ ID NO: 15452 - DNA, 24 bp, synthetic construct
  misc_feature 1..24: note = Description of Artificial Sequence: Syntheticoligonucleotide
  source 1..24: mol_type = other DNA
cagggactcggtaccgagtccctg

SEQ ID NO: 15453 - DNA, 24 bp, synthetic construct
  misc_feature 1..24: note = Description of Artificial Sequence: Syntheticoligonucleotide
  source 1..24: mol_type = other DNA
ctgggactcggtaccgagtcccag

SEQ ID NO: 15454 - DNA, 24 bp, synthetic construct
  misc_feature 1..24: note = Description of Artificial Sequence: Syntheticoligonucleotide
  source 1..24: mol_type = other DNA
ccgggactccacgtggagtcccgg

SEQ ID NO: 15455 - DNA, 24 bp, synthetic construct
  misc_feature 1..24: note = Description of Artificial Sequence: Syntheticoligonucleotide
  source 1..24: mol_type = other DNA
cccggactccacgtggagtccggg

SEQ ID NO: 15456 - DNA, 24 bp, synthetic construct
  misc_feature 1..24: note = Description of Artificial Sequence: Syntheticoligonucleotide
  source 1..24: mol_type = other DNA
gccggactccacgtggagtccggc

SEQ ID NO: 15457 - DNA, 24 bp, synthetic construct
  misc_feature 1..24: note = Description of Artificial Sequence: Syntheticoligonucleotide
  source 1..24: mol_type = other DNA
ggccgactccacgtggagtcggcc

SEQ ID NO: 15458 - DNA, 24 bp, synthetic construct
  misc_feature 1..24: note = Description of Artificial Sequence: Syntheticoligonucleotide
  source 1..24: mol_type = other DNA
ggtcgactccacgtggagtcgacc

SEQ ID NO: 15459 - DNA, 24 bp, synthetic construct
  misc_feature 1..24: note = Description of Artificial Sequence: Syntheticoligonucleotide
  source 1..24: mol_type = other DNA
gctcgactccacgtggagtcgagc

SEQ ID NO: 15460 - DNA, 24 bp, synthetic construct
  misc_feature 1..24: note = Description of Artificial Sequence: Syntheticoligonucleotide
  source 1..24: mol_type = other DNA
accggactccacgtggagtccggt

SEQ ID NO: 15461 - DNA, 24 bp, synthetic construct
  misc_feature 1..24: note = Description of Artificial Sequence: Syntheticoligonucleotide
  source 1..24: mol_type = other DNA
tccggactccacgtggagtccgga

SEQ ID NO: 15462 - DNA, 24 bp, synthetic construct
  misc_feature 1..24: note = Description of Artificial Sequence: Syntheticoligonucleotide
  source 1..24: mol_type = other DNA
gcccgactcggatccgagtcgggc

SEQ ID NO: 15463 - DNA, 24 bp, synthetic construct
  misc_feature 1..24: note = Description of Artificial Sequence: Syntheticoligonucleotide
  source 1..24: mol_type = other DNA
gggcgactcggatccgagtcgccc

SEQ ID NO: 15464 - DNA, 24 bp, synthetic construct
  misc_feature 1..24: note = Description of Artificial Sequence: Syntheticoligonucleotide
  source 1..24: mol_type = other DNA
gggagactcggatccgagtctccc

SEQ ID NO: 15465 - DNA, 24 bp, synthetic construct
  misc_feature 1..24: note = Description of Artificial Sequence: Syntheticoligonucleotide
  source 1..24: mol_type = other DNA
gggtgactcggatccgagtcaccc

SEQ ID NO: 15466 - DNA, 24 bp, synthetic construct
  misc_feature 1..24: note = Description of Artificial Sequence: Syntheticoligonucleotide
  source 1..24: mol_type = other DNA
ggacgactcggatccgagtcgtcc

SEQ ID NO: 15467 - DNA, 24 bp, synthetic construct
  misc_feature 1..24: note = Description of Artificial Sequence: Syntheticoligonucleotide
  source 1..24: mol_type = other DNA
gcacgactcggatccgagtcgtgc

SEQ ID NO: 15468 - DNA, 24 bp, synthetic construct
  misc_feature 1..24: note = Description of Artificial Sequence: Syntheticoligonucleotide
  source 1..24: mol_type = other DNA
gaccgactcggatccgagtcggtc

SEQ ID NO: 15469 - DNA, 24 bp, synthetic construct
  misc_feature 1..24: note = Description of Artificial Sequence: Syntheticoligonucleotide
  source 1..24: mol_type = other DNA
gtccgactcggatccgagtcggac

SEQ ID NO: 15470 - DNA, 24 bp, synthetic construct
  misc_feature 1..24: note = Description of Artificial Sequence: Syntheticoligonucleotide
  source 1..24: mol_type = other DNA
acccgactcggatccgagtcgggt

SEQ ID NO: 15471 - DNA, 24 bp, synthetic construct
  misc_feature 1..24: note = Description of Artificial Sequence: Syntheticoligonucleotide
  source 1..24: mol_type = other DNA
tcccgactcggatccgagtcggga

SEQ ID NO: 15472 - DNA, 24 bp, synthetic construct
  misc_feature 1..24: note = Description of Artificial Sequence: Syntheticoligonucleotide
  source 1..24: mol_type = other DNA
gccagactcggatccgagtctggc

SEQ ID NO: 15473 - DNA, 24 bp, synthetic construct
  misc_feature 1..24: note = Description of Artificial Sequence: Syntheticoligonucleotide
  source 1..24: mol_type = other DNA
gcctgactcggatccgagtcaggc

SEQ ID NO: 15474 - DNA, 24 bp, synthetic construct
  misc_feature 1..24: note = Description of Artificial Sequence: Syntheticoligonucleotide
  source 1..24: mol_type = other DNA
gacggactcggatccgagtccgtc

SEQ ID NO: 15475 - DNA, 24 bp, synthetic construct
  misc_feature 1..24: note = Description of Artificial Sequence: Syntheticoligonucleotide
  source 1..24: mol_type = other DNA
gtcggactcggatccgagtccgac

SEQ ID NO: 15476 - DNA, 24 bp, synthetic construct
  misc_feature 1..24: note = Description of Artificial Sequence: Syntheticoligonucleotide
  source 1..24: mol_type = other DNA
agcggactcggatccgagtccgct

SEQ ID NO: 15477 - DNA, 24 bp, synthetic construct
  misc_feature 1..24: note = Description of Artificial Sequence: Syntheticoligonucleotide
  source 1..24: mol_type = other DNA
tgcggactcggatccgagtccgca

SEQ ID NO: 15478 - DNA, 24 bp, synthetic construct
  misc_feature 1..24: note = Description of Artificial Sequence: Syntheticoligonucleotide
  source 1..24: mol_type = other DNA
ggaggactcggatccgagtcctcc

SEQ ID NO: 15479 - DNA, 24 bp, synthetic construct
  misc_feature 1..24: note = Description of Artificial Sequence: Syntheticoligonucleotide
  source 1..24: mol_type = other DNA
ggtggactcggatccgagtccacc

SEQ ID NO: 15480 - DNA, 24 bp, synthetic construct
  misc_feature 1..24: note = Description of Artificial Sequence: Syntheticoligonucleotide
  source 1..24: mol_type = other DNA
ggcagactcggatccgagtctgcc

SEQ ID NO: 15481 - DNA, 24 bp, synthetic construct
  misc_feature 1..24: note = Description of Artificial Sequence: Syntheticoligonucleotide
  source 1..24: mol_type = other DNA
ggctgactcggatccgagtcagcc

SEQ ID NO: 15482 - DNA, 24 bp, synthetic construct
  misc_feature 1..24: note = Description of Artificial Sequence: Syntheticoligonucleotide
  source 1..24: mol_type = other DNA
cacggactcggatccgagtccgtg

SEQ ID NO: 15483 - DNA, 24 bp, synthetic construct
  misc_feature 1..24: note = Description of Artificial Sequence: Syntheticoligonucleotide
  source 1..24: mol_type = other DNA
ctcggactcggatccgagtccgag

SEQ ID NO: 15484 - DNA, 24 bp, synthetic construct
  misc_feature 1..24: note = Description of Artificial Sequence: Syntheticoligonucleotide
  source 1..24: mol_type = other DNA
ccaggactcggatccgagtcctgg

SEQ ID NO: 15485 - DNA, 24 bp, synthetic construct
  misc_feature 1..24: note = Description of Artificial Sequence: Syntheticoligonucleotide
  source 1..24: mol_type = other DNA
cctggactcggatccgagtccagg

SEQ ID NO: 15486 - DNA, 24 bp, synthetic construct
  misc_feature 1..24: note = Description of Artificial Sequence: Syntheticoligonucleotide
  source 1..24: mol_type = other DNA
cccagactcggatccgagtctggg

SEQ ID NO: 15487 - DNA, 24 bp, synthetic construct
  misc_feature 1..24: note = Description of Artificial Sequence: Syntheticoligonucleotide
  source 1..24: mol_type = other DNA
ccctgactcggatccgagtcaggg

SEQ ID NO: 15488 - DNA, 24 bp, synthetic construct
  misc_feature 1..24: note = Description of Artificial Sequence: Syntheticoligonucleotide
  source 1..24: mol_type = other DNA
acgggactcggatccgagtcccgt

SEQ ID NO: 15489 - DNA, 24 bp, synthetic construct
  misc_feature 1..24: note = Description of Artificial Sequence: Syntheticoligonucleotide
  source 1..24: mol_type = other DNA
tcgggactcggatccgagtcccga

SEQ ID NO: 15490 - DNA, 24 bp, synthetic construct
  misc_feature 1..24: note = Description of Artificial Sequence: Syntheticoligonucleotide
  source 1..24: mol_type = other DNA
cagggactcggatccgagtccctg

SEQ ID NO: 15491 - DNA, 24 bp, synthetic construct
  misc_feature 1..24: note = Description of Artificial Sequence: Syntheticoligonucleotide
  source 1..24: mol_type = other DNA
ctgggactcggatccgagtcccag

SEQ ID NO: 15492 - DNA, 24 bp, synthetic construct
  misc_feature 1..24: note = Description of Artificial Sequence: Syntheticoligonucleotide
  source 1..24: mol_type = other DNA
ccgggactccgtacggagtcccgg

SEQ ID NO: 15493 - DNA, 24 bp, synthetic construct
  misc_feature 1..24: note = Description of Artificial Sequence: Syntheticoligonucleotide
  source 1..24: mol_type = other DNA
cccggactccgtacggagtccggg

SEQ ID NO: 15494 - DNA, 24 bp, synthetic construct
  misc_feature 1..24: note = Description of Artificial Sequence: Syntheticoligonucleotide
  source 1..24: mol_type = other DNA
gccggactccgtacggagtccggc

SEQ ID NO: 15495 - DNA, 24 bp, synthetic construct
  misc_feature 1..24: note = Description of Artificial Sequence: Syntheticoligonucleotide
  source 1..24: mol_type = other DNA
ggccgactccgtacggagtcggcc

SEQ ID NO: 15496 - DNA, 24 bp, synthetic construct
  misc_feature 1..24: note = Description of Artificial Sequence: Syntheticoligonucleotide
  source 1..24: mol_type = other DNA
ggtcgactccgtacggagtcgacc

SEQ ID NO: 15497 - DNA, 24 bp, synthetic construct
  misc_feature 1..24: note = Description of Artificial Sequence: Syntheticoligonucleotide
  source 1..24: mol_type = other DNA
gctcgactccgtacggagtcgagc

SEQ ID NO: 15498 - DNA, 24 bp, synthetic construct
  misc_feature 1..24: note = Description of Artificial Sequence: Syntheticoligonucleotide
  source 1..24: mol_type = other DNA
accggactccgtacggagtccggt

SEQ ID NO: 15499 - DNA, 24 bp, synthetic construct
  misc_feature 1..24: note = Description of Artificial Sequence: Syntheticoligonucleotide
  source 1..24: mol_type = other DNA
tccggactccgtacggagtccgga

SEQ ID NO: 15500 - DNA, 24 bp, synthetic construct
  misc_feature 1..24: note = Description of Artificial Sequence: Syntheticoligonucleotide
  source 1..24: mol_type = other DNA
ccgggactccgatcggagtcccgg

SEQ ID NO: 15501 - DNA, 24 bp, synthetic construct
  misc_feature 1..24: note = Description of Artificial Sequence: Syntheticoligonucleotide
  source 1..24: mol_type = other DNA
cccggactccgatcggagtccggg

SEQ ID NO: 15502 - DNA, 24 bp, synthetic construct
  misc_feature 1..24: note = Description of Artificial Sequence: Syntheticoligonucleotide
  source 1..24: mol_type = other DNA
gccggactccgatcggagtccggc

SEQ ID NO: 15503 - DNA, 24 bp, synthetic construct
  misc_feature 1..24: note = Description of Artificial Sequence: Syntheticoligonucleotide
  source 1..24: mol_type = other DNA
ggccgactccgatcggagtcggcc

SEQ ID NO: 15504 - DNA, 24 bp, synthetic construct
  misc_feature 1..24: note = Description of Artificial Sequence: Syntheticoligonucleotide
  source 1..24: mol_type = other DNA
ggtcgactccgatcggagtcgacc

SEQ ID NO: 15505 - DNA, 24 bp, synthetic construct
  misc_feature 1..24: note = Description of Artificial Sequence: Syntheticoligonucleotide
  source 1..24: mol_type = other DNA
gctcgactccgatcggagtcgagc

SEQ ID NO: 15506 - DNA, 24 bp, synthetic construct
  misc_feature 1..24: note = Description of Artificial Sequence: Syntheticoligonucleotide
  source 1..24: mol_type = other DNA
accggactccgatcggagtccggt

SEQ ID NO: 15507 - DNA, 24 bp, synthetic construct
  misc_feature 1..24: note = Description of Artificial Sequence: Syntheticoligonucleotide
  source 1..24: mol_type = other DNA
tccggactccgatcggagtccgga

SEQ ID NO: 15508-15514 - skipped (7 entries)

SEQ ID NO: 15515 - DNA, 38 bp, synthetic construct
  misc_feature 1..38: note = Description of Artificial Sequence: Syntheticoligonucleotide
  misc_difference 1..4: note = a, c, t, or g
  misc_difference 10..15: note = a, c, t, or g
  misc_difference 21..38: note = a, c, t, or g
  misc_feature 1..38: note = See specification as filed for detailed description ofsubstitutions and preferred embodiments
  source 1..38: mol_type = other DNA
nnnngactcnnnnnngagtcnnnnnnnnnnnnnnnnnn

SEQ ID NO: 15516 - DNA, 22 bp, synthetic construct
  misc_feature 1..22: note = Description of Artificial Sequence: Syntheticoligonucleotide
  source 1..22: mol_type = other DNA
ccgggactccgcggagtcccgg

SEQ ID NO: 15517 - DNA, 22 bp, synthetic construct
  misc_feature 1..22: note = Description of Artificial Sequence: Syntheticoligonucleotide
  source 1..22: mol_type = other DNA
cccggactccgcggagtccggg

SEQ ID NO: 15518 - DNA, 22 bp, synthetic construct
  misc_feature 1..22: note = Description of Artificial Sequence: Syntheticoligonucleotide
  source 1..22: mol_type = other DNA
gccggactccgcggagtccggc

SEQ ID NO: 15519 - DNA, 22 bp, synthetic construct
  misc_feature 1..22: note = Description of Artificial Sequence: Syntheticoligonucleotide
  source 1..22: mol_type = other DNA
ggccgactccgcggagtcggcc

SEQ ID NO: 15520 - DNA, 22 bp, synthetic construct
  misc_feature 1..22: note = Description of Artificial Sequence: Syntheticoligonucleotide
  source 1..22: mol_type = other DNA
accggactccgcggagtccggt

SEQ ID NO: 15521 - DNA, 22 bp, synthetic construct
  misc_feature 1..22: note = Description of Artificial Sequence: Syntheticoligonucleotide
  source 1..22: mol_type = other DNA
ccgggactctgcagagtcccgg

SEQ ID NO: 15522 - DNA, 22 bp, synthetic construct
  misc_feature 1..22: note = Description of Artificial Sequence: Syntheticoligonucleotide
  source 1..22: mol_type = other DNA
cccggactctgcagagtccggg

SEQ ID NO: 15523 - DNA, 22 bp, synthetic construct
  misc_feature 1..22: note = Description of Artificial Sequence: Syntheticoligonucleotide
  source 1..22: mol_type = other DNA
gccggactctgcagagtccggc

SEQ ID NO: 15524 - DNA, 22 bp, synthetic construct
  misc_feature 1..22: note = Description of Artificial Sequence: Syntheticoligonucleotide
  source 1..22: mol_type = other DNA
ggccgactctgcagagtcggcc

SEQ ID NO: 15525 - DNA, 22 bp, synthetic construct
  misc_feature 1..22: note = Description of Artificial Sequence: Syntheticoligonucleotide
  source 1..22: mol_type = other DNA
ccgggactcagctgagtcccgg

SEQ ID NO: 15526 - DNA, 22 bp, synthetic construct
  misc_feature 1..22: note = Description of Artificial Sequence: Syntheticoligonucleotide
  source 1..22: mol_type = other DNA
cccggactcagctgagtccggg

SEQ ID NO: 15527 - DNA, 22 bp, synthetic construct
  misc_feature 1..22: note = Description of Artificial Sequence: Syntheticoligonucleotide
  source 1..22: mol_type = other DNA
gccggactcagctgagtccggc

SEQ ID NO: 15528 - DNA, 22 bp, synthetic construct
  misc_feature 1..22: note = Description of Artificial Sequence: Syntheticoligonucleotide
  source 1..22: mol_type = other DNA
ggccgactcagctgagtcggcc

SEQ ID NO: 15529 - DNA, 22 bp, synthetic construct
  misc_feature 1..22: note = Description of Artificial Sequence: Syntheticoligonucleotide
  source 1..22: mol_type = other DNA
ccgggactcctaggagtcccgg

SEQ ID NO: 15530 - DNA, 22 bp, synthetic construct
  misc_feature 1..22: note = Description of Artificial Sequence: Syntheticoligonucleotide
  source 1..22: mol_type = other DNA
cccggactcctaggagtccggg

SEQ ID NO: 15531 - DNA, 22 bp, synthetic construct
  misc_feature 1..22: note = Description of Artificial Sequence: Syntheticoligonucleotide
  source 1..22: mol_type = other DNA
gccggactcctaggagtccggc

SEQ ID NO: 15532 - DNA, 22 bp, synthetic construct
  misc_feature 1..22: note = Description of Artificial Sequence: Syntheticoligonucleotide
  source 1..22: mol_type = other DNA
ggccgactcctaggagtcggcc

SEQ ID NO: 15533 - DNA, 22 bp, synthetic construct
  misc_feature 1..22: note = Description of Artificial Sequence: Syntheticoligonucleotide
  source 1..22: mol_type = other DNA
ccgggactccatggagtcccgg

SEQ ID NO: 15534 - DNA, 22 bp, synthetic construct
  misc_feature 1..22: note = Description of Artificial Sequence: Syntheticoligonucleotide
  source 1..22: mol_type = other DNA
cccggactccatggagtccggg

SEQ ID NO: 15535 - DNA, 22 bp, synthetic construct
  misc_feature 1..22: note = Description of Artificial Sequence: Syntheticoligonucleotide
  source 1..22: mol_type = other DNA
gccggactccatggagtccggc

SEQ ID NO: 15536 - DNA, 22 bp, synthetic construct
  misc_feature 1..22: note = Description of Artificial Sequence: Syntheticoligonucleotide
  source 1..22: mol_type = other DNA
ggccgactccatggagtcggcc

SEQ ID NO: 15537 - DNA, 22 bp, synthetic construct
  misc_feature 1..22: note = Description of Artificial Sequence: Syntheticoligonucleotide
  source 1..22: mol_type = other DNA
ccgggactcgcgcgagtcccgg

SEQ ID NO: 15538 - DNA, 22 bp, synthetic construct
  misc_feature 1..22: note = Description of Artificial Sequence: Syntheticoligonucleotide
  source 1..22: mol_type = other DNA
cccggactcgcgcgagtccggg

SEQ ID NO: 15539 - DNA, 22 bp, synthetic construct
  misc_feature 1..22: note = Description of Artificial Sequence: Syntheticoligonucleotide
  source 1..22: mol_type = other DNA
gccggactcgcgcgagtccggc

SEQ ID NO: 15540 - DNA, 22 bp, synthetic construct
  misc_feature 1..22: note = Description of Artificial Sequence: Syntheticoligonucleotide
  source 1..22: mol_type = other DNA
ggccgactcgcgcgagtcggcc

SEQ ID NO: 15541 - DNA, 22 bp, synthetic construct
  misc_feature 1..22: note = Description of Artificial Sequence: Syntheticoligonucleotide
  source 1..22: mol_type = other DNA
accggactcgcgcgagtccggt

SEQ ID NO: 15542 - DNA, 22 bp, synthetic construct
  misc_feature 1..22: note = Description of Artificial Sequence: Syntheticoligonucleotide
  source 1..22: mol_type = other DNA
ccgggactctcgagagtcccgg

SEQ ID NO: 15543 - DNA, 22 bp, synthetic construct
  misc_feature 1..22: note = Description of Artificial Sequence: Syntheticoligonucleotide
  source 1..22: mol_type = other DNA
cccggactctcgagagtccggg

SEQ ID NO: 15544 - DNA, 22 bp, synthetic construct
  misc_feature 1..22: note = Description of Artificial Sequence: Syntheticoligonucleotide
  source 1..22: mol_type = other DNA
gccggactctcgagagtccggc

SEQ ID NO: 15545 - DNA, 22 bp, synthetic construct
  misc_feature 1..22: note = Description of Artificial Sequence: Syntheticoligonucleotide
  source 1..22: mol_type = other DNA
ggccgactctcgagagtcggcc

SEQ ID NO: 15546 - DNA, 22 bp, synthetic construct
  misc_feature 1..22: note = Description of Artificial Sequence: Syntheticoligonucleotide
  source 1..22: mol_type = other DNA
ccgggactcacgtgagtcccgg

SEQ ID NO: 15547 - DNA, 22 bp, synthetic construct
  misc_feature 1..22: note = Description of Artificial Sequence: Syntheticoligonucleotide
  source 1..22: mol_type = other DNA
cccggactcacgtgagtccggg

SEQ ID NO: 15548 - DNA, 22 bp, synthetic construct
  misc_feature 1..22: note = Description of Artificial Sequence: Syntheticoligonucleotide
  source 1..22: mol_type = other DNA
gccggactcacgtgagtccggc

SEQ ID NO: 15549 - DNA, 22 bp, synthetic construct
  misc_feature 1..22: note = Description of Artificial Sequence: Syntheticoligonucleotide
  source 1..22: mol_type = other DNA
ggccgactcacgtgagtcggcc

SEQ ID NO: 15550 - DNA, 22 bp, synthetic construct
  misc_feature 1..22: note = Description of Artificial Sequence: Syntheticoligonucleotide
  source 1..22: mol_type = other DNA
ccgggactcgtacgagtcccgg

SEQ ID NO: 15551 - DNA, 22 bp, synthetic construct
  misc_feature 1..22: note = Description of Artificial Sequence: Syntheticoligonucleotide
  source 1..22: mol_type = other DNA
cccggactcgtacgagtccggg

SEQ ID NO: 15552 - DNA, 22 bp, synthetic construct
  misc_feature 1..22: note = Description of Artificial Sequence: Syntheticoligonucleotide
  source 1..22: mol_type = other DNA
gccggactcgtacgagtccggc

SEQ ID NO: 15553 - DNA, 22 bp, synthetic construct
  misc_feature 1..22: note = Description of Artificial Sequence: Syntheticoligonucleotide
  source 1..22: mol_type = other DNA
ggccgactcgtacgagtcggcc

SEQ ID NO: 15554 - DNA, 22 bp, synthetic construct
  misc_feature 1..22: note = Description of Artificial Sequence: Syntheticoligonucleotide
  source 1..22: mol_type = other DNA
ccgggactcgatcgagtcccgg

SEQ ID NO: 15555 - DNA, 22 bp, synthetic construct
  misc_feature 1..22: note = Description of Artificial Sequence: Syntheticoligonucleotide
  source 1..22: mol_type = other DNA
cccggactcgatcgagtccggg

SEQ ID NO: 15556 - DNA, 22 bp, synthetic construct
  misc_feature 1..22: note = Description of Artificial Sequence: Syntheticoligonucleotide
  source 1..22: mol_type = other DNA
ggcggactcgatcgagtccgcc

SEQ ID NO: 15557 - DNA, 22 bp, synthetic construct
  misc_feature 1..22: note = Description of Artificial Sequence: Syntheticoligonucleotide
  source 1..22: mol_type = other DNA
gccggactcgatcgagtccggc

SEQ ID NO: 15558 - DNA, 22 bp, synthetic construct
  misc_feature 1..22: note = Description of Artificial Sequence: Syntheticoligonucleotide
  source 1..22: mol_type = other DNA
gcccgactcgatcgagtcgggc

SEQ ID NO: 15559 - DNA, 22 bp, synthetic construct
  misc_feature 1..22: note = Description of Artificial Sequence: Syntheticoligonucleotide
  source 1..22: mol_type = other DNA
ggccgactcgatcgagtcggcc

SEQ ID NO: 15560 - DNA, 22 bp, synthetic construct
  misc_feature 1..22: note = Description of Artificial Sequence: Syntheticoligonucleotide
  source 1..22: mol_type = other DNA
gggcgactcgatcgagtcgccc

SEQ ID NO: 15561 - DNA, 22 bp, synthetic construct
  misc_feature 1..22: note = Description of Artificial Sequence: Syntheticoligonucleotide
  source 1..22: mol_type = other DNA
ccgggactcggccgagtcccgg

SEQ ID NO: 15562 - DNA, 22 bp, synthetic construct
  misc_feature 1..22: note = Description of Artificial Sequence: Syntheticoligonucleotide
  source 1..22: mol_type = other DNA
cccggactcggccgagtccggg

SEQ ID NO: 15563 - DNA, 22 bp, synthetic construct
  misc_feature 1..22: note = Description of Artificial Sequence: Syntheticoligonucleotide
  source 1..22: mol_type = other DNA
gccggactcggccgagtccggc

SEQ ID NO: 15564 - DNA, 22 bp, synthetic construct
  misc_feature 1..22: note = Description of Artificial Sequence: Syntheticoligonucleotide
  source 1..22: mol_type = other DNA
ggccgactcggccgagtcggcc

SEQ ID NO: 15565 - DNA, 22 bp, synthetic construct
  misc_feature 1..22: note = Description of Artificial Sequence: Syntheticoligonucleotide
  source 1..22: mol_type = other DNA
accggactcggccgagtccggt

SEQ ID NO: 15566 - DNA, 22 bp, synthetic construct
  misc_feature 1..22: note = Description of Artificial Sequence: Syntheticoligonucleotide
  source 1..22: mol_type = other DNA
ccgggactcccgggagtcccgg

SEQ ID NO: 15567 - DNA, 22 bp, synthetic construct
  misc_feature 1..22: note = Description of Artificial Sequence: Syntheticoligonucleotide
  source 1..22: mol_type = other DNA
cccggactcccgggagtccggg

SEQ ID NO: 15568 - DNA, 22 bp, synthetic construct
  misc_feature 1..22: note = Description of Artificial Sequence: Syntheticoligonucleotide
  source 1..22: mol_type = other DNA
gccggactcccgggagtccggc

SEQ ID NO: 15569 - DNA, 22 bp, synthetic construct
  misc_feature 1..22: note = Description of Artificial Sequence: Syntheticoligonucleotide
  source 1..22: mol_type = other DNA
ggccgactcccgggagtcggcc

SEQ ID NO: 15570 - DNA, 22 bp, synthetic construct
  misc_feature 1..22: note = Description of Artificial Sequence: Syntheticoligonucleotide
  source 1..22: mol_type = other DNA
accggactcccgggagtccggt

What is claimed is:

1. A method of designing a primer oligonucleotide, the primer oligonucleotide comprising from 5' to 3':
   i) a first region comprising a self-complementary sequence comprising from 5' to 3' the reverse complement of a nicking enzyme recognition sequence, a palindromic sequence, and the nicking enzyme recognition sequence, and
   ii) a second region at least 16 nucleotides long that specifically binds to a complementary region on a target nucleic acid molecule, wherein the second region of the primer oligonucleotide comprises two or more 2' modified nucleotides, wherein the two or more 2' modified nucleotides are selected from the group consisting of 2'-O—methyl, 2'-methoxyethoxy, 2'-fluoro, 2'-hydroxyl, 2'-alkyl, 2'-allyl, 2'-O-[2-(methylamino)-2-oxoethyl], 4'-CH$_2$—O-2'-bridge, 4'-(CH2)$_2$—O-2'-bridge, 2'-LNA, and 2'-O-(N-methylcarbamate) and those comprising base analogs, and wherein two or more 2' modified nucleotides are contiguous;

the method comprising:
a) selecting the second region of said primer oligonucleotide, so that the $\Delta G$ for a double-stranded primer-target hybrid formed by the hybridization of the second region and the target nucleic acid molecule is at least 15 kcal/mol lower than the $\Delta G$ of a self-dimer comprising the second region of the primer; and b) selecting a first region of said primer oligonucleotide, so that the ΔG for a homodimer formed by hybridization of the self-complementary first region of two primer oligonucleotide molecules is at least 15 kcal/mol lower than the ΔG of a self-dimer comprising the second region of the primer oligonucleotide.

2. The method of claim 1, wherein said palindromic sequence in the first region of the primer oligonucleotide is 2, 4, or 6 nucleotides long.

3. The method of claim 1, wherein the first region of the primer oligonucleotide is 12, 13, 14, 15, 16, 17, 18, 19, 20, 21, 22, 23, or 24 nucleotides in length.

4. The method of claim 1, wherein the first region of the primer oligonucleotide is fully self-complementary.

5. The method of claim 1, wherein the second region of the primer oligonucleotide is 16, 17, 18, 19, 20, 21, 22, 23, 24, 25, 26, 27, 28, 29, or 30 nucleotides in length.

6. The method of claim 1, wherein the two or more 240 modified nucleotides are positioned at the 3' terminus of the second region of the primer oligonucleotide.

7. The method of claim 1, wherein the number of contiguous 2' modified nucleotides is 3, 4, 5, or 6.

8. The method of claim 1, wherein the nicking enzyme recognition sequence within the first region of the primer oligonucleotide is 5'-GAGTC-3'.

9. The method of claim 1, wherein the nicking enzyme recognition sequence is positioned to cleave the phosphodiester bond between the first and second regions of the primer oligonucleotide.

10. The method of claim 1, wherein the first region of the primer oligonucleotide comprises a nucleic acid sequence selected from the group consisting of:

5'-GACTCN$_1$N$_{1'}$GAGTC-3'; (SEQ ID NO: 15241)

5'-GACTCN$_1$N$_{1'}$GAGTCN-3'; (SEQ ID NO: 15242)

5'-N$_2$GACTCN$_1$N$_{1'}$GAGTCN$_{2'}$-3'; (SEQ ID NO: 15243)

5'-N$_2$GACTCN$_1$N$_{1'}$GAGTCN$_{2'}$N-3'; (SEQ ID NO: 15244)

5'-N$_3$N$_2$GACTCN$_1$N$_{1'}$GAGTCN$_{2'}$N$_{3'}$-3'; (SEQ ID NO: 15245)

5'-N$_3$N$_2$GACTCN$_1$N$_{1'}$GAGTCN$_{2'}$N$_{3'}$N-3'; (SEQ ID NO: 15246)

5'-N$_4$N$_3$N$_2$GACTCN$_1$N$_{1'}$GAGTCN$_{2'}$N$_{3'}$N$_{4'}$-3'; (SEQ ID NO: 15247)

5'-N$_4$N$_3$N$_2$GACTCN$_1$N$_{1'}$GAGTCN$_{2'}$N$_{3'}$N$_{4'}$N-3'; (SEQ ID NO: 15248)

5'-N$_5$N$_4$N$_3$N$_2$GACTCN$_1$N$_{1'}$GAGTCN$_{2'}$N$_{3'}$N$_{4'}$N$_{5'}$-3' (SEQ ID NO: 15249)

5'-GACTCN$_2$N$_1$N$_{1'}$N$_{2'}$GAGTC-3'; (SEQ ID NO: 15250)

5'-GACTCN$_2$N$_1$N$_{1'}$N$_{2'}$GAGTCN-3'; (SEQ ID NO: 15251)

5'-N$_3$GACTCN$_2$N$_1$N$_{1'}$N$_{2'}$GAGTCN$_{3'}$-3'; (SEQ ID NO: 15252)

5'-N$_3$GACTCN$_2$N$_1$N$_{1'}$N$_{2'}$GAGTCN$_{3'}$N-3'; (SEQ ID NO: 15253)

5'-N$_4$N$_3$GACTCN$_2$N$_1$N$_{1'}$N$_{2'}$GAGTCN$_{3'}$N$_{4'}$-3'; (SEQ ID NO: 15254)

5'-N$_4$N$_3$GACTCN$_2$N$_1$N$_{1'}$N$_{2'}$GAGTCN$_{3'}$N$_{4'}$N-3'; (SEQ ID NO: 15255)

5'-N$_5$N$_4$N$_3$GACTCN$_2$N$_1$N$_{1'}$N$_{2'}$GAGTCN$_{3'}$N$_{4'}$N$_{5'}$-3'; (SEQ ID NO: 15256)

5'-N$_5$N$_4$N$_3$GACTCN$_2$N$_1$N$_{1'}$N$_{2'}$GAGTCN$_{3'}$N$_{4'}$N$_{5'}$N-3'; (SEQ ID NO: 15257)

5'-N$_6$N$_5$N$_4$N$_3$GACTCN$_2$N$_1$N$_{1'}$N$_{2'}$GAGTCN$_{3'}$N$_{4'}$N$_{5'}$N$_{6'}$-3', (SEQ ID NO: 15258)

5'-GACTCN$_3$N$_2$N$_1$N$_{1'}$N$_{2'}$N$_{3'}$GAGTC-3'; (SEQ ID NO: 15259)

5'-GACTCN$_3$N$_2$N$_1$N$_{1'}$N$_{2'}$N$_{3'}$GAGTCN-3'; (SEQ ID NO: 15260)

5'-GACTCN$_3$N$_2$N$_1$N$_{1'}$N$_{2'}$N$_{3'}$GAGTCNN-3'; (SEQ ID NO: 15261)

5'-GACTCN$_3$N$_2$N$_1$N$_{1'}$N$_{2'}$N$_{3'}$GAGTCNNN-3'; (SEQ ID NO: 15262)

5'-GACTCN$_3$N$_2$N$_1$N$_{1'}$N$_{2'}$N$_{3'}$GAGTCNNNN-3'; (SEQ ID NO: 15263)

5'-N$_4$GACTCN$_3$N$_2$N$_1$N$_{1'}$N$_{2'}$N$_{3'}$GAGTCN$_{4'}$-3'; (SEQ ID NO: 15264)

5'-N$_4$GACTCN$_3$N$_2$N$_1$N$_{1'}$N$_{2'}$N$_{3'}$GAGTCN$_{4'}$N-3'; (SEQ ID NO: 15265)

5'-N$_4$GACTCN$_3$N$_2$N$_1$N$_{1'}$N$_{2'}$N$_{3'}$GAGTCN$_{4'}$NN-3'; (SEQ ID NO: 15266)

5'-N$_4$GACTCN$_3$N$_2$N$_1$N$_{1'}$N$_{2'}$N$_{3'}$GAGTCN$_{4'}$NNN-3'; (SEQ ID NO: 15267)

5'-N$_5$N$_4$GACTCN$_3$N$_2$N$_1$N$_{1'}$N$_{2'}$N$_{3'}$GAGTCN$_{4'}$N$_{5'}$-3'; (SEQ ID NO: 15268)

5'-N$_5$N$_4$GACTCN$_3$N$_2$N$_1$N$_{1'}$N$_{2'}$N$_{3'}$GAGTCN$_{4'}$N$_{5'}$N-3'; (SEQ ID NO: 15269)

5'-NN$_5$N$_4$GACTCN$_3$N$_2$N$_1$N$_{1'}$N$_{2'}$N$_{3'}$GAGTCN$_{4'}$N$_{5'}$N$_{6'}$-3'; (SEQ ID NO: 15270)

5'-NN$_5$N$_4$GACTCN$_3$N$_2$N$_1$N$_{1'}$N$_{2'}$N$_{3'}$GAGTCN$_{4'}$N$_{5'}$N$_{6'}$N-3'; (SEQ ID NO: 15271)

and

5'-N$_7$N$_6$N$_5$N$_4$GACTCN$_3$N$_2$N$_1$N$_{1'}$N$_{2'}$N$_{3'}$GAGTCN$_{4'}$N$_{5'}$N$_{6'}$N$_{7'}$-3', (SEQ ID NO: 15272)

where N is any nucleotide, and N$_1$ is complementary to N$_{1'}$, N$_2$ to N$_{2'}$, N$_3$ to N$_{3'}$, N$_4$ to N$_{4'}$, N$_5$ to N$_{5'}$, N$_6$ to N$_{6'}$, and N$_7$ to N$_{7'}$.

* * * * *